United States Patent 7,833,706 (GENETIC POLYMORPHISMS ASSOCIATED WITH RHEUMATOID ARTHRITIS, METHODS OF DETECTION AND USES THEREOF) - sequence listing, part 4

SEQ ID NO: 10616 - DNA, 765267 bp, Homo sapiens
  misc_feature (1)...(765267): n = A,T,C or G, or insertion/deletion polymorphism (see Tables 1-2)
ttttatagaacagggaagatacatatctggaagataaactgactcatgaagattatatatttacactggtgtgtctcagtcactatatctgagggcccagagatgacggagaaggaaatagggtgaggtgggtgcttcttgccatcctgaggcatcatttccgcagtcttctctgcaaacacctgcattttccatgaaatctggattgtgctgagagtgtctctccttaaacattttttggatctgagcttccaaattctttttctgaaattgcgtttaaggcgatcagccagatttcaatgaaagcctttgctttatatgaagcataaagtagagcttaaatgaacagaaggtcatttgtcttgtttttcaaaaagaaaaaaaaaacctcaccatttttgtagcataactaaagcaatctgaaggcttttttcttttgtgtgatagaatttagagaaacgtactgtgctatcaagaaagggttcaaataagagcttctaaggaagatgttcttctcaatgtgtgggtgataattttaagttgtcttcctttgagactctgcctctgtcagtgttttacttgataacagaactcactgagtcagaagctggcaatttcatcatgatgcattttcttatttaccattcaagaggtgtaagccttatctcttatattaatgtgaaaagtaatgaaaataatgatgccaaaggcatttaattcttggctctaatactttataagtgtgcctcttgttcacataatttactgggcaggggaacaagtcatcagggtgacctttttccatggagttaatcagggactcaaactaacagaagctctgccttcttcagtgcgtggcttccaaggtcaccaccaggatcactttcattctggccagccaggcagggaagagcatggatcagcacatatgggagggtttgacctgccaaaggctactgactgtaacccagatgtggttattataaagctggttctgggtagtttttctccatatctctcttatatcaaaaaaggtgagttaaaggagccctgattcttagatgcaattagaactcatttattcatgatggaaaagagcttttcagttctagaaggttagagacaaaaatgaatatgattaaagtttatagaatcaatgcagccaaaaagaagtttactaaatcacagaccacagaattagaatgctgtcttttaagactaaaagagttatttagggcatagaaagggaatatagtagaatttcagaataaccatatgtgtgttaactactattgattaccgctgtgacagggacttagatatatgatttcatttaatctttgcaatacctctttaagacagcttactgtggtggttaaatatgtaggctctggggtcaaactgcctagtttaaattctggttcactcacttactagctggaaaatgttgaacaactacttaacacttctctgactcagattacccagctataaagtggagataatagtaacccggctcctaggggttaatatgacagtgaatgcattaaaaatgtaaaaccctgagaagagtatgtgacataaaaagctttgacattattattatttctccatttacatattaggaccttgtatttcagaagagataagagactttcccacggttacgtacgtagtaattggtagaactggctgttaaaagatatgtctattcaaatcaaaacactgtccttcccactgtggcaggcctcaagtgagttatgagctgacaagagactggagtacataccacaatctagtttctagggaaattaggactatttatattacactgtggttaaaaggagagagaaactactcatatctgccttataagttgtagaagtatctaccatggtagttaagagtctaggttctaaagtcagacttcctaggtctccatctcaattccgaattttgtaactggaggaggttaatccatcctccaaactttagtatataaatcagtaaaatagcatacaataatattatctaccagatcagctgagagtaacaataaagcttaaataataaagagatttattatctcactcattaaaaagtctaaagaaaatttaaagggtttaaaaagctcatgaaggaccaggtttctttgcatctttcttgtcagtgtcctctttacataacaatatgagacagagaaagagaatttccctgaagacattagtcagaactgagcccctcatatagctcttaaaccagttacagacaaaggggaatggaattattgacattagtttaggccaatcatagtttgttccttggaaagagagaggggccatgtttcctaagcatgacgaccacccaaattaagtcagggtttgcttacaagaaaaagagggtggagagtggtgttgaataggaagggttatgttttttagtgtctgggaagtgcttagcttagtgctctgacccacagtgagtgctcaataaaggttagctttgccagctccctgaggctgacattcccagagggcaattctgtgctctcacaaaaaacagaccttcctattgtttcaaaaaacagtacacagcaccgaacttgacggatcacaggcctggctcacacaattttggatttcttacagatccctttgcatagcaaaaatctccacacttggacacaggaaggggaacatcacacaccgggaactgttgtggggtggggggacgggggagggatagcattaggagatatacctaatgctaaatgatgagttaatgggtgcagcacaacaacatggcacgtgtatacatatgtaactaacctgaacgttgtgcacacgtaccctaaaacttaaagtataataataataatttaaaaaaaagaatgggaaaaaaaacaaaaaaactccacactttagaaacatttctatcttgtatactgaacaaaaggtgtggaaaatgagggagttaaaccatgctgcttcaagcatcatgctacatgttgaaggtatttatcctgtagttctcctttaacaaactgcgtcattttgctggctgaagaaactcttgcagcccatgtttgtcttgaagacaaatcctgttcagatttctacagcgttctctcctttttacgtccacgttcacagcaacagctgggaggaatcagggatgctagatgaaatactcaactatccattgccaataatggtggttaccaaatgactcccaactcagtgccattcaacaatgaacgtttattgtcatgttcatgagtctgcaggttggctgagtctgggagatctaggatggtttctactggacttgcttccaagctgtaaatggggcttaggtctgtcctgattgtctccttagatcagaggctccctgaggcatgtttatctcatggaaatgataagaaacccaagagggaaagcccaacctcaaagcatattttgagcctttgctaatatcacatcttcaaacatgccattggccaaagcaagtcacattgtccaacatcaatgggatggataaataaacagggtgtctagtaaaaactgtaaggtcacaaagaaaaatgtgtggacgcagaaaggagcagggagcagagagctatgatgcaataaactaccacaggaggctcaatctacttcttattttgcttagagctcattgtaactctccaatctcctcttctagtgagcgcagccctgtcttgccttcctaagccactgtgacaggtaaaaactatttggccaataatctttccagtaaataacaaagagatagaaggagaaaaggaaaagaaaggaaaggaaaggaggaaaggaaaggaaaggaaaggaaaggaaaggaaaggaaaacaatttggtatgatcagttgtaaggacaattgagaagttctggagccctggaagcagagtttcattgcagtactctgaagtagagaaaatcgacttgagacggtgactgataccttctgtgaggtaattagcaagccaaggctgctggctagagggactgtggaccattcaggttttagtttagggacatgtgatcaaaatgaaaccagtcagtttttcatgaaattctttgtagcaattggcttccaagcacaaggcaagaccctcaaatgacagcaagagtcatgggtcttgttcaccaggttatccatggtgattacaatagtggctagtatacagctggctaccaataagtatattttaaatgcattgaaatatttaatagcaaatttctgtattggattttggtaatcttttgactgagttcataagcattgggccttggagtcctgagggcagagaacagggagaatgaaggattaagagaacgtagtgtttctctccatttttctctcttcgtattctttcttctttttaaaaatcaacctttttgagatataatttatttaaaacaaactgcactcaatttaggcgtacttacagaacttacaagttttgataaacacacacacgatatagaacatttccgacatgctcatcaggtgctcgtagcccttccctgtccatctctacctatccctggccacaggcaagctttctgtcaacatagaatatcttgcctattctgcaattcctacacatggaatcaggcagcatacagtctatcgtgtccggcttcttttacaaagcttaaagtcgcgattcatccctgatcttgcatgcccactcatttttattgtggaatagtattccaatatttgggcataccacagtttgtttatccattcacctgttgattgacatttgcaggctactaagaagaaagttcttcacatcactttacaagtccctgcagacttgaacgttttcatttcttttggacaaatacttaggagtggaatttctaggttgtatgataagtaaatatcttactttataagaaactattctccaaagtggttttactattttatattccctccagcaatgaacaagagttccaagctatttctctctccgcccccccacctcccgcgtgtgtctctctctctctctctttctctctctcacactcactcactctctctctccctctcctctctctccttaataaaaaaaaaaaaaagagttccagttgctccacatcctttcaagcatttggtattaccagtctttaaaattttatccattctggtcctcctctttcccttcttccctccctccctccctttctttcttgaattgagaaatgtttgtggaaggagtgaagacaaacattcctggacctatgttcctaaatgagcaagtttctattaataagactctcccccacccgccacacatcctacacactcaaggagaggagcgggagagggcaccctctttcttcctcggaaaataaaacctttgctttctttaggatgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggccggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagccaggaggtgccgctgcgtccccgcttcctggcgcctgacccagcgtgcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagttgccatcctttctgggtctggcaggcgccccctgagggtcttacatcttttgggccagtggagagggaggggcaagctttgcctggtgacaggtcctgagagttcggaaagtagggagtgtgaagttgggaccaactggaaagcgcctggtgtgaacaaatcgcgtccctctccgcctgcggacgcaccccctattacctcttttgcccgatttcaagaaggaaggacctgaagttcaaaacactttagtgattgcgaaccctcttggcgcttttgtgggagccaaggcggcggaggacacaacggtccagccaacaggtggtcgttgatgccaaacttcagcgcctggctccggagtgagggtccctgaaaagggctgcggggacacatctggggagggcgtgaacagaatgggggcccttgaggggtcctggagggctcatgggcctgcaggcaagtggggagggctgacttttgagaactgagctgattggagtcttctgcctgaaatagacaggttgagagtttgccccacgatttacctgcaccgtttgccaggtagggcagagcctagcccagcgccggggtctctaatgctttacgagcggcccagaccccaggacttcaaatgacttccccttcccctctaccccagttgtcttcaaaacacgtaaattagttatccagctgaaaacatgcgaatcttcggatggagaacattatggtatcagttttatgtcctgggtgtcattctaaaggttcgataagaaaaacctactgaaataaacccgagttgccaggctctaagcaaatttaagtccaaatgactaatacatctcttaatcagaaggaattataggagaatgaggcgttcttcttgccgaaaagattttccacctagtaaattatagcctgttatcctctagggtatttttctttaatcttcttaagccattttccagtgtctgaaaacaatttaaatattccagktagtgaatccaattacttagctgagtgcgtctgtgtctatattttgtccagctggaagcgcaaacggaacttggagtatgaaccacagcttccttgaaagctcgtgccarttattaaatgctgtaggcaaggatgtaaacatacatctttttaccatgggcttcacacttttcttctttctgttccagtctaattgtactgaatgtttctgtaaatggaatagaatctaaacaataaattcagacgcagattaaatgctttgtgtcagggaaaaaaaagacaaagaaaatgcagttcagcaataaacaagacggtcttgcccattttgagatccttgaatagagaggtgatgtgatgatggatttactgagaaagagagtgaagggcagaggaaagagaaagagactttgcagaatttagaaaagggagtttcagcgtaagctctggatttgtatacagtgatgattctaaactgtattttaaataattctctataatttcttgtttgggagagaatagccaacatcacattgagaatgaaagtattctatgaaaacacattttggtatatccaggtagatgactttcattatgtgcatttctgtaacacatatttcttgctcacctattactgccaatcctggactggattctggggtggtgaaaaaagtagacaaaatccctgctgttacggaccttacatgctaggtggaggagacaaaaatcatcaaaaacaccaatgagagagagattgggtgatgcattgagggtaatagagaggacgttagtgaaataccaaccaaagaagaagttgaaaagagctccttctgagcattgcagcagtgagtttccaaggaagccctcctgaaagaaaggacatagtcactaaggagaagaccagaagaatttcaggtcttttttaaaaaaaaaaaaaaaacctagactgcactcaggagtcaagttatctggaatataatgagctatcttgcaggctctttggttctctgggtcttcatgctgatcagtggactacaagggacccagcctttcttaaggttgcctttctcttccccaggcatcccttttctactcttctcagctcgtatttgcccttccagaatcaagccagttcaagttatctggctatttatattgtaccttagtgagacagtgtgttgaagacaaaaaagaaccagatcttgaatcaaaggcctgagtttacctcctagttctttcaccagtaagctgcatgactttaggcaaatcacttagcttctctgtatttttgctgcttcttgtgtaaaagcgtggtaatgttacaggacattcaaaaatgatgaatttggggctgtttaggatgtgwagaaattatctcttgttcctgaagtgattaaagcagtataatcactggtcttgttgtcttgaccaccatatggaatggaagatgtcacccagaggttgcagtgccatgcataatttgctggccacctaccaagtcacagtgaggctgtggatgctctaagggtggtagtcgaaagctttaacataggcactaaacaatcacaacagacagcaggggggtaatagatcctggagataccctgttgtaccagggccaggcgttaatatttttgctgcttggtcatggggaggtctgggagtccccagggtctgtggatgggtgggtaggtagctggagtttttttgactatttcagtattttaaaactcatggtgtatattgtctgaacatcaaggctatacctgtccttctgaacttggcatgaagataaaggactgacctaatgatatttaaaaaattcaacctcatgtctttgcttttgttttgcatttgtctgttagcaggctctggtggtaggaggtgggtgtaaaggactatgggtatttgtgggagaattctggtgaggtagacagtggaaggagagttactttcttgatctaagctagggagcttgggagattgtgagagaagctcctctctcttctggatcttggccttggtctatattgggcaggacatggagagaaagagcaaggactgtaaactgtacaataggacccccagccactgatttggccctgttttccatgcctaagcactctgtctcactgtcgcacaacctctgagggatggaagggttttcatttatttattccttctgtttcttcattcttacctttcaaattcagatcttactgtgggcaggttgcttaacgcatcccaacttcagtttcctcaacggtaacatgcaaattgtaatatttcctaactcagaacagctgttgaggttaaataaatgaatgcatatgcattgctttgtataaagcctgacatacaggcaaccttcaataaaacatgtttttaaaagttattgtcggccgggcgcggtggctcaagcctgtaatcctagcactttgggaagccgaggcgggcagatcacaagaccaggagatcgagaccatcctggctaacacggtgaaaccccctctctactaaaaatacaaaaaattagccgggcgtggtggcgggcgcctgtagtcccagctgctcgggaggctgaggcaggagaatggcgtgaacctgggaggcggagcttgcagtgagccgagatcgcgccactgcactccagcctgggcgacagagcaagactctgtctcaaaaaaaaaaaaaaagttattgtccctcaaaaataagatggacgtgaattttatcaaggtgattagcaggtgttctatggctcttttattctactagtggaaaaattcagaccttacttccattccctttaatgtgtgttttgattttatactttataatttggagaaaaatcaggtttctcaccttcttttaaaaatccaggtgtttcacggaaaataagtacgtaatttagagcaggatccattctctacagcaagtcagtttacaaataatccaaaagtttatttttacttaaattccatataaaatatatttatgtatatatgtgtatataatttaacattgcacgttctgtcttacaagcatattctaacatggaaaaataattgctagactaagttgtctgagaagtctgatgaaactcagaagtttggatttgcgttaatgccatctggatttgaatcaagtaactccctcctttaccacacctccaacccccacagctaaaacaggtaatttaagaaatactagtatattgcacacttcccagcatcctacacaaaagcttagaacttttgcattatgtggaatctgctgttccagtttccaaaatgatgacaagtaaatgatgacaagatgacactcacaagattaatgagagagcagaggggaaaagggtttgcgaggtgggaatttagtagcgttcactttggaaaggttatgggaaacagggaggaaacttctctgagttggtagctggctgatgtggatggagcaactacaaagtgcaaggtggattttagaatggaaggctagcagatgccctctaaggagccacttaaatttgcccagttatgtccatttttcttgtccaaagagctttgagaatttctcattggcagtcaataattactgtaatctaagtgtaagagcataactcttttgcaagcaaatcaataaaactacttgaaactttttaaaaaatcagtgtaacatgcgtacaacaaaacacacaaatcctgtgtccagctggatccattttcacaaagtgaacattgccatgtcatcagtaccagatcaagaaacagcatcacttgccccagaattcctgagtgctctcttccagtccctacgtccccttctaagggtaacccttatcttgacttctaactttatagtttggttttgcttgtttttaatctaataagctatttttactttgaatgaaaactttaaaaaaaacctcttcagcctaaarcatttttattattgctgaactgatcctcttgaacaacagcaacaaaagtgacttacagtcagtttagatggccattgattgggttcttgtctgtcccaagtctgggaagtayagcaggtatagtaaatgccctgaaggagcaaacagttcaacaaaaccctagtaatttacagaggaaatgtaatgccttcaggctgttattggcatggcaaagctgactagtacagtactgttgctggaatataattttctctcataggttttctctcttatcttgcttaacactaatatttccccacctatggtgaatgaggataatttgcagtggctattagtttcatttgaaagtttagcctatcagtaaatagcttcaagttatatttatctgcaatggtatataaatggaatgggaacattttacttttttatgtgggatttggtaaactgtaaatgtttccttatcagaattgtttcatgttatcatgaacaagaatcgccagcagaaaatggaaggggattgctggtgaattgttgactaacgctatgggtctccacttaaataacaaacccctggtaactgaaatcattggtcttcttgttactggagctaataattaggttcatgcaacctttcagatcatatcataaattccaaatgctcaggcatatttcacagtcttttccatctaatcttttccctttctgttctatgtctgatccccctaagcagagccttgtgcccctatgtgtaagtaggcaaaggaaatatagacatatttctgaggtcatttacatatatgaccataaaaaagccattgatttttgtaactaactaactgaaataggatataaaggaactaactaattggaatagattataaaggatgcttatgttctttaagagtctctctggttttcctctgatctctttaagagctaatgttcgattttattatcattaccatgtgttaattctcaaaatttttatttcaatttgtattccaaaaatggtttgcatgtacctattaattgaggttgactaaatctatgcatttatcaagaaactaaattattataaattgagtaacaaactattatataaaattggaaaaaagttatttttatttatactaaaattattttatttatattaaaacagaaataaaagcatcctacatctgtcttttatttcaagggtttttttttttttttttttttttgagacagagtcttgctctgtcacccaggctagagtgcagtggcaccatctcggctcactgccaacctctgcagccgggttcaagctattctcgtgcctcagcctccggagtatctgggattacaggcacatgccaccatgcccagctaatttatttttatttttatttttagtagagacgggggttttgccatgttggccaggctggtctggaactcctgacctcgggtaatctgcccacctcggcctcccaaagtgctaggattacaggtgtgagccaccgcacccggccttcaagggctttttttgtttacaatatttggttaatgttctgtttctttttactgaattgacgtttaatgtacaagatcacagaaagtggattagttagtaaagaaaacatttacctgaagtagtcacatggatatcaatatatagcattgatatctagaagattaagatattattttgccattaaaaaaaacattttttttggaagttgtctatgaaatagttaagagtaagggaaatttaatttaattttaatccattttatagaagaagccatacaagctcatgaagctggaaaaccatagagcgaatcagcaattgatctggtcaaaaaatgttaaagatgccaatcatgatcctccccaggtgtgctgtgttggatatggttgaatctcacatagcatcgattcctacatcctcttagtaggacttcttataatacaaaatctggacttctaaagctacatttaccagactcctttttgacgaacattcttcttgaaaattaatatttccaccaaataaattcatgcatatgagatatggagggcagaaacattaaaggggccaatttcctgcatcctttgggttgtttctacagatacgtgagaagctaaaagaggtgggactttctgtaatagttcttcagtgtctctgagaggcagtggtgacagtggccactccctgttggcagcttacacttctttggcttcaacaaagctggtgttttgtttggaccccgggagttccttcttgatttctcacctttctgaatgtggtagatacartagctctccccaagggtctgtgctgctatgttctgagatcattcatggagagccaacctaaagcctgctcctccaacccttccagtttttctgtcaagtgcttactttatattaagtccctttatcttcaaaattcaagagaaatttctgtttctcgcaccaaatcctggctgatatggccttttgcggttctaggatttcacagctttcagtcctaaatataataatcatctaagtatcctacatagttttctccttcagtactacygttgagtaaaatgaagttttgctgtaatatttcctctggaattcaaaatccagactaagtcctaatagcaggcattcatgcttatatagcagccctgcttacccctgttcagtcattaagaccacctcgggtggtaggaaaaagagcaagcgtttgtcttttgcatttcacgtagaagcaaatcgaggctagtgattgtgatttgtcgaagggcacataactaagtagatctggaataggaatttaaaactacgtcttctggccaaattcagtgtcctttccagtctaccatgatgtccccgaacagggtccttttagtaacaacaacaacaamaaaaaactttttatttttttatttttttttttagacggagttttgctctttttgcccaggctggagtgcaatggcgcaatctcggctcaccgcaacctctgcctccccggttcaagcgattttcctgcctcagcctcctgagtagctgagattacaggcttgtgccaccacgcmcagctaattttgtagttttagtagagatagggtttctccatgttggtcaggctggtctcaaactcctgatgtcatgatccacccgcctcagcctcccaaagtgctgggattatagatgtgagccaccgaacgtggccaacaaaaagcttttaatagagtctaaatgaatacaagtttraagagattsatagacttttccaaagaatctctgttatttttaggattcatacatatgaagcttagatccctgcaaactcagtttttgagctattgtcttcaaaatagctctttttcatggtgtatgtacagtccgtttttgtctacactgtgcaagatgtgtgagcattggaaaacctcattgctgctttgagacaaaaagggcaggccagccgcagtggctcacgcctgtaatcccagcatattgggaagccaaggcaggtggatcacttgaggtcargagttcaagaccagcctggccaatatgatgaaaccccgtctctaytagaatacaaaaattagctgggtgtggtggygcacacctgtaatcccgaccactmgagaggctgaggcagaagaatcacttaaacccaggaggcaggcagaggtttcagtgagccaagatcgcgccactgcattccagcctgggcgacagagcgatactccgaaaaaaaaaaaaaaaaaaaggagggggcaatgtatgctctatagtctttaaagatattctacatcagtcagtcagcgtggaaacatgcatgtggaaagacaggtattcaggtatggtgttaaaggtctttttttcattgtcgagtaagtgacatttctgcattcagcaagactctttatatctgttactccaccttttcttcttctcgacatacgtgtaaatgttgtcttttgctgattcctatttaggcttgtctcatggcctctcatagaaatcatggaccatggaagaacaagaatatggtagacatgaaggaaatgtagagggtgagttgcctgctctcaagcacgatgcagaatgcaagacagtgtcaactgagaggccagatctatattacttgtgcagggaggtagataggccttgtttatattacaactagagcaggacttctggagggctatagctttataattatcattattatttttttccctaggggagagcataggcctggcactgggaggtgctgatgctcaggggatatttgtggaatgaaggaactgtctggtgtttgtctggctcacagtgggttcacacaggggagtgtgcagccttgaggcagacctggagggcagtcatgctcctatgagaccttcgtgacctttgaggtgttgtgttacattggttggaacaccttgctccttgtccttccattccatctgaaatctcctagggtcctaagggactctgtgrccttcttaaatgggatttctccatgtgtgtttgaraaggaaactatttattggcaatgcagagctcactgctgttacagtgctgatttcatttaaggtccaaatatgtcttaagattgagtgtatactacactgcaattcaatattggttgaaggtgatgatgcttaatgtatttatttctcatattctaaattttaccattagttcctattttctgaaaaatatgctcacccatacacccaaatattgcaatgaaaagcccttaaagaaattcagargcgttgggagtgacagaacaaaagatgcatggttgtgaaaacatcctatcacgataatgattcacaaagagaaaaaagaatacttgtgctttattgctaaagtgagaaaagtaacaagacatagttctaaatctgatttataatgaacttccacctacactattctttgtgtacagaggcaatggaagtccctggaacaatgcttttaatttcctcctttctccactcctcgtttaatgtacttgggccacctccattattccagctgccctcctgcccctgagaaatacctcaccttctgcatttatattttggagctcgaccttcctggcatctctgaatcctgacttcattattatctgacaccactcccctttcttttaacagtgtctatatgagtttcccctcagttgaagctttcctaagaacatagcaatatgcctttactagtaaaaatcccaacctcaaaaccaacacaatgttccccagtcccttttcctcctttagttaccgtcttcttcttcatctccttccctctactatgcaagtgtaacttatagtcactgtctccctgtccttacctcctacctacttcttctcagccttccaaagtctttttctgccctcaccactactttgaaatttctttatcatggctgtgggcaacatggctcccagcaaccccaactgatgyttttcagaatcttccttgtttttatttgctgcagtaccttccaccccttcatccattcattcaccagtcatactttaaaaatgtactgatgtctcttttaagcattgtgctagtgttgtggattgatgatgattaatgatttcatgcctgcccttattgcggagacagatgctaagcaaatagaggtacaattattttcattataactgctatgaaggaaaaaaagtacaagtgagtataggaagcatggaaggtttccctggaaaattctatttatgacaagtgggatttaggccagcatgagtagaagaatgtgtcaggtggagggaacagcaggtgtgggtattccaaagagccaargaacacaagattttgaaggagagaagcagaattagcacaggagagtgtggctcagataatgtggttggatggcaagggcctgcatatatactgcgtaggtccttgcaggattttagacgtataaagtcaaccagaaaccattaaaaccatgttttcaaccctggcaccattgacatttggtcccagtagttttttgttgtggagtctggcctgtgtattatacgatatttagcagtatccctcgctctagatactgggtgtcagttgcaaagcctcccagtagtgacaaccaaaattgtctccagacatagccaaaagtcccctggggtgcaaaattgctcccagttgagaaccactgatgaaaatgataaatgatatactatgcttttaaaagtatccggccagttcactgccctccccgccaccccaaaggccaataagtacatgaaaagatgtttaacatcattagtcattggagaaatgcaaattaaaaaacacattgaggtgccactgcatacccaccagagctatatgttactgaaattattggtttttctcatctgatgcccccactaagccaggagcacctcggttgatttgggatctgggctttaatttggttctctcgtggattatctgaaggatcttgcacgacacttgaagaacaattcttccaacatttccctacattgtgttaaaagggatttttctgcttgttctgtaggaagccagtatcttcacattgcttctctccactgttttgcaccctctactctggaccttcttcatctcttctgcttttctttattttgggaaatttcagagtagagacactcctggaggaaaagtctcatcaatgctgatayacgtggatgttttactccaatgatcttaattcctcacctggcatccaagactacgtttataakgttttcatttcatagtcagggctgtattgctcatgtttagtttgacaagcatcacatctgattttctgtgacccttagaactctttgcccgttgcatagctgttttcccccsagtgtctctatttgctgtatttggccctgctgcttcctgatgcaagtcttgggcaatccctgtggaacatcgcttgttacttttcctgttgactctgtggtatcgattagtttagacgtgcatgcctctattcatgtgtgttctcttgtaataccataaaaacatgagaatcgctgtggagtgagaattgtggtcaaccttggccaggagactttctgacagtggtgctgaggaatgtgccatgggtctgtggactggcccttgacatgagccttgaggtttagggttatgctttgtagtagtttactaagacttccatagcaaaggaccatagcctgggtggattacacaacggaaatttattttctcacagtttgggaggaagtgggagataaaggtgtcagcagggttgcttcctgctgagggccgtgagggaaggatgtgtgccaggcctctcgtcttggctggtagatggcctgcttctccctgcatcttcacatcattttccttctgtacatgcctgtgtccagatgttctcttcttataaggacaccagtcatactggattagggcccactctaaggcctccttttaacttaatcatatctgtaaagaccctatctctaaataagatcacactttgaggtactggggattaggacttcaacatgtgagttgttggggaggaggccacgataaacctggtgacatacctccgcctggtaaagcgtagctcagagggtagcaacatgacagctctagttagatattgaagaactgacacttagagaagaagttagatttattttgtactatttaaatgttaaaaattaaatggtagctgcatatgtggataaaaccataaactgccttgctggaattgtgtgacaagagcactgagattgctttgtgagaaatctccctgttaaagagtgtccctgtgaaggtttggagttgccctgcctaacagaaatatagcgtgagccacacaggacacttgtaaatgttctagtagcctcattaaaacaagtaaaaaagaaacagatggaattaatacgaatactatatttaatttaatccactgtaggcattttgacatgtaatcaatgtcagaaatcattagtgagctattttctattcctgtttccattcttagtctttgaaatcttgcagcacatcttagtctcagcagtcgcatttcaagtgctcagtagtcacaagggagccacagcagctcctgtactggacagcaccagtatagggcatccattctcaacaggggccatgtcgcttccaaggaaacgaaaagtggttttggggaacaaaagaaatcttcttactgtttttgttttttttgttttttttttttttggtataaggcacagttatacatacagcatataaacagatattcagcctatctgcaatattgaagtgtcatgggggatgattagaaaaataaaaacctaaaaagcctcccttgcagggcaataatggaaaaagttgagaagcactgttatagagygcgtacttgaaggtttaatttccagtgcttcccataccagcttaactggctttccttgaggaagtcacttagcccaagccttggtctaggtatctgtaaaatgggaataataatagtgtctacctcttaagttattgtaagtattaaaggagaaaagccacgtgaagttcaccacagtgattggctcagagcaaatgttgagaatgtatcagttactattcagtcagggatttttataaaaaggtatactggtattagaagtgagtttggattagtggtgcctttgtcatttcgtctcagtttctttagtatttattattgacttatatcagtgcattgatgagcaaatcattgtaatgttaatgttgattccagtgactcttttttttcttgctgaattgtttctcattcttcaggatttcgaggttttgttaaggtcttttgctttgccccttgattgtttttgatttggcttaaagactctttagagattcatgtaaattactaaataacatcttcttaattactatattaatcttcactatttatgatataggaatgacagtaaaacgtattatatcaaataaagagcagcaagtagaaatttactgaacattatctgctattactaacttaagacaagtatgtttattggttttcttttttacagacaaacatttatcagaaaaaatacaactttaagtaaattagagttgaattcttagaagcaatatactcacaagatatggtttgcctgcattctaaggtcacaggtgttcttggaggtaaacatcatcctattcctgacccaaagcctcacctattgtaggcctacatccgtggttttgtaagtgtggcccctggaccaacagcatcagcatcaccatgagcttcttagaagtccagattttcagactccgtcccagagctactaaatgagggactctggagaaagagcccagcaatctgtgtttttacaagatctctcagtgaacttgatgcataggcaagtttaaaaaccacaatcttatgaaatacacacatgttatagatgttgatggagaggtaaaggattaaaatatagaccatctgagagctgtcttcatcattctacagtcaaaggtcccaagagtcrcaacccatctgcagctcctttgtcaatgaaggatggtcatatatttcaagtttcaaacctgggcatatgttctgacaattaagaatatttgggatctgggttgagtggctactttggtatggggagaatatagatactagcagctatgtgggaggtgggaaaacaagcaggtggaattgaaaatagacattcatatatttctgggtcagatcctactttgcatggcaagaatgccaagttccagctgatcttggaatgttagaggtgattatgaaggaagcgggcagggagccgagataaatgatcacttaacagaggaactgtggccggaagagtggggtcaagaaaacattgaacaaagaagggttaattttgaaggaggggaargaataagctagaaatggaagtatctgaaacaaactaggcagcatagaacagtgttcctaaatataaattttgaaaagttttttttttttttttttgagayggcgtctcgctctgtcacccaggctggagtgcagtggtgygatctcagctcactgcaagctctgcctcccgggttcatgccattctcctgcctcagcctcctttagaagttttattctgctcacttaaatatttgattgtatgggatccttgcagggaatcgccaccaagattttgattagaattttgtcagatgctctgataagaaaagaaactgacctgaaaaagataagttacacctacagtttattctaaagtcctctaraagtgggaatgtgtgctgtgtgcagcctgtcaaaacttttattttggcaacttctagaagtaacaaaacaggactgaaaatattgctatgatttattggaaacattggtgtgagctgttatgcatgcaatctcatgaaagaagcctaaactattttaaaaattagtctttcattataatatcgtttatttccaaatgtctttttttgacatttagaagtaattgggaaattttaaaattctagctgaagttccttgcaacagcacggtccttgtaaaagatatttttcaaactgcatgttaaggatgtatatatggaatatcagcataaaacagaatggcagttcctcaaaaaatgaaacatagtactatcatatgatccagtaattccacttctgggtatatactgaaaccaaggactcagatagatatttgtgcccctatgttcataacagcattattcacaatagccaaaaggtggaaacaacctagatattcatcagtggatgaatggataaacaagacatggcatatacataaatggaacattattcagctttaaacaggaaggagatatgacacatgctccatgaatgaagttttaggactttatgccaaataaaataagccaaacacaaaaggacaaatattatacaattttacttatataactacttagaatactcmaattatttaattacctggagtagtcaaattcatggatacagagagtaagactggtggttgccaggttataggggcaagagggaatgaggagttagtgtttaatgcatgtggcatttcaatttgggaagatttaaagttctaaagatggatggtgctgatggcagcacagcaaggtgaatgcatgtaataccactgaaaggcatattagaaaagagtaaatgttatgttctgtatattttactgcagtaacacagaatatcctgataaacttacatttagtattttgatacatctgtttttaattataatccactataataataatgaacatttttatgtggcaaacatgcccagatgctttaccccaaattatcctagctatttctcacagcaaccttctgagttaggtattatgattattcccttcttttttcagttgtgtaaagctatgcactgagatgggacaggcaggaatttgaacccagagaacattttccagaaccaggctcttacaataaaacttaatatgtagattaaaatcattcatactgctctgcccattaggaagaaaaaagtcccaaatgccaaaattatctctgcaagttctaattttcattacaagttcttttaataagctagatgatatgacacactatggttatgtgtatgaaaaaattgaaaaaactggcaatttatgtctctctaaaaaatgcaattcctgcaaaggcctgagtgtttcagtataaaaatccatatccagtggcatgtattttcttgtgcagatggtatgtctttctgaaaattgctaagagaaaagaacacatattttagaaatgtttaatattataattacaatgtatccaagttttgctttatactatgcatgctttaaactcagaagactatttacctatgatgttttattttagcatgtaaaattgaaatttgcaacaagtttgtatatatctttctgaatatgtagaagatggccttatttactgttaccttggaaacagtgatgctcaaatactatgttttactctattacaattaaaaatcattttatggaacaaatgtaatttaaaatactattcttaagcatggattttagttaatattaatcataaaaataagtaatgatgtttagtgttaaaattatttgaaaagctaaatatagatttttaatagaaaacataccttaatcaataaatcataatgctttttcctttacaagttatgtataagtcttctgattattaggaaagaacctcagttacataatggataattccatgaagttaaaaatgccatgtctaatttcttttgaaatttttcttaataattgactactttggagaatctgtacaattattacttcttaaataactcctggatagatttttctacagtgatatatgttgatattcatgtttcttcttacatttctaggactcaactattgttactccaattattttgaggactgaccctcagggatttttcttttactggacagatcaaaacaaggtaagaaatgaggtatgcctttcttacatttttcagtcgtttactactttgaaaagtatttatgtatcttatctatagaagaacatccatttcacagatcttttgcagtttatttaaaggttctacttttaaagaatatctaaggtattcttaggacttaggacgtttcaaagtcactagtttgaaatattagatttgctaaattctagagcaattggtatttttggttctgtttatattatgtgttaggataagaacagggaaatttgaattacatttggtgtagcacataattagtcagcgttactgatttaagtccccacccataaaggatgaagaaaaatgatgagaaaataacttttgacccaatagccttaccccttggcttttctttctctctcttttcccctgtgctgttcattaaggactctctcagaatcagcaggaatttggccctgataatttgttgatgtcagaaaaccaagaataaaattcctttagcctattccttcagttgtcaggaatttcttactaaattagctttctgcccacaatagcatgaatttattatctcatttgttatgaagccaattgatgattctgtactgaattattaaaaagtagaatatctgctgatcataagatttatttggagtttaatgggcagttagatgagaacactcatggaaagtggttattatttcaagcatcgttgccacagtcctacacttgaacctcagaggccacagaatatagaatgtttttgttctctaagttttgatatatggagaaatgggatagggtttactgagaatgctaaatacatactgaaaacaatagaatagtaatagtataccattaaaacagctggaacctccacagttacggatgaaggaggaacaaattgttagctctttcaaaactctacattagtttcttatatccaaagttcctggagttgcctgtcagctttgccttctgtctctgaggcaagctcaattatacctgtgtctggtcccagggccactcctgaatgagcctgtttacacatcattcaaaaggtgaatttcagtcttgttgtcctggaattagactctaaatcagtgtgccctggaaccatgtgtggctgtagaagtggaggtaaaccacagaccctacgctaatgtcaaaaattgtatgagtaagatttcctacttaacgctcacatttattattgggtgtgttaatcgctttggcttagacattctgtttggtttcctgctgttatgtgtaaaacaatggcttgcaagaggttttgttttttgggtgtttttttcttctcctaaaggatatttttagaactgttgaaactatattcatgaacgatgtacttataatgcctagagcatttctaaacgttgggtatttgtacgagagaccaaactgtcagtttgatttttcaacttgtagatcaagcttctataaaagcaacagaagatattctgggatttttaaataattcatggcaactcagttaagctcccctctagaccaatcatcaatatttatttccttaataaagaaaaagggtttaggaccaaaggctctttgttgcatttctgttgtgaacccagtattttgacccatgcttattttcaaaggtaggaaaatttgttttcattttttacacaaacttttaaatcttggttgcaatgctgtttatgaccaagcgaaacagataatgtggtagcaattccttttatcatgttattgcttttcttttcatggatattactcttacagttctagccaagagatagaaatagtaaattttacttttcactttctaaatgccaaagtcatctctcagtcatttatcagaatttggaggctcatttcttagtgatcatatatcttagaatccaaaagatgagaggatttaagaaaaaaaaattaaacttaccatgctttcaagtttgtcattttctttctggcttgaagcccagccctggaaccagtaagagtgattcatccacttttaggagatggacgactccaagtgatgaattagagtaaatgtgtgctagaagaaatggtgcatgcaaataaaagatggcatgccaagcttttagtggggatttttttgcataagatcatttgaaggtacatgaatgaatggtacattcatgatgctacttagagggccactttttaaaaaatattttttatctggcaattagttttaggaatctgccacatgtaccatagagataatctctcagaaaacaaaaaaaaaatgtgatacctttaagtttatcccttgattttatacactgtgttttccattggttgggaagcttgcattggtatttattgtaatatgcctctcttcttcctttgggcttcttccaatatattccctctttggtccacgaagcttataccaaagcacttggattagcaatcatctgaggcctagtctgctcagaggtgagcagaaatccctagcagaggggattttacaagtgttttttatttttcttttttatagcattggaggtaaatggccacattttatgatgttctatgcatgtccgtctcttgtcatggctacatcagatcttgtatcagagccacttatttcaagccactggctttcccctctgtagacaatgacatgctaccttccaaaacccctcctttgatttgtcaccacagaaatgataggtgacaaagaagacagcacagatgatgaatttaggaattaaaaactaaagctagcgagtcatttttaggtagcagaaatgtgctttagtgaaacactgacaggatgtttggagttggtggaagcagataaatatgaatatcatttttagggataaatgttcatgctttgtaccagctctggacttattttaataattcttttcactgtattgttggctctgtaaatcttattgaataaaatgagcaaaaatgagtttctgaatatgactattttaagcagagtggtttttcttgtgtaagtgtaggtgatgtgaagaggatgaatttatctgtaagtcatgggtgagaagggagtcctgcacagcctgagtacttgagaggtggcctacattaggctataacttttctttggatccgtgccatgtgaacactagaaaccaacacaggaagtgttagctgtgaaaaccatgtgaactataagaatctgctccaccggttttgaaagaaaggctaaagaagaaaaaagtgtcaatgttaaagagctaaccaaaacctatcctgctagaatatgaaaaaaattagacctttgccttgcaacctgatgccctgcttctgtgccaaggttggtgtaaaaataaaactagtcaccactagttcagatccaagaagttcaatatagttcagtaaacccttccttgtcttcataaaactggagcttgggggaagggaaaaggaacacatcattaaatttgaaaaggaatgggaggaagaacacacggtttgcatgaagaactcccattactttcttttttgttacaaattttatttgtttttaatattgtggataatatacaaatatctttttatctgtaaaatagtaaagcaatgtaactatctttaaactgcactctcccattgactccaatcctagttctctattcagagtcaactaatagtaatagcttcatggtttcttcctaggtctcttttaaataaatttgtgcatgtgtaactatggaaatatttcattttgttttgcttatgtccatttttatactaagtcacatcatattaaccattctacaatttcctttttaccatatagtgtgtctcagagaacttttcaagttagtacatgtgtgtctatatcattccgttaaattggcctatcttagggaatttttcatgttagtacatgtgtatgtatcacattctttcatattgctctatcgtatgttaaacaattgattaccacattttatttaagaatacagaagttctcactggtggattcttggtgtttgtctctaatttggggttacaaagaatcctataatatggagtaatagtcagctgtgtgtagccctctctgggaatatgggtcagggattccctaaggtaaatgctcagaagtgcgattgctgatttaaggctatacctatcctaaattataatgaatggctgtaccattttataaccctacctgtcttatatgagtggaactgttttcttaagcccaaccaacagtaataggaaatattttaatttttgcctaactgatgcaactgttatatcaccttgttttaatctgtcgttgcctgatttgctagtaaactgtgtatattatcatacatttattgatcatttcagtttttccttacatggattgcctatttatatctcttgcccttgtgtggacagttctctgtgtattctagatgtactcctttagctgttataaatgttgcaattacactcttcctgtctgtggtttgtctttgactttcttaacatctaatttatgggtaacaaaagatgacttgaagctttaagttttcatgtagttacattccaactacctccccactttttgcttcctttaagatatttctgattccttctcatcaccgttattaatctaggtttttaatccatatgtaatgtattatgaggactggtgtaaggtggagctctaacttcaatttcttcatatcactcgtagagctgacatttcactacctggtttggatggcccaaagatctgttatgttttaatgcctgtggactgctgggttctgatttcctacttcattcttatctcatttattttctgcctttcttactttgtggttcaaaattgtaattctttttgtttacccgtgatcctatattagagatttaaatttatacctgcatatttagtcatttctggagacttagggcaagaaagattggttctaccattcatgccatctgccatcttgttctgccctgtgaatttgcatgagacaccattctggatgtttgtacagagtgatgattcagtttccattaatggcaaccatagatagtcttctcttatgataaccttaaatttctacagagttcaaaagcaaagtttaaaagttaaatatttacataagtcacagtaacatttttcagcatgagtccagagttcaaaaatattttgaatgatgcatcataaatgtcaacaagaaaatctagtgatttcctattaaaaatagtctggcttccataaagaactactgggtaccacacatttcattaatgatttttagcagtggggctttctctttgggatatgcttctctagggtatcccaaaattgtcaactttgacccttcttgtgtatagtaaatgggataggtcattcaagagtccactgagtgattaaatgcaatgatgtagttataaatttagaagataagtgctatttattttatttggtagctttctctaaaagttgaaacaataacttacattatctgggaaaaaaaccagcaaaattcacgtgaggattgctttgtgagggctgggattgttccttggcctggagcagtgtgtcagtcattgttgactaagcagcagcatctggggactaagtcctttccttcaccttccttgaatttccttcaccagtattgatgatattaatagctaaaacagacacagtgccatacccacaccctcttcctcaccactcctgagaacataagccgggctccagtggctggccagtgcctgcattcttttgctttgtctggctactagaactcatgttgctacccatgcagctgcccagaagttcctggcaattcacactcaccctcaccaatgggattcagtggataaataccacagctccctcacctcttgggtgggataacttaaaggtgcattctttatattatatcccagaactctctagtgggattaagcccagttacccacagtggcaactggcttgaaaatgttccccttatgggcttccttcccttcctgtctcacttctccactcctgattgtgttctaaaaccacctctaaaataaactacttttactagaatccttatctaggaactgcttaatgcagatgcatagtgcttaacaacttaatatagatgcccccaaatgaagggttttaaaatgattccttggttaagagagattggaacatattaagtgaacacttttatttgaagccaagtctgattttcctaaaacagtcctaatttgggaagcccaaagctggttgaggaaaccagctttgaagctgtgacagatgtggtttgtcacagtctggctctgctgtgtatttaatgagtcaccctcagtgaatctctttaaaaatcaaagccttggtttcattatctataaggtgggtattactctcttagtgttgttgtgaacattcaatgtgtaaaatgaatgacttagcataacacctgctactttgtaaactctccatcctttgtggtggcttttattattgctacataataaacaatgactctctgaccaaacaattgtccataagtattagagaccacaaaaatgtgctgttttgaaaaccaagtgaccatttatttatgtatatctttttattccttttttcttcttcaaggcaacactgacttgttttctatttagactctgctgtggtcttttgatctgaaacattgaagcttaggtctgtttgggcaaataagatgtttatttatgtatttcataatgttgtgggaacagagccatggaaggcaaaagaaggatttattgtttaaaagactttccctctggggataatttgctaataaatagtccatcataggtgaaagtttcttggacccttggaaatttgaagcatcgtatggaacaacttttaagatgatttagaggactttgataggagaaaattgtattattcacaagaaaaattggacacaatcatggttgcctatgcctttttcctaagatagtcactttaggattgtgacaactacatgggcatcaggccactcctcttcctccctactgaccaagaccttagagattaaacttttagtgtttttgaggatagtttagccactaagccaaggttcagattgctgaggaacaaatctatcctcaccatatcaacttccaggttaagtttttccatttttattaacattaccttcttttcacttctgtgactcctcagagattttgcaccagtgaactctggctagcatagaatagacatgtcatgatgccttagcttatgtagacacaacatacaaataaatgttattagaatggaatcatttacaagttcttcttagaggatgtgatgtatgatttttttggtagaatttctaattgaagtgtagccttttaaagtatattttaaaattaggctagtcattttgagatggtttcattgcagcttctttggaatcatttttagagtagaaatgcrttagtataatttttatgtcacaatcaccacacttcattatgggcataacaacagcaatgcttgttttaatatattgtaaccagagtttagaaacatgtaataccacgaaaattcattactcctaatataatttaattacaaaattgttccttggtttcataagttgcatatatttagctcttcccactactttaggagaaawtaaattggatactttccatgctatgaagctattataatggaatatttgtactttttgatgccaaaaaatggttcgagccattggattggcagaatatgtgaaggaaatgcattctgcatattgttcataattttacttcctgttacggagaaaattcctttgactttgttacaaatagaatccccgggtacttggtattgatataatgccatgctcttttgtttgaattacaaatgttgtaggtagagtaggcatttttggttgttctgtagttcattttcttgccaactcaagattgttgatggtactgatggagacattattgtattagtccattttcatgctgctgataagacatacctgagactgggcagtttacaaaagaaagaggtctcacccacaacatacgggaaatcaagctgrgatttgggtagggacacagccaaaccatatcattctgcccctggagcttcccaaatctcatgtcctaatatttcaaaacaaatcatgcctttccaacagtcccccaaagtcttaactcatttcagcattaactcaaaagtccacagtcccaagtctaatccgagataaagcaattcccttctgcctatgagcctgtaaaatcgaaagctagttactttctagatacaatggaggtataggcattgggtaaatagagccattccaaatgggagaaattggccaaaacaaaggggctacaggcctcatgcaagtccaaaatctagcagggtagtcaaatcttaaagctccaaaatgatctcctttgactccgtgtctcacatccaggtcacactgatgcaagagatgggctcccatggccttgggcaactccgcccctgtggctttgcagggtacagcccccttcctggctgctttcatgggctggcattgagtgtctgtggcttttccaggggcatggtgcaagttgtaggtggatctaccattctagagtctggaggatggtggccttcttctcacagctccactaggcagtgccccagttgggactgggggctccaaccccacatttcccttctgcactgccctagccgagactctccatgagagcaccaccccagcagcaagcttctgcctggacatccaggtgtttccatacatcctctgaaatctaggcagaggttcccaaacctcaattcttgacttctgtgcacccacagactcaacaccatgtggaagctgtcaaggcttggtgcttgcactttctgaagccatggcccatgttctatattggcccctttcagacacagctagagtggcagggatgtagggcaccaagtccctaggctacacacagcacagggacccttgttccaacccacaaaaccattttttcctcctaggcctctgggcctatgatgggaggggctgccatgaagacatctgacatgccctggagccattttccccattgtcttgaggattaacatttggcttcttgttacttatgcaaatttctgcagccggcttgaacttctcctcagaaaatgggatttccttttctattgcattgtcaggctgcaaattttctgaacttttatgccctgtttcccttataaaactgaatatctttaacggtacccaagccacctcttgaatgctttgctggttagaaatttcttccaccaggccgggcgtggtggctcatgcctgcaatcccagcactttgggaggctgagttgggtggatcacctgaggttgggagttcggaaccagcctgaccaacatggagaaaccccatctctactaaaaacacaaaattagccaggcagggtggcacatgcctgtaatcccagctacctgggaaggctgaggcaggtgaatcacttgaacctgggaagtggaggttgcagtgagccaagatcgtgccattgtactccagcctgggcaacaagagtgaaactccatctcaaaaaaaaaaaaaaaaaaaagaaaaaaagaaatttcttccaccagataccctaaatcatctctctctagttcaaagttctctaaatctccagggcaggggaaaaatgctgccagtctctttgctaaaacataamaagagtgtcctttgctccagttcccaatgagttcctcatctccatctgagaccacctcagcctggaccttattgttcatatcattatcagcatttttgtcaaagccattcaacaagtctctaggaagttccaaacttttccacattttcctgtctycttctgagccttccaaactgttctaacctctgctttttacccagttccaaagttgcttccccatttttgggtatcttttcagcaacaccacactactggtacaatttactgtattaggccgttttcatgccactgataaagacatacccaagactggacaatttataaaagaaagaggtataataggattacagttccacgtggctggggaggcctcacaatcatagtggaaggtgagaggcacgtctcacatggtgtcagccaagagaaaagggcttctacgggaaactcccatttttaaaaccattagatcttgtgagacttattcactatcatgagaacagcagaggaaagacctgcccccatgattccattacctcccaccaggtccctcmtacaacacgggggaattcaagatgagatttgggtggggacacagccaaacctatcacttgtcaagctctttctatatttaatcagcaagacaagtctctttttgtcttttgggaaaataaatttagattgatagttggattatttaaacatttatcacacacacacaaaatattaaaataaataatataattactttcttccactttaaaatattttaaatttactttaagtaatttaaaaggcaaaaatgcaaactttgaacaactgacttattaggacgttggtacctattataaataagtttctcaaatctagcaaagtatgtaatattcactaatttactttgcacatacctttttatcgttgttatcattatccttgttatccttagcatcaccaacagcaaacacatatatgctgttttatccttgccagacacaattctaataatatatagtctgtatatttatagcatatacatatttttatacatatatttatatagtatatgtagcataggtatacttatagtctataatagtatgtatatagtgcatatatgctacatatatacatacatagtgtgtctatatgccgtgctacatatatacatacatagtgtgtgtatacttacacatatatatagtgtgtgttaacagacctatgcaatttcgtcatttccataatcctatgaatgacagtgctactattatctacatttaaaagtgagtaaactgaagtgtgaacagaggttatgtcatgatccctggttgtacagttggttaatggcagagtcaggaatagaaacaacagtggcagtgcagtctggctctatgttctggctcttaactttttgctgtttaaagaacctgtttaatatgtaaagttaagtttgcctgcaggatttttttccttggatttgtttgaaaaagaaacctcagtaggcctagtacatttgctaggaacagacaaactgtatgaagaaggtattctcaagttgggctgcacaatgaaatcacagggggagcctcaaaggacgctgctgcctgggcttcctgtctccagagaatctgacttaattggtctggggtgtggtcagaacattggactttttttttttttttgaaagctcctcatttgattctaatgtacagccaaggtgaacacagatagaaagcaagctgaccttacaaattaattcagtaaacttcctgaaaggatgtgctcactttgcctttcctgcctgtgacgtggcctactttctactcagaagtaacactccacatgagcaactacaggccctaccagattctgaattatttgactatgactggataatattccttacactgtgcttagtaaggcaataaattactaggatttttttagaattagtctcaatatctaaggttgaatcaaaatagtttttttattatattctgtcgatgaaaatttttttaactttccattccctgaatgttacaggtattagctgtttgttttatcgttaccaaacatgtcctcagaattcaagtcctgtttattaaccttatatttgtgttttttgagacccttgtttagatcacagtactgtgtaaattccatacttaattaaattagctgcacccttgaatgagtgaatgtggttttaagaatgaccttatataactattttattttatagctaatttttcatttctgggatacaaaggcagatgttatcttattaaattgtagcattatgtcatttcttatcaatttgtaggaatccttccttaactgagacatacactcaactgggcaaaccagagagagctagataatttcaggtgtgataggaagtttgcctttcatcacctctacatgatacatttcagaatagtaaaattcacatttctcctgttagaatgtttggttttttattctgcttctatagggaatggggattgtggtaatgatttttcatgagatttctccctggcattgtgcaaaactccacttaggaacagtggtctgaaaattatattgcatcacggcaaacaatgcacctgtgtgaaatgaatgcttaagtgaaaagttttatgggacagagctagttgctatgctaagaaactaatgactgtgctggtatacataatggattctatttttagatgaacacttggtcctatagcatggcttcattatgcaagaggacagaagtttcagcgttatattgtgaatattgagacattaacatatcagagtatatgccttcttagatactaaagtgactttttcatatattttaaccctgacatagttcataactagaggaaaaaagtaaagaacaaaaacagaatttcaaaataatttcaggtttctggtgtttgtaggttgagtttttccaacagttgactgcaaggaaaggattcaagttcaagtggtttatttgggaggtgaccccagaaagtgtgggcagggccatggggaagtgagataggcaagggaagacagccattaaagggtgcactatcaaataagttaccatggtgtacaagtgaagctccgtcccattggagagccctgggagacagtgcagagaggagagggagcagtggtatacccaccagttcctaataatcagtgactgggggcagctctctcaggggttattttctcagctcttctgccagcctctcctggagactgaggggcttccaggccagtgggccctaggctttgagaaatccctcagacatagatgcagctggaagctgtccgttggcatacatgaaaacacatgggcaccaccagcagcaaccactctggtggctttaatttctggtaagtcagacttttaaaatctatatcgcagtgtgcaaactggagcctgcacccattcacgaacagttcttgcttggcctgtgcaaataattaaatacataaacatgagttgccagcatttaaaaatctgcaggttcatatacagatctggatttctcaaaaaatcagaaggcatggaaatgccggccgacatacccccatggccacatttggctggggcagtgcagcagctgcctgctttagacagggtgtgtggtatgcaatctgccacatttcccaccaggctagcctacctaatttacatgaacttttaagctcatttagatgtttgagtataaatatcgggcctctatggtaacatcctatactggaagcttcaataagctaatgattgcaaagcttcatatggaatgaggttaattctgtcacagtgggcctattggagtgctgtggcataaagactagatttttacagtggaaaaatggctgaagrtcagcatatccaggtcttgctcgtaatggccataagcaaagcaattatgctccaatcccaattcttctctgtgatgtatggatctaaagtgtaggagccctgaggtccctctctgacttaaaaggctattattccaaagtgactttcaggtgtcattttgctaggtaagatttataaatatgagtccttggcaaaggattttcgtgtcgaattgggccattaatctagggaaaataagaatggtggactccaggacaccaggcagaatgacttcccttggttcccttggttgaatgaatgggattaacttcacccccagatcaaggcagtgagcattgactggtttagccaaccaatgtagtccacccttttctcaccgtagagctgtgctgtctcatacagtagcctctagactcatgtcactgtttacagttaagttttaattaattaaaattaaattaaaaattcagtttctcaatcccactacctacctttcaggtgctcactagccacctgtgtccaggtgccatttccatcattgcagaatatgttattggacatcactgcacagagcttggatcaggaatggctcttcagagccaatgcaaagtttcttgcaataagaagcttccttgaacttgtggggaaagaaactttccttctttttctggattatgtgctgcaaggatgtaatatctggactcacttttgttatcttgttcccatgaaagaagatattggagtagctcagatgccactttgggagctcaaaggggaagctagccctgcagaagacaagccagtgaagaaccaagtccttaatgatgtcatttgagataccagatcagtccatttcagttccatgaatgaatcaatccccttcataggctatgccagtttaagatagagtgtttgtccctttgcagttagaattactgactgacacattggacaatcatttatttgaaggaaggcagagactcaggtgttaaggatccagctaacatctggcccataaacttgaaagagaaataaaagcgggaatagaatgtgttaactctgtcagtggctatcattccctgtacaagacattattgttagttttgtatagttttctaatctgggctttaacatttcaaggataattttagtggcttctagccatcatgaggaaagaacatgtcttgagaaacatggggaaaattgaaaactgtacagagaatataagtttttggcaatgttgtatgttaacctaatagccttaatggtaccatgataatttctgggtaaggaaagtagaacttattaataaactgttgtgctgcagacattgtgccaaggtaccttatgtggacaaactatcacatgaattcatgaattgattgatttttttccattttgcattgaggaaactgaggctatggagagggtgatttttaccctggaagactctctctaaccctgccaatttagaatgaaaccctctcttctgttcttctggaataccttgtgccttcctttaccttagcactattaatgctatgttgattctgtctgactctttttcctttcccagtggatgatgaaggccttgaattcggggactttacctcatttgtttggcattttgaatacactgctaacatacagtcactgctcaatcgatgtgtgtcaaatgaatgagacttacaaaggctgtgcatcttgtctaaggttacaggttactaaatggtggaaagccagatctgtcaggtccaaagccaatgacctttcagtagttcattcattaaaaccctctccttcttgtttaaatctccagctgtcttactcttagcagtttatgtgacctctgcctcctggagaagagagaaaacacagtattccctgccaccagacctaatagcacactttcatttacagctgctttcctctgtctccctcttcctttcccagcccatcctttccactttgaccctggaccctagcttctcaatgatttcayactaaaattgatcccttccctttcttatgttgtcaatatttcccctgtaaccagatctgtacatcaatattaaacatgacatgcttacccatcttaaaagaaaaccctatatcccctcttgaccctcactggctacttcctttctttctcgctttcactcatagcaagcttcttcaaagacctgcctatgctctccccattattctcacctttcaccaacttttcaatacatatcaacctggattctgtacccactactcctccaaattagtctttcttaacccatcaatgaccttcacattttaaaacatgctggccatcttgagctctgtggtgcttgattatttttatataattttacattgttgataaccccattttcctcgaaacactttcttttcttgactttctttttctcctacctcttcctacctctccagccacatgttcgcaatctactttactggctgtaagttgcagtccttctctactcacatgttagggaatctcacctgcacttaaaacttattttaccatctggatacattggctcccaatttcatatcaccttccaataccctgttcctgagataccggaaagcaaacatttccaagattggtatcatgttcttcctcccttaaatcctgacctggtcctggtgccttattaaaggtaccacccttcacagagtggcacagtcctgaaccctgaaagtcttccttaacaccttcttttccaccttccctccaagttcttggcccctttccttttgtgctccgtccacaatagccgccttctgtttccctagacacggcatatttctttctgctgaaatttttcacaatacttttcctctgcttggaacacatgttttctccccatggattagcccctcccctgcttcaccacacttctcacagttgtaatcaaatgttttttacatagttatgtaatatctagctcccgtattaggtttttgactcaatgagagcagagtccagaggtgtccttgtccgtgtttaagacctggctctcttaatggggaaagtaacttgtagcattcgccaatttccatggtgtaaatactgtagtgtctgatttcgagatatggatacttcatcactgaacacagatttggaaagtgaagggtacagttggctctcataagcttacaagctttccccagctcacccccagggcagatgcttgtctgtcttattgactgctgtattttcatgagttagggcagtgcttggcacattgtaggaactccaagactattagttggaggagtgactgcagtgtttttattaccattggaaatatagtaaaaagtgctgatgtttcagagaaaaatgaaataattttttaaattttagaattggacccagcctgaaagtttatcatatgccatccctttgtttttcttcattagaattgagggtcaggaagtgagatctgccacaatcacatagctacctggtaaatgagcccaggttaaaatgcacatcttttaattaccgaccaacactccttctactgtagtgcattatcacttctaaaaggaaagtaatttctttccactagtgatttagttcagattgcattattagatagtgacgtrgttgaatgtataattaaatctgctttacaaaagaaaaagcagtattttatcatttctttttaaattatgagttgtctcttaagagggatttctcttttatctttttcttctttaatattctgatgtacttatttatagaacaaagacattagtcagcttttgtggtgtagcaaaccaccccaaaacttatgccttaaaacaacaaccatttttttgaggtcacccttctttgggttaacaatctggtgcaggctctgggggatcatttttctggtctcaggtgggctccttctggcttctgcagctactcatgggttggatgtgtggctctgctgatatggctggcctctcctgtctgaggcttcagctaggatggctaggctgacttgtatctgtcccatgtggtctctcatcttccaacaggctagtccagcttgctctggtagttcactggcagagttctgaaacagggtggaagctgcaaagccctagaagcagaattgccatactggcacttctgccacattttctatgccaaagcaaatcattcataggttggggaaatagatgccacctattgatgacaagatctgaaaagtcacactgcaaagaggcatggttacagtgagaagaataatttgtgactgtttttgaattacatacaaaaaagtaatttcttcttcaaattagtagaagattgtctctctgatgggatagaactgactgatagcttcctcatccttctgaaatattaaggcaatatgaagtaccccacctggacaattgtgttaattatatatgcccaatattagagcacttacgctgcagtgaggtgggtgtctctcaccataccctagacttggaggtccctgataggtgttctgaaagaagatccctgtaaggttatagggaagtaaagccgcatcccaacatggtgcacagacagcagcctcctagcaacatctcttaaagcagatggtgttttcagacatattgaggaatgaggtgggttgggagcagttgcaacaagatagggaaaccttaagtcatctttgaggatactagtttgttgtgctattttttttcttcctaaatgatttggaagtgatttttctgtgcctgatgtagtcttttttttttttccctttctttgtatcctgtgttgggaaatggaaataattcaaaatctgtaaaaacactgggaaaatggaaattaaactttgggattctttactgcagaaaaatgatgatgggaaatgttcttcagtagagaggtagaaatcatttcagaccgcttctcctagccggggcccacaacatgcatttttctgggatgaaaacacatgagtttgaccaaggaaaagtttggtagattttgtcaatgaagcatgaaaagggatcagtctttactctgagctcatcttttttttttagctgagtgtgctcttggaagatgcaggcatcagtgtatttatatctgggtcaacagggcatgcggtgaaggggaaggaaggccattacctagtgaatgtatattgggtggggagccactgaggttaaaaaattcagcctactgccatctctttactttgggctgtatggaagttgttcatgacctccataattgttcttttgtaggatamcctgtatcagattatagactctgaaatccaactcccagggttcaaaacctgccttgaacactatgtatctctgaggaagacatttaactcattctgagcttccattttctcttctacaaactagaaataataaataggaatcccatgaggattaaatgagataacacatctgaaacacttggcacaacacacatgctgataggtgcttcacaactgctactgatttttaggataaattttagtaaattttaatatatattgtgtgaatctgaactaggacaggtattcggatacttctgattcatattctgagtctttttgcacccaattggttgaaacatcagggcccccaaggaatgccagtgtctcaggttgcagataatactgccaagttgcagataaatccctgattggacaactatctaagagttagtagatccactcagactcccaggaacttggagtgcagttttcgatgcctgaattcagagaggacagggtgcgtggtgcatgtggcctagtctacaattgcttctggcctattgaatcttaggaatggaaggctgaaggggagaagatagtttgtcatcaaaactaaggttctggacaaatttggagggctcagttgctgggctggccctggagaatgagactgaattctcgaccctttgaaaacaggtgccatgtttgatttctttttgtgtcagcaatgcatcttctattaaaagaatggcattagggtctcagtcaagatggcctgaggcattcagttaagggtacactgatatattcctcctgctggtcagtgtcaagattctgctcctgttctctttcatccctgtgtacccatcttagatatttttgagtgcccatgatgtgctctttgttgtagtatctgagatctctagttggggaaacctaccaaagtaataaactattctatccattgttaggacaaataggaaaatcttactgactctaggagaaaatagcaggtatttctttctttctttttttttaaatagactatttcaaatcctaaagtagttttacttgatatttacagagcacatgtcataaactctatttaaaaacagaggtaaaaagggggaagcactgaaaaatataactcgagtaatcagtttcattcaaaatgtaagtgggagaatcagaatagaaaataatatgatttgcagatttattttaaatcagatctaaatttttagatttgcaaggtctgagtgaaaaaaaagagtgtcattgcttagaacttcttaggaaaacaaatcaataaatctgtaggaaataggctgtgtgctgaaccttatttggtttctgctttttgaccgagragaagcatattatattgaaagggtatatacttggtacatagaaggaaggcgacctttaatctctgactttatataaacataaaaaccgtgaatagaaaagactgagcctaggaagaaataaaaaaggagccctgaatctatgaggctgagccatatgaaacagccataattgtaggccaaaaatggccaaacacaggcggtttctcataggccaacaatacagtcgttctgagagagcaacagcattacttttgcttagttgaccatctgattatgacagtttagaacctcatattgatgtggcaaacatgagttaacttctctattgttaatggatatgattttattctaatttagatctgatttaaaataaatctgcaaatcacattattttctattctgattctcccacttacattttgaatgaaactgattactccagttatattttcgagtgcttcccccttcttacctytgattttagatagagtttatgacacatgctctgtaaatatcaagtgaagttattttagtatatggtgcaacattttataaataacaagaaagagtatgctactttcaacaatatcatgtttaatatacataaaatatataagcaygtaaaatatatgtaacatatatacttaaaatgcatatacattatatacatttaactaagtacaaatataaatgttgcctaagaggtaagcttcaaattggaatttgagggaaataagcttcaaattcatttctcatatattcatcattttatttgttcatatgttatgttttttgttgttgttgtatgggagaggtactgatttaggttacttcttttgtagtagaggatggtagttaaaaatacatactctgaaccccatctgcctgggtttgaatcccagctctatcccttgtgagctgtgtgattttgagtaagtgacttaaactttctgcacctcagttttaatatatatgaaaaaaggataatattagtactcccttaaggttgtgttagggattacatgaattaatataatgtgtttggatcagtgcttatgttggaagcactaggtaagtgtttattattattacttctcattgtagtctcctttatgaaacgtgtgtgcatagcctgtctggaggatgactttttgtcttttaaagagagaagctgtactacttctactgtaccagaaattcatctgagagcaggttactttctcattgtaaagtccatgcaagccagataaacctatagggtagcacttccttaattagtttacaatttctgaggataggttggtgggagtaaactgcctctgagtgttcacttctctgggaactgtcccgtctgttgttgcgtatcatatgttctagtgcattttttttcagttatgtcctttcccacaaagcagtttggtgtaaccactgtaatcccagtaagctatggttggggtctatgtataggaatgtgcaccctgaaattcattcacttattcagcacaattttattgagcatctactaagtgttaggcactctctgtgtcagatatattatagataatatacaactacctaaatgcatagtaagcaagatattgtaccattgagagtagtaagagtgatgagaagagttcagggagggagtagtggtaactgttttacataggtactcaagaaaggaatctctgataagctgatctttgagcagagatttaaaggccgtgagggataagccatgtggttggttatctggaggaagaatgtcctaagcaaaagaattggtaaatgtgaaggtatgtgacttctgggatagtttgacaaacagttcaagaggccaattggctggagcatagtaaatggggattgggatcagtagtaggaggtgaggtcagagagattgctgaagacaagggcgaattatattaggtttttacaaccattgtaagggctttggcttttctctgcatgaaattcaaagatgttataaagttttaaatacagatgtgatgtgattggacttgtgttttttaaaaaaggatcactgagacttctgatctatacaagatggccagattagatattggacctgaacatttttctttgttcttcttccctaagtacaactatacatcccagacataatgtgagaggcaaccagcagaggactctgaaaggtgctaagaggaaggcagactggtttctggcatcaggaccagagaagcagcatggggcagggtatcttatgtttcccccagccagtaaaagaaggtgatcaggaccagcattttacaacctgtgacctagcaacagaaggtggttcaggaaagctccttcttttcatggagtccatccagtgtcaacagggaagcccagcaccattggcaaagggatcagtcgggaattcagttatggctagccatacatgggcagggtaaatgctcttcttcctgaccaggcctgggacttctccctctaccaagagatacaacacagggtcaccaggttgtaccagcaaaagggggcccatgcccatgacaacaagcagcctggcctgggatacctctttctccatgggtctgaaactcctctctcctgcccagagacactgagactgctgagtgacaccggtaagaggtatttcactacaacaagcgcttggcccatgaagcctatttgtctccatagacccaagatgctattctctcaccaagagacactgtagggtcagactgaaaaaaacctgtcagccctctcaggtacagggacctctggaagcccctctcatatcatctaaaccaagcagaccaaaataacacagcaaaggttctgaaaattaaaccatcggtggaatgacaacccacaaaagtagaccagaactcatgtgataaacttaaaccagggtgactacctgctaaaaggaaagatttgaatagaatttagtcttctaatatacaaaaataaaacgtccaggatacaactgaaagttgctcatcatactaagagctgagaagatcatggcttgagtcagaaaaatttagtcaacctcaagatggatcagattttggaattatcttacaagaattttaaagcagccaccataaaaaatgtttcagcagtcaaaaacaaattattttgaaacaagtgcaaaaatagaaaacttcagcaaaaaaatagaagtttttaaaaagaaccacatgtaaaggataaaactgaaaaatacaatggccaaaataaaagaacacaataggtgggttcaatagtagagtggaaatgatagaagatagtgtcagtgaattaaggacacattggcagaatgtactcaatctgaacaacagaagagataaaatagattttaaaaatgaactgagctccggggacctgtggaacaataacaaaatttctaagatttctatcactggagttgcagaagagacccaggggaattgggctgaggaatatttgaataaatcatggctgaaaatgtcccaaatttggcagaaaaacacaacctaagaatctgagcgcacctcaaacaggatacaccttagcaaatctacaccaagatacatcatgtgtaaacttctgaaaacaaaggcaaaggaaaaaaatcttcaaagcagactaagaraaatgatgcattaactacagagaagtaccaattcaaatgatagcagtttcttatccggaaacatggagaccagaaggcagtgcatctttcaatggctgaaagaaagtatctgtcaacagtgacttctgtgtccagtgaaaatatcctcctaggatttctctcagatgatgaaaactggaatttgtaagtagcagacccacccattaagattgactaatggaattttataaaacagaaaggaaagtatagaagaaggaaacttggagtatcagaaacagaaaataatggaaagagctgaaatatgtgtgcaagcaatagaccatcctatgcctcaacagtttgtaaattatatttgatggttgaaacattatgttagcatccgatactcaaggcaatgctatttaaaagtaggagtcagtaaagggacctaaatgaaagtaagatgatttccactcttcagctgaagtgtaaaatattgatacccataaaatgtaataaatcacatatgcatattgtattaggccaggtgcaagggctgatgcctctaatcccaacactttaggaggtcaatgcaggaggattgcatgaggccaggagtttgagaccagcctggccaagatagcaaattccatccctacaaaaagttaaaaataaaaataataaaataaataaaaaagatgggtgtggtgacatgcgcctgtagtcccagctactcaggaggctgaggcaggaagatgactttagcacaggaaattgagggggcagtgagctgtcactgtaccactacactccagaatgagtgacagagcaagaccccatctctaaaaaatattaaaagtaataataaaaactgcaattacttttgcaccaacctaataacaaacaaaaaccttacacttaaaaaatttataaagaaatcaagataaaatcctaaaaaatatttgactaacctccaagaaggcaagaaaaggaaaacagcagaacaaaaaccagagtaaataaatggaaaacaaataataaaaaggcagatgtaaactctaatatgtgaataaataccttaaaggtaaaagcaaagagaacctagatatagacccatacacatatgctctgctgatcttttacaaacatgcaaaattagttcaacaaggcaaaggacagtattttcaacaagtgatgatggagacattggatattcataggcaaaaaataagtaaaaataaaaaaaaaagtataaaatgaagttcaacataagcttcacacttcatataaaaatgaattcaaatagatcctagatataaatctaaaacataaaactgtaaaacttttaggaaaacacataggaaaatctttggaatatggatctaggcagagttctttgacatcaaatccatgattcataagaagaaaaattggatctcattaaaattaaaataatttctctgtgtaaaatcctaaaaagaggatgagaagacaagctacagactgagagaaagtgtttgtaaaccacatatctgccaaaggacttgtatctagaatacataaaggaccttcaaattcacaggaaaaaaaacaaaaaacaaaaaacctaaaccaaacaatccatttagaaaatgggtaaaaggtctaagtagacaatccactaaagaggatacacagatggcacataagcatatgaaaagatgtcgccttcattagccattagggaaatgcaaattaaaaccccagtgagttctcactgcacacctatcagaatggctggaattaaaatagtgacattaccaaatgctggcaagggtgtggaggaacagatcaatggtaggttaaacagtctggcagtttcttataaaactaaacatgtagttactatatgatataactattgtattatgaagcgttgatcccagaaacatgttttaaaagtatgttcacacaaaaaatctgtacacaaatattcaaagcagctttattaataatagcccaaactgaagatagaccagatgccttcagtgagcaaatggttaaataaagatggcatgtccatactgtgacatatgctactcagcaataaaaagcaatgaactattggtgtacttagcctggataagtctccagtatgctgaatggaaaaagccaatctcaaaaggtttcatactgtatgattccatttatataagagttttgcaatggcaaaattttaatgagggacaattttgtgtctgtaaagtgttaggcacaggcgtaggcagggagggaggctgctgtagttataaaagagcaacatgaggaatgcttgtggtgacgatactgttctatatcttgactgtggtgaggaatacatgaacctacagatgataaacttgtatagaattaaatacacacacatgcacacccacacacgcaagtcaaacgggggaaatctgaattagattaatagattgtatcaatatcaatgtcctggttgtgatattgtactatagttttgcaagatattaccattagggaaaattgggtaaaaggtaaaagggctccctctatattattacttacaactgcatatgaaatctgtaattatctcaataaaatttcaatgaaattaaaaggaacctccagagtagtgcctgaggactctcagtattagccttgacctcagaacatctctagacaaaagtgatagaatgaatattactttattaagagtttttcataatatattatcaccactcccttctcagtaatcagtagtataatattatgtttatagaaaaatatctcatggtatgtcaatgtttgttggtattaaaatcaaattaaaataattttacacgagagtgcaaatggctgacagatttaactcttatgtttttgtccccccaaaaaatcatatgttgaaacctaacccccacagtgatagtattaaaaggtgagtcttttgggaagtgattaggtcatgagagctctgccctcatgaatgggatttttgccctaataaaagaggcttgagagtctttttacctttccaccacatgagcattcatagaaggcaccttctgtgagaaatgggcaatcaccagacgctgaatctgccagcatcttgatcttggacttctcagccgccagaacagtgaggaatacatttctgttgataaattacccagtctaagtacggcattttgttataatagcctacctggactaagacgatgatgttaattcaaataaatatgactgctctgggagaaatgattttgggcaatatggctttattgctgctgtttctattctaggctgctactccctcctataagacacaagggcagaaatcagcaacttcaccctctgtttatgaagggtgctatgcagggcccaagtattattattattattattactatttttaaaattttactttactcatgtttgttctggtatgtgattcagctttttaaaaaacttttatttattttcaggggtatatgtgcaagttggttctatagaaaaattacaggtcccagggatttgctgtgcatattatttaatcacccaggtaataagcatagtacccaatagatagtttttcaatcctcaccctccttccactctctactgtcaggtaggtcccggtgtctattattcccttctttctggacagaaatgtgtactcaatgtttagctcccacttatacatgagaacattcgtgatgtttggttttctgttcctgcgttagttcacttagggtaatggcctccagctccatccatgttgctgcaaaggacatgatctcactcttttttatggctgcatagtattttgtggtgtatatgtaccatattttctttatccaggctactgttgatgggcatttaggttggtttcatgtctttgtttttgtgaatagtgctgcaatgaacatacatgtgcatatgtctttatgatagaattatgtatattcctttgagtatatatccaataatggggttgctgggttgaatggtagttctaaattctttgagaaatagccaaactgctttccacagtggctctgaactaatttacattcccaccagcagtgtataagtgttttttgatttttctgactggtgtgagatggtgtctcattgtggttttgattggcatttctctcatgattagtgacattcatcattttttcatgtgcttgttggtcatgtatttgtcttctgttgaaaagtctctgttcatgtcctctgcctacttttaatggggttgtttgctttttcttgttaatttaaatttgttatagattctggatattagacctttttcagtttgcaaatgttttctcatattctgcaggctgtctatttactctgttgatagtttcttgggctgtgaaggagctctttggtttaaattagatcccatttgtcaatttttgttttcgttgcaattgcttttggcatcttcgacacaaaattgttgccagggcctatgtccagagtgatatttcctgggttttcttcargggtatttayagttttyggttttacgtttaagtctttaatccatttggagtttatttttgtatatggtttaaagaaatggtcctgtttcartcttctgcatagggctggccagttatcctagcaccatttattgaataggcaatccattccccattgcttgttttgtcgactgtgtcgaaggtcatatggtagtaggtgtgtggctttatttctgggctctctattcggttccattggtctacgtgtctattttgtaacagtaccatgctgttttcgttactgtatagccttgtagtatagtttgaagtcaggtaatgtgatgcctccagctttgttcttttgcttaggattgctttggctattcaggctcttttttgattccatatgaattttagaatatttttttctaattctctgaagaatgtcattggcagtttgataagaatagcatcgagtttgtacrttgctttgggcagtatggccagtttatcaatattgactcttcctatccataagcgtggaatatatttctatttgtttgtatcatctctgatttctttgagcagtgttttgtaattctcaccatagagatctttcaactctctggttagctgtattcctaggtattttattctttttttgtggctactgtgaatgggattgcattatttatttggctctcagcattgatattgttggtgtatagaaatgctaccgaatttcatacattgattttgtatcctgaaaatttgctgaagttgtttattagatcaaggagcttttgggcagaggcaatagggttttctaggtactaggtataaaatcatatcgtctgcaaactgagatggtttgacatcttatctttctatctgcatgtcttttatttctttctcttgcccgattgctctggctaggacttccagtactgtgtcgaataggagtggtgagaatgggcatctttgtcttgttcttgtcccagttctcaaggggaatgcgtccagcttttgcttgttcagtataatattgactgtgggtttttcatagatggctcttattattttgagatatgtgccttcaatgcctagtttgttgagggcttttttttttttttttttttttttttttttgagacggagtctcgctctgtcgcccaggctggagtgcagtggcgggatctcggctcactgcaagctccgcctcccgggttcgcaccattctcctgcctcagcctcccaagtagctgggactacaggtgcccgccactacgcccggctaattttttgtatttttagtggagatggggtttcaccgttttagccaggatggtctcgatctcctgacctcgtgatccgcccgcctcggcctcccaaagtgctgggattacaggcgtgagccaccgcgcccggcctgttgagggcttttaacgtgaagtgatgctgatattttttaaaagcctgtaatcgtgtggtttttggttttagttctatttatgtgataaatcacatttactgatttgcatatgttaacccaattttgcatcccagggataaagcctatttgatcatggtggattagctttttgatgtactactgaattcagtttgctagtattttgttaaggatttttgtatctgagttcatcaaggatattggcctgaagttttccttttttattgtgtgtttgccagattttggtagcagaatgatgctggcctcacagaatgagttaggcagaagaccctcctcctcagatttttagaatagttttagtaggaatggtaccatattcccagggctatataagaaacagagttgaatttggttgaatttggaaacagagattaaggaataggccaaaagtgatgaatacaggggcatgtaatatactttcaggaatccaaagtccagttcattgaaaaaaatgtatttgtaaatttccttttaaattccaaatgaaaatttgggttaactcagaagaatatatgccatctaggataacaataaatgagcctaacagtctttaactatctggtgatatgggattgcctgaatcatggtacctctaaacattgcaacccttaaaactcatgctatgtgtgaataattaatgccacaggaaatacttatgagacattaaatttaaaaaaggaattgcatttgtcattttttcatacattcataatgtaaaagtgtgtgtgtgtgtgtgtgtgtgtgtgtgtgtatgtatgtgtgcgtgtgtgtgtaaagaagaatatgattgggaggccgagagaggcggattacctgaggtcaggagttcgagaccagcctggccaacatggcgaaaccccgtctctactaaaaatacaaaaattagccaggcgtggtggcatgcctgtaatcccagctactcgggaggctgaggcaggagaattgcttgaccctgggaggcggaggttgcagtgagccgagatcatgccactgcactccagcctggccgatagaatgagactctgtctcaaaaaaaaaaaaaaaaaaaaagaataagaaaaaaagactagaaaaatgtatgtcagaattgtaacagtgctttgctttggggaatgctaggaatgtgtgtgggatttagtttctttccaatgccattgtgcatcttcagatttctttatgatttctttaccttattgttgaaataaaaaaagcaataacaatacacaattattttttaaaaggaagaagtttaagcaaagggaaaactagcatatgacaaaatagctgaaaccagaggtagagcttataagccaatatgccaaaagaccctgcacttggcctttttagtccaagtgatctatattttagctgagtttcctagaagtatatacaaggattctcagtggtgactrgaatgaacagactagctgttcaggaatctaatgcctaccatagctattaatagctaccactggctgttcgtggtggctcacacctgtaatcccagtgctttgggaggctaaggcaggaggatcacctgagtccaggagtgcaagaccatcctgagccacaaaggatgtctacaaaaataaaaataaaaaatatctgggcatggcgaatcacatctatagtcccagctacttgggttggtgaggcagaggatcacttgagcccaagagttacaggttacagtgagctatgattgtgccactgcactccagcctgagctacagagtaagatcctgtgtctaaaaagaaacaaaaaagctaccactaatactgatatttaagagatttctccagtatatacccataaagatgaaaaaccacatcttttagtgagtgacatccctgtaagacacaggggcaatagcgttcacaggaattagtctcatatcattctgagacacagatcaaaagtttttcattactagcaattctagcagatataaaaccatgtgaaccaggtgtgcagcagctttccagtgttgagtgtgaaggatgggtagctctaatattccctttcctgtggcatacctctttgcagtttgactttgtagatcctcccattgagagttggagactatttcctcaccctttaaaactaggctggggttgtgagtttctttgtctggtaaaatgtggtagaagtgatggtgtgtcatatctgagcttggtcttccagtggccttttgtgtttctcttttatcctgtggacccctacgtctgtcaagagaacaagctcagattatcctgccatcctgccagaagatgaaagatcatgtggaaaagagacgagtcatcctataccatcaagctcccatttgacttgccagttgatcacagttgattatcttttttttctttttttttttttttgagactgagtcttactctattgcccagactggagtacggtggcacgatctcggctcactgcaacctctgcctcccaagttcaagcaattcttgtgcctcagcctcctgtgtagctgggattacaggcgcccgcaaccatgcccggctaatttttgtgtttttagtagagacagtgtttcaccatgttggccaggctggtcttgaactcttaacctgaagcaatccgcccacctcagcctcccaaagtgctgggattacaggtgtgagccaccgtgcctggctgcacagttgattatcttatttgcagccactgagataaaatttgactctatatccttaactaactattagaataaccacaaatatgactcttytggttaaaaaagaactgttttttttggtatttgagcccrtgaagctgcattcagctgagctgggcccagatcagcagaaccattgatatgtcccatacacacatgagcaaagatgaggctttgctgtatgctgttgagcttttgtagttgtttgttatgtggcagtgttgcggtaatagatacatgatccatctggcttcatccttgtagagaaggagattggctatctttccttcagggttccagtcctggttcttyctttaactagctatgtggctttagcaaatattttaacatcattaagtggcatatgtaaaatggaaaaaaactaatttttgtctaactcacaaaattgctaaagtgaagtgaaatatatgtaaatgtatttattatctatacatcacaaggtaaaatttgattaatctaaaactctctgctctgtaataatgtactacatttaagtttttttccaatgcatttgatctttcagctactacataaaagaaataaacaaacataaggactattctaatgccatgccagtcacagtgttaaaataacttaggcatattttgataccccttgatatgtttatgatgaatttgaaatatactagagaagaaattttgtttagttttataagtgtggcttacagaaggagactttaaataaaataaacccaaacaagttttgatttactcatggacatgttttagttcggaatgtcaagtatgaatgtccgtctccagggatatcagggtgtgaatcagatgtgcatgtttcacaatccacaggtttccatatgtttttgaaatatagaaaaaacttcactaatttaagcttatcagcattcaaagttatcttatttgcagccactgagataaaagttractctgtatcctaactagcttactatttgaataaccacaaataytggttaaaaaagaaccaaaaatagttaycttggtttgactgtaaactgcattcttccatcttgaaaattttgaatttttctagattttcaatatgtttttggggtaataatgatatgtaatattataaaatttgaagtaataataatgaatgaatgaaattaaataaaatggactccagataccttcacctagagacttatgctgttaattaacttttagagactacaaactcaggtatcagcctgtgcatatatacacatagaaagataatgcataaataggagtgcttttagaacaactagaatataggatgcatactaatttaattaacatcttaaatttaactttacttgaaattaagcataaaaaagaagctgaatataatctaagtggctgaactctagcaacaatttcactgcagaataagttgtttctaaaagatccctctaaagttcataagaaatgattatgaagaaattgaagtttacatcattacttatgtaactaaaaattttcctttaacctctctaattttgttatgaaagacaaagaaattagattaggtgggcttcttttttactttaccatctcagcctctgaatttgttagttatattatttttatatttttgaggcttctgccctgctaggatgctttgtggcaataatttctgaaattcttcaaacttaattttatcagattttataagaaacttagcaattcaattaaaattggaaatgcaaaaagtcttcagttgcataagaaaacccattcatgatagtagaaatgtaaattgtaaccacactgagtttccatttcttacctatcagattgtcaacatttcgaaagtttggcaatacctttattattattattattattattattattattattattattatwctttaagttctgggatacatgtgcagaatgtgcaggtttgttacataggtatatatgtcccatggtggtttgctgcacccatcaacccgtcatctgcattaggtatttctcctaatgctatccctcccctagccccccactccccaacaggccctggtgtgtgatgttcccctccctgtgtccacgtgttctcactgttcaacccccacttatgagtgagaacatgtggtgtttggttttctgttcctgtgtaagtttgctgagaatgatggttcccagcttcatccatgtccctgcaaaggacattaactcatccttttaatgttaaggctgtggggaaacaggctttattatgcattgctgggaggagtgtagtttagtgatatctaccaaaactacatgtgcttagcttttgacccaataatttcttttctgggcatttatctttttatatatatctgcatgtgcacaaaaatgatgtgtttacaaggttagtcagctgagctgcttataacattctaacttacaaagaacctaagtgtccatcagtaagggactggttaaataaattatggaacattcatacagtgaaatatttttcagctaatggggagcagaaggaaaaggtagagaagggaaaaagaagagatctctgtattgatttaggaagatttctaaggtatgttgatcggtaaaatgttcatgtccagaaagtgtgtgtaaagagataagattatatttgtttgtgtatatatacatatatttatttattacttattttatatatataaacactttatatataaacactttaaggaaaatgtttaccttgtgtgagaggggacaggagaggaagggcactgggagactggtaactctgtctctttaatttgtttttatttatttatcactaataattacttattacaaaaaagaatgttaaagcattaagtggattcattctgaacagcagtgctttgtctcagactcctcattcatgacttctttaatttgattgactttttggttagctagattttgccgtctagttaattttaaaggaaatgaatgaatgttctgtttcctaaattgctgcatgaatgaggatatctatcaaaattgtgtgtatcaattctcccttgaaaacctttaaaatcttttggtctcacttgttttctacctcaaaacgttgttagtagtattccagtgtcctctggaatgagattgtggcactttcaaaaagtagagtttttcaccctatacttcgcttttgtttcagtgaattttttttgaggtggaaaaggagctcactaaaatggtttatactttctgattttatcccaaagtttggatttctttttgggttatcttttaatgttgcattattttgtggattttagctttctaactttctgttatggaatatactcagggaagtgttttacatctggagagatataattcaaaattttctctatgtgattatttatacatttttcctgagtgtgtgaaataaatttaagaataatctgaagttttgtgtttgttttagttgcatataccttgaaattgatgttaattgatgttgtctttacttttactatattgtttaggttatgaattgtgtgagtattctctaatggagaagtaggctgtttcatgtctttattctatattgactgtgacataagccttgtagagaaagtttttctatgtgcagaatgtacaaaatgtcttgcaaatctctgtgagtttgcccccgtgatgcttgtttcagcatcatgactgaaacaataaaaggaggaacatcatctagtttctctatttgcctgtgataagtccagattctctgagaagcagacatcatcatgggattaaatgtgcaaaaaccttattagagagaaaacctgtgcgagtgaaaaaagggaggcagctgggggcagctgacagagccctcagactgtgatgcacatttgaccctgagtgaaggagagagggagacaaggttggttggaagtgtcctggactggcatgaagtttcaggaaacctgaaggagcatcaaagttcacagttagaggagtcccatatctcctaggaacaggcatgccttaatctctctgttggcagtagtcattgctgggagtgctagatggccccagcctaaatggggtgatggctttcagaactaagcaggctgagcaccttggtcagcagagatccctatagggattcttaccagtacatctttctaaagcttatatgggactcttcttactttacatttgttcttggatgacctcatccactactatgaggtgaattatcacctagtctcagtctgtagtcctgatcactatctttacctggcatgccaagcctattttccaattgccttctgtgtactttgctgccctgcaaaccctcagactcaacaccccatgatgaacttatgatccttcacctcccccagtcccaccctttattcctgtattagtttaccatgtctcctttcttcccctttcccatattgaaaactaggagtcacctgtagctcttcctctccttcacatcaaatatccaaccagccaccatgtcctttgcatgtatctaaagttctaaactctggtgcctcctcccatttctgttatgacagttctaatttggttcatagattcttctttagaatcacatactttaagatggagtttgccactataggtccatcgtctattttttaacagtagtgactggcaggtatctctccacttcctagagttttccttgctgatctcatcctcagccattcttctgcacttagacttgtagaaaaggtccagatctgcaatgtggatgctgttggagtgctggcattttttccttctgcttctcacacggatattatgaatgataaatttttatgatggatgagttcctgacaccagagccagcaattcctactccccatatagtaatacagaaagcatgaaaagtagataactgaatctatgagtgcataggaccactacatatttggtggtggtggtggtggtggtgttatgtgtgactgtgtacatatatgtatgttaaaactagatatgataaaaccttaccactttattgctgtatgaatcagttatttgtgtaaccaacaaccacagaatctctgtggcatgtaacagtggttgttatctctagctctctcatgcgtggcttggctgaggtttggctgatttaggctgggctcacataagcttcacgtcaagctttgtcttaggcattttctgttccaggctcaggatgtgtatgaggctctggtcttcccaacatgtgtttgttgtggggcccaggtttaagagccagcagccatgtgaagaagcttcttttcatagatggcaaaatacaagaaagcaagaccaatggcacaagtacatttgaaatctttccttgtgtactgtccactaacattcctttggccaaagcaagttacatggccaagcccaacatcaaatggtctagtgggaggggctacaaaggaagtagacacagggaaggatgaagtactgggaacaataatgcagttgaacacaattatgatgattgctttccataagaagaaaataaatagaaaaaaaattggggttggttacgtgcaaatgcctttcctgctttatgtttaagtctaattagcagaggagatgcattttcctataaaaattagaaactaaaagaggagcaatgtggattgctagacagaagtatgtttatgacattattatgtgctaattctttcttaagagtggccatcaatttataaacttccacagttcttttggaaacttcctgggaattgtctattttcgtccatgtttgtaatctctgagccatataaagagtgaagtgtattgcgacgttttcactttcaaaactattcttagccaattttgttagggtcttataaaatgtgctaaagagtcaaacgttaacatatcagctttgaatatatcaggatatagaatgtcagaagttaaacttagaattcttacagtattgtgtagcagactgctaaaattagtatatgattgatgacattgtgatttgataggtaattcaaatattttgtaagtgtttcagaggaaaatattgctataaagcaactgatttagaaattgaaatgagaaatgtcccaagaggtgaatagttgtaatatttattyaaaagtaatgttgcctatcctgctcctgataaccactatttcattctctatctctgtacatttgactgtttccttctaggattccgcatataagtgaatcatgcaatctttttttwctgtgtctgtgccagacacagaaaattatgcttatttcacttagcataatggcttccaagtattgtgttcgagatttttgctaagtgaatagctatagctgcttttgccattggagagttgggggatgggtaactatgtgagatagtggatatgataatttgtttgactatagtaactattttaatatatatatatatataaaacataatatcatgttatataccttaaatgtgcacaataaaatgtattttaaaatatggcctaaatgaacatgatgtagggtttcctttattagtattaggaaggattttaattgtgcatgtagatataagacatttccatatgaaatttatataataacaaagatattacacaaggaaaatgggtctctttcacttctacacctgaaatgtaggcggcgacacttttatctagtcatagaaaacacaatgaacttgtggttgaatgtactcaaattttctatcaaattacaaaatttgtcaaaactgtaacacatttatcatccaaattgtcttaagaaacgtgcatatgacaatgtctttaattttcagtcacccaaattttcaacagttgtattattcacagtgagattcatccaacaaatgtatatccatttcaacttggacaattttaagaactgacaactttccatgtatgatatttgtcattctcagaatcccttagaaacctcaacacttaaccatttaccatgtttcaagggaatgtttttccaggaaaaaaaatgcacaagtgtgaaaaagcaggagaaagagaagtgcagttttaatagaatgtccaagatttaaggttatgatatgaaaactaggtagcatgttcttagcaagtcttgaattaatggcaaacttatgacttcattgattttctttaccccatcccctgacatataaatatatgagaaatatagcttccataccaacacctaaagacagatttcttattcaatttctttgagaaactaaattcaatggcagatgacagcaataccagtgtactgcagaagtatgctctgcattcctgtgttttgttcatggtatacattcctaatgccctttttgtgaaacctggttaataattaagcaagtcaggatgtacgaaccacctgaaattctcggataagtagtttcttaatatctctttttgtacttgctattgaaagtatttagagttatttttgcttgattatttacaattttacactttctttataaactaatttttcctaaataccctagtgtgattttaaagtttgaaatgccttaacattctccatcagggacaagttatgttttgtagttagcggcttgatacccacatgtagctctgtgtttatgatggcagagcaaagtgaagattgcagacaattatcttgatggtcaggcctccaggtcagctggctgctgtgtttacagataaagtgagctggacattgggaagtccactggcaacttctgaaatacataatggtctaaattgccttctattctcagggcccaagccacttgctagtgtaagttggctatttaagggcgagcattaactctcgtgggtcaccagggaaccatttaataagtaactagaggcctggagatgttcacgtattcctctaaatgccctggttttgttactggtgcagttcactcaaggtcattctgcagcttcaaatatttaatgtcctttctcaagtgaatgaccgggtccggtggagaagctggctgatttgttatttgtagtcagccagtacatagtaagctaatcaagttcataataattatattctggcaagaaaaagctgattaacagatgtagtaggagtttagagaggctgaaataaatccgagttatgataaaacaacctcattagagaagagtatatacatgcataaggattttgagctgaatacctttatggtttttttgtaacttttacttttgacataatttcttattttttattttttattttttaatttttatgggtacatagtaggtttatatatttatggggtacatgacatgttttgatacgggcatacaatgcgtaatgatcacatcatggagaactgggtattcatcctctgaagcatttatcctttgtagtgatataatttcaaacttacaaacaatttgtaagatcaagacaatgaacaactatacatccttcacacaaattcactgattgtttctcatttttttccatctgctacctcattatatctaccaagatatcaatccacttaatttttttttcctgaaccatttcacggtaagttgcagacaggatagcccttcaycttaaataattcagtgcatatactccaagaacaagaacattttttacgtgaccacagtgcataattatcaaaatcataatggtgcatactactatccagttgtggtgtatgattttaatatgttatatagagagaaacaaaaatgaaaatgaatgactactattccaaaatgcgaacgtgtgagttgcattgggacagattagtatgctctgtaaaggggaaattaagctgacttaattatttaagtcatgtattaagctaaatttcaattatgaaattactggatgatccaaatacatattagatgagggtcagtcacttattcaataactcatttgcctattttagtcaatgctcaggtgtcttgtttttcctaatgacttccaaaggtgatgattactggcacttactcaagcctaactttcacataccacttgtaaagcaggtttgaataaaagatgcaaggaaggttgacttcaatattcagccataactggacctcttggtgtgttggatttctggttttcagtatataattcagtataaatatagttaggatacaataaaaggctgatcaaatatgtctaaaggagagagtcagtatagtaacataagtaatatagacaaggcatactatttgaattttggattttaaaaaatgtcatccttttattcagactttctaatggtgcactattgcagtgataattagcaaggttaaaagcctcttcctgaagactttagggagatgcttgccattagaataatctgtttatacctatctcatgtttgtttttacagcctgtgtttcaaagaatagtattaagtctgatggattttcttgcccgagaagctaatttaaaaaaatcgtattcactaggtgaactgcagactgctaaaaggtgggactaagatgaacactaaagaacaacataaaggacagatatcactcacctgtgaggatttggttagcgatgtgggaggagagccttcctgagtatcttaacatcagtgcttctctgaaggcattggtagattttttttttttttaagaatgcaacatcatctgcaacctgaagtcagttctggaggcaggatgtacctcatccctaagccagttatggaggcaagactgtactcatatcactgtactcacatcatttacaaggagtaaatgctacataagtggcaccagtgtaagtatctaaggattcaggggatggggagatatcttagagacaaatagagcagacttaaggaattggataggtagaaaggagggaagagaataagaaatgatgtaaataaaaatatataactgcagagaagcagataactgttgaggagtggccaaatatggaggggggctaatgtgtgtgtcagggatttccagtttccagttctcatgaaacaggatgggggctaaaggagtggtctctaccatccagttagtagaacaggatgtacataatgagtggatacctttcaaatattcaattacattcaaaattttgctaaaacatttgttcatgcacatcttgccatagtgaagtccagcccaggaatttctgcctttgcatatgwaatgggatataaccagagactgacaaagaacattcaggataaagagaactattaacttgacacgtattttgtaggagatgctgtgggaaaataggcacattcacatattgctggtgggagtgtaaatcattacactacctataggagggcaacttgatgataactatcaaaattacaaatatgccctttgccctgaaagtccagcttctgtaatgtatcttacggaattacttctgtacgatgcataaaaagcagaatattaaatcccaaaccaaatatttgaaaatggaaactggtcaaataaaccctgccagccatagaatactatgcagctgtaaaagaaaaaattttttaaaaaaaaggagaagaaaaagaggaggaggagaaagatgtgctctatgggttgatttggaaatatcccctagaaagaaggcaagaataatcayatttgcatatatttgcataaaggaactagaaggagatataaaaaacagaataaaagtgttttgtagtgggtggaaactggtagatggagacaagggtgggtgtgaaaktcttcactctgtaaaactttttatacttsawaatttctgagctgtttctgtactagttaatggaaaaaatgaaaagagaactattgtgttcttataagaatggcaaggactgctaattttctaccctaacatttattctcccaattgttttttattttaaaccagaacattgccctgtagacttaatgtttccagcttctcttgcagctaggtgtggttgaggtcaatgaggtayagtaaatgctgtgtggtatatcttggtactttttaaatggatctgttaagctatgagggtctttctgccttgctttcttctttccaatatagatgtgatgttcagaagctcagcagacatcttggcaatgaggggaccttgatattggaaaccatgtgctaagaggacagagaaagacagacccatgagtcccgggtgatactatggtgccaacatactggctgcttcttggtttctcttatatccaagaaagaaagctctaccctgtgtacatcacacttattttgatctttatggtgttgattaggcattggagtctaatccagtatttgccccaaatgtagaatactgtttttctttaagatcttttctttgcaaactttgcttgggccctctaagcttgtgactttacttcaaatccagttccactttgggttgatataattatggcatgtgaaaagtgtttctggagaatcatgagatgtgactattatctggtaaagtgtgttgcagtccaaagtgccaatggtggaaaaactcccgtaagtgcaccctgtcatttttctttttaatttaggtgtacagctgaatttttaatatttcatatgcagttaaattaaccatacttcttgtgtcaaaataaatatgcagaatctcaatcatggacttaaagatgcagaaacacattgattttaggaaaagtacatgtctcttttattaccacacatataattctggtaaaaattatgatgaataatagagaaaaaatatggaaacatggatgaaatttgttttatagatttgcaggatgcttgctaacatggtggtagggagggctgatgtattttcagtctgacatctgttaatgtgactataataaataaactgtatttactaagtaaacattcaacttttctctcaaaaagatttggtagtaaaagaatatgtcattgtctcattgctggaagcctcatactttttcatattggatggggaagggaattccattagtggtagcacaagtccatctgtcttacattagacatttgtctaaaccaactttgctcactgaaaagcagtgtaataacaccactgaagagagttcttaatagactgaggaagcaaacaaattcaactggtgtttcataatatctaaatttttagacctgagatcatttctttggattcccttctacagattttaatttgcatgcctgatttagcagcctctttccctgctttaagtagaaagtagaaataatattttaaaactaatttttacatctttttttgcattatggagatgggctttcctgtgtgctattagtagaaaatcttttaggaaaataaggaagaaaccatgcagagggacataatttttcaaaaaaggctcagaagatatagcagtttgtctttatgtttttcaagttaagattctcctatagatatattaaacctaatccccaatgagagggtatttggatttggggccactgaggggtgattagggcatgggggcagagccctcataaatgggattagtgcccttggaaaataggcccaagagaactcccttgcccatcagccaggtgaagacacagcaaaaagatggctttctatgaaccagaaaatggccctcatgtagtgtgtctgcatcctcttcatccaacttcccctaacatcttacatgaccatagtccaatttttaaaagcagaaaattaacattggtacaatactgttaagtaaacgagagacctaattcaaacattacccatttggcaactgatggattttttattctagaatcaactcaattttcccacagtgaatttaattgttgtgacgttatttagtcttctgaaatctgtgacagttccttagtctttccttgtctttcacatccttggcacttttaaaaagtattggtcagttactttatgcaatgtctctcagtcttgatttgtatgatgttttctcatgattatattgaggttctgcatttgtattagtcgattctcacactggtgtgaagaaatacctgagactgggtaatttataaagaaaagaggtttaattggctcacagttcygcttggctggggaggcctctggaaacttacaatcatggtgcaaggtacctcttcacagggtggcaggagcgagaatgagagcagagtgaagtggggaaaatctccttttaaaactacaaaatctcatgagaactcactatcaaaagaacagcatgggggaacccgccccatcattcaattgtctccacctggcccctcccttgacacatggggattatgacaactcaaggtgagatctggatggggacacagaaccaaaccatatcagcattcttggcaaaaataccacagaagtgatgctgtgcctttcccagcacattctatcagacagaaaatgatattttgaaataccatttggcagttggctctttgaccaatttrcctctaattcaaactctgtatcattattgagcaagcatttagtagcttgaaattgtagctgcatattctccattttgctcacaagtgtatcacatttagaaagaaagatgggattacttttatcaactaatctggtgtttttttctacctctgtagaaatggaaaataaaagctcaacatctgattattgtaggtgttcttactagctgggttaggaaaagggataaagatacatgtgctgcagtgcgtttatagaggcaggtgatggtcaagtattctttgatggtcaagtactccttctgtctaacagcctcaaagaagctccttttctttatatatatatataaaatatatatatttttaattatactttaagttctagggtacatgtgcacaacgtgcaggtttgttacatacgtatacatgtgccatgttggtgtgctgcacccattaacttttcatttacattaggtatatctcctaatgctatccctaccccctcccccaaccccacaacaggccccagtgtgtgatgtcccccttcctgtgtcmaagtgttctcattgttcaattcccacctgtgagtgagaacatgcggtgtttggttttttgtccttgagatagtttgctgagaatgatggtttccagcttcatccatgtccctacaaaggacatgaactcatcattttttacggctgcatagtattctatggtgtatatgtgccacattttcttaatcctgtctatcattgttggacatttgggttggttccaagtctttgctattgtgagtagtgccgcaataaacataagtgtacatgtgtctttatagcagcatgatttatattcctttgggtatatacccagtaatgggatggctgggtcaaatggtatttctagttctagatccctgaggaatcgccacactgtcttccacaatgtttgaaccagtcccaccaacagtgtaaaagtgttcctatttctccatatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaggtgtctgttcatatccttygcccacttgttgatggggttgttttttttcttgtaaatttgtttgagttcattgtagattctggatattagccctttgtcagatgagtagattgcaaaaattttctgccattctgtaggttgcctgttcactctgatagtagtttcttttgctgtgcagaaactctttagtttmattagatcccatttgtcaattttggcttttgttgccattgcttttggtgttttagacatgaagttcttgcccatgcctatgtcctgcatggtrttgcctaggttttcttctagggtttttatggttttaggtctaacatttaaatctttaatccatcttgaattaatttttgtttaaggtgtaaggaagggatccagtttcagctttctacatatgcctagccagttttcccagcactatttgttaaatagggaatcttttccccatttcttgtttttgtcaggtttgtcaaagatcagatagttatagatgtgtagtattatttctgagggctctgttctgttccattggtctatatctctattttggtaagagtaccatgctgttttggttactgtagccttgtagtatagtttgaagtcaggtagtgtgatgcctccagctttgttcttttggcttargattgacttgacaatgcgggctcttttttcgttccatatgaactttaaagtagttttttccaattctgtgaagaaagtcattggtagcttgatggggatggcattgaatctataaattaccttgggcagtatggccattttcacaatattgattcttcctatccatgagcgtggaatgttcttccatttgtttgtgtcctcttttatttcgctgagcagtggtttgtagttctccttgaagaagtccttcacatcccttgtaagttggattcctagctattttctgtagaacctcttctccattcaaggttgcagaagtctgtgacaaccaaggaaaagagacagcaatggggctctcttacctgtgcctaggaagaatcttacctagtatcttcttctgctaggaagagagaacagatgtataggatgaagtatctcaccttttgggatctttttttaaaataatctcagaccatgtaaactccagccatcaagggaaatgtgctgattcccacagaccgtatttcttttcttttttttatattgcctcagaaagagaatgcatggaactgctgctgcttcaaactagatatctgacactagtgctaatggctggtttctcagctaatccacctgtccttcacttctgaagaactgaatgatagtctttgtatttccaactacaattacaaattacatgaagcaagaacaaatttttagttttatgattatgtggtaagcatttcaataaagctccacaaatgatggaaagtgtgaaggagagaaagagggagagagagaaagacacacacacagacagacagacagacacacacacacacacacacggacccattacccattatctggacagaaacatcttaatttgcgggaacattaaaaattttttttctatgtggctatacataattatttataaatctacaattttatttaccaaaagtgtgtgtgtgtgtatagtgtatacttgcttttaataatagatatattttccttgacaatgaacattgagcaaatattatcatttttaaaggctggacagtagccccttctgtggatgatctgtacctgatttaaaaggtctcacattgatggaaatttcgccattgtcggcagcgctgtagtggacatccttgcatgttgattgtgcattctactcagatgtttccctttgggtaaaagcctagaattggaattattaagtcaagtatataaaaaattgagtcttattgcatatagttaaattgtctctcagaataaaactgctccaatttcaacttccaccrygaatgtatgaatgtgcctattgccatgaatgtttgccgaaataaatctttggcaatatcaaaatatatccatgtagcctctattttatttctttattttgaagttgagcctccttgcctaagttatttttcctattatttcaaccttatttggtgatttgttgcttatattttaattagtttgtatgtgagattcttaatgattttatatattaaggatcttaatgatttttcagtaactgcaaataatttttctagtttataacttatcttttaactttatttgcttaaaatattacttctgaaataattaaaaataaactacataatgaagatctttgtacgtactaatatttaatatgtgataatgcaacaagtatttgtgaatattgtaataggtaatatcttaagcatttacaaatgttaacttattttatcctcataaaattatttaaggtgtatcctgatactaagtcgattctacagtgagcatacttaggcacagagaggttgaatatactgcctaagtttacataggaccaagtggagaaactgaattcaaagccaggcaattacctttagagttcttgttcttgccactgcattttataattggttaaaaaaatatttatttattccggatattaattcattgtcactcatttgcattactaatatcttctccctcttggaagtctctcttttaattttgtttatgctatattttgatatacacaagtatgtcatagccattatatgattataataatgtgatcagccttatcaatatttttcttcctgggtattgtttttgcagcatactagaaaatccattgttactcttatgccatgaaataggccttaatattttcttccaaaaatcttgaattttcatttttaacattcagagctttaatctacctggagtcaatttctatgtttggtatgataggaactgaattatacctcttttgttatagaaaatgtgtaccatcagcaatatttatcaawgtaactaactttattaagtccttgaacttcccattttatttctatgtgctttcaaaattttattattacagagaatgaaattgttttattgcctttcaaaattggttattcttgtgtataggaatgctattggagcttagaatattgatctagtaacccagtaaccttgcttaacaatcttttgaattttaatagtttttttctgaagatcctcttggattttctatgtagaaaattcataatctatacatcaccacacacttttccaactgttttaccattttatatttttctcatctccttgaattatcttgggcctctgataaaatactgaataaaagcagtatttatctggatccgtgtattttctctgatcttacagggaaggcttcttgtgttttaatattaagcataatatcagctttagatttgtagaagatatttcttaacagattaagatctgttcccttttatgtctgattcgctgaaggatttagaaaaattatacataggctaagttttgtcaaatgacttctctgcatataataaaataagcttttctcctctgctgcaaacttcttgctaatattttattttgcatctatatttgtaaggcaggcccacctaggattattatttctcagacttttcttgttcaatatcaagataataccacttcatagaataagttagaataattgtcttatttatttgggtttctttagttagttatttaagctttgttatgttcccagttcttctcagccatttactactagtttctgtcttgtgtgttttatttattaaaaaaggrcccccctccagcaatagtataaaaataatcacctctgtttttcttatattttgaaatattgtgggtttttttaacctttaaatcttaaatagataacttagaattggcctctccatgtatgtaatcaaaatagggttatacaattcttattttaaagccagaggaaaaaaatccaaaaatttttttagcaaaaacttcaaatggattcttcatgatgacagctggggtgcccaagagaactgctattggtttcaggtttaaaataaacctgaatctctacgtaattcaacattatgatttggtacttaatgcaaaagtaagccttcaactcaacatataactggagaagaaaaatttaattccagaagctttccatctcatataggttattactctgccagagtaaggatttactttctcaagcagttggaattcccaagcatactgaagcaagttatagatagcctgaaaagcaatgtgaaaagcaatgcttcatctctgaagcaaaatttcctttcagctttacaatcaatgatgctatcagtgacatggtttttaaattctcgttgagaaaatttaaaggaaaatgttaactttttaaatgagcagacatgaagaacacagtttacctacaacatgaatgaagaagtatagagttattgcctgtgttgggttttgtagatccttcttgattcctgcttatatttaatagagatgtcagaatgaaaatgtccaacatggttaatattaatcttattcctcagccagtatattcaggaaggcagtatagttattttataatgttgttcttttgtttgtgtattttgttgttgttgttttgagacagtgtctcactctgtcgcccagactggagggcagtggtgccatctctgctcattgcaaactccgcctcctgggttcatgcaattctcatgcctcagccttgtgtggtagctggaattacaggcatgcgccaccatgcccagctaatttttgtaattttagtagtgatggggtttccccatgttggctaggctggtctccagctcctggcttcaagtgatccgcttacctccgcctcccaaagtgctggattacaggcgtcagccactgcgcacagcctataatgttttttttacagcatttatttcttggcttactttttattcctgttaatgttgatattgtaccatttggaaattcagctattttatgtgtacacacatatgtgggcactttctacttagtctgtttctacagtgatatctatctttctgtggatatttatgacagataggcagacattcaaatgcagaatacatcaaggtatttgttggactagataatatcaatatcacatggaataggtttgcttgcttgtttatttaattcaatcgcatatgttgagagtacagtgtgtgccaggcaatgcattgtgttctgggatcccacacagggataaagacctcataatggtgggaggtagatggtttgcctgcaataatcacatcagacaatatgttgactgatagtccagtgtcatcaacaatgtgtcgagggagcacagggatggaaataatttgttttgcagggacttgagggtgaatgtgggagcagagatgaggaagaacacgcagagaaagtagaatttggtctaggccttgaagagagttgtatttcatatgagggggagcgagtcaaaacactgaatcaccagggtactttgcttctttagtgaatgggaaatattatagtgcacgtggcaagtagtgagtagtgattacggagcaggaaagtttaagctggaagagctcagtcattctgggttgtatgcacacacacgcgcacacacacacacacacgtacacacacagaggcagtggcatggaggatcatttggaagctggagaaagtaaaaatcactagagttgaggatacagatgagaatctgagcaatgggagtagtctgaacaataggaacgtgggaccgacataagaaagggatggaattgatgacaaatttaatgtgggaaataaggaagaggaagaagcaaagatgatatggaagggtctagcttgtgtgaccagatggaaagtgactcattaatggaagagtattaggatggagaaattgttttatttttaaaataatttccagtgtagtgatgaaaagaaaaagwtactgaattttattttgaacatactgagtttgaggagcctgcttaactatttaggtggaaatgtcactttacctaaggaaaatgagtttgggctctgaaaagagagaagtacatgtcaccaggccgggggtggggtgggggatgattgaagccaagggaggagatgtgcttgttcagggagagatgcacagacaaatcaggttcctgaaaaacagaaacatttaatgcatgatgggagggatctattgtcttgctgaagaatgataagtgagatgcagggagaaaacttggaggacactttattgaaaattaaaggacaaatgtttctggagggaagaggcaacaaaataatagatggagattttttaatacgtgccttagtgttcttgcccttgaattggtacaaccctgaagcacattgcatacagtcttccagaatcccctgcaggattcagccccagttgcccatagtgaaggacttgtactttataacacctttcattgccttccatcccttctctgtctcacttctcaacttccctcttggtgccttctggggtcacctcaggataacctacttgcaaccaaatccttgcatcaggatctacttctgggagacaaaatacctaagacaaaatagaattttggtttctttcttcctaagaatggactggaatgggttagaaggaagatgaactgtggaaagagagagctaagaatgacagggtggggaaataattgaatacgtagtccggtgtcatgagcaatgtgtcaagggagcagagggatggaaataatttgttaaattattaacaactaaataattggagttggaggattaggggcttttcctctctggagaaacacaggaaaagattggagtgaaggcacataatgttagtggtgtgatcattcttgatcattcatcctgtcatttctcatagaaggagacagaattgtttactgaactcaggcatcttcataagcaccctaggtgatatagtttggatgtttgtcctgggctccaatctcgggttgaattgtaatccccagtgctggagatggggcctggtggaargtgtttggctcatgggggcagatccctcatggcttggtgttgtctttgtggcacctccttccacccaaccttgctcccaccatgtgagatgctggcttccccttttgctttccaccatgattgaaagctccctgaggcttccccagaagccaagcagatgctggcacatgcttcgggtacggcctgcagaaccgtgagccaattaagcctcttttctttataaaatacccagtctcaggtatttctttatagcaatgcaagaacagcctaatacactgggatagtccattcattctaagtctgttgttattcaacaaatatttataaatcatatcctatgtgtcacacctatgattttctgccttaaataatagggttccctttcatcattttttttccttgccacttatttgacaatactggttgcttctgctttctgacattgaattcagttaatcttattctgcttttgccatctgtgataataagttattatcctagaaatatgttttgaatttaaactgaatatccatcttgaagttgccttaaattctttatgataaaatccatttagcataataatccgaaaagacagagtgaaaaaaacattatttaaaatagttgatttaatgttgttatgaaatataacaggactcttgaaaaggtgattaatattcttacacatgttgaaacagaacaatatgagttttttcttatctacttttcttatctggtcttctctggcttctaactttattagcattcgtatattttattaattaaaagtcttcttgatatacattctgtgaaatacttatacaaaaacaaatatcaaacctgaaattcttcaagcttctcgatccagctactgatttattgaaaacactgagaagagaaatgtatgattaaatgatgtaggatgaaatttgtccatactatactataggaagtaggaaaatcttcaggacaatcaatctggtttagtcaacaaataaattccaagaaaaaaataagacagaaggggaaacratagtttagaacacatacagctcatcttaaacaattccaatgtatggctttcatttagattgggatttttaaaattatggcacttgtgagataatttgaatattgagtatttgatgatatttaggaattactattaatttgctttaggtattttagttatttgcaaaagagggaaactacaccgttagagatacattctgaattatttacaggtataattatatgatatctgggactggattaaagtagaataggggcaygggagaaggggttggggttggataggatgaccacgaatgaatggtttttgaggctggtttatggctttgagtgtgcattatactattaagtttacttttgtgtatattcaaaattatccatgataaaaatggaaaaaattaaattaatatataggtagatcatcctcagtgtatgaataaattatagtttattttttccaataaaaactttgttatgtaatagcatggtttcttaaattcacctgttcgatagaaataaggttaaacaagttcaagaatcaactaacatcctcctacagtaagcttcattgcaaatccagttttgacctttgctcaaagaagagaatgagaaaataacacatttgtgtgtgctcttttcctgacctatgacttgtatagatgttagcacagtggctttggttttaaggtaaacattctttcagcatttctcatccttctcccattttcctgcatttctcatccttctcccaccttcttggtattttaatcatttatgtattgtgaacattttagataagatgtaaaagtcttatatagtgcccctcagttaaatttgcttagtttcagagctgtgggattcaataaaatgagacaggaattatgggtaacctcataaaggagtatgaaggcattgttatcgttgctacctttttgaaggaaatatgccctcactctgacttggaaattaatagtctttcatataataatttgataaatttagtaaaattcatttttggacctgcatctagatttgcttctgccacaactaatgtgaaatataaaataaatacttactatattttagctaacatactttttcattatttttattcctaagaatggtaaatactaagaattatctaaattgctgtgctgaatcatataaatgtatcccaagaaaatatttcaaaaaaagaaaacatgcacaaagatagtcattataaaggataacaaagtcagcaraaaaaaaaaagattgtcattatagtattttcaggactaaaacaattagacatgaatcaaatgataaaaagtttcaaaaagtaaatacataaatcatgatatttcagcaacaggaattattgaagtaccatgagaaataaatttttaaaatgcaacaatatggaaatattgagatgtaaaattagggaaaaatacaaggagaataaaaattgtgccttcactctgatataaatatgtaaaatatgttagtttatagacaaaagactgtaagaggatgttcaaaaatgaagccagatgttgcattatagtgttggtattaaggatgagttatttttcctttaaattctcttctgctgttatatgatatttataaaattttaaaagtgcagaaaacaaaaaaaattctgccatgaaaaactctaattatattgaaaataccatcctacagggaagaaagtgcaagattacttttaagttagctctaataaatacagtgaatgatttgcaatgaactgccacatattttaaagtctagtttatattatacggaacaatgcagagaatctcctctctgtccttcttaaacagaaaggaaaagtgctgttataaatcttacacccttaaagaagcatggcatcactatgaagataagcttcacctaatgtccagtacagtgctggacccaggtgggtacttaccaaacactgtggaaagtctgaagggatgctggtgagtgcctcccagaggtggtattttcttttccattgccccattttgttcctctataatattattttgcttttttaatttttttaagacacgagatcttggtctgtcacccaggctggtgtgaagtggcatgatcacaggtcactgcagcctcaaactcttgggttcaaggaattctyccacctcagactcctgagtagctgaaactagagtcatgcaccacaacgcccaactaattttttaatatttagtagagacaaggtctcactctgttgtccaggctgatctcaaatttctgggctcaagtgatcatcccatctgggccacccaaagcactgggattacaggcatgagccacctgcctggctaagttcttgtttcaataactgcctcctttctcctcctgcagcttttaaattgtagataaatattttcaggtgctaacctagagtcttactcttccatgttcatrtggggtatctgcatgctgggggaaggaagaggttgaggagggaattggccttttgctgggggtttagtgcactggaaggcatttttagaacatctggagatttgcttccttttgtcagaatcccaaagactagacagatatttgaaccacaccgtagataactgttttgattttttctttttctctttttttcagagacatcataggtcctattctggggccccagtgaattgttccatagactttaagaaattcttgggctgttggatgggaaggcaaaaccatgtaactggatggagtgattcttaacttatttcttttcactctacagttaagctaaaattagaaactctgaaaagctggctgcttttaaaaggagataatggacacaacctttgagaagggctggtgatggaaggggaagggaggaggcggtcattttcccatacatcaataaaccatagacatgcttggttcattccaccactaggttattgctgctgggaagcaaatattatcctgtctcttgtttatggagtaggtttttttttcaaattaattaaagggtttatcatctcactaaacacacagatgtcttaataaaatgtagagctatgtttagtatcatgcatctgtttcctagatgtcatgtggagtgctcttggaatataaaaatatggtccctgccccaaggagtttgtatatgctttttggtgcacatacacaaacataagaaaatgggcaagtcaaattatagatgaggatgatagtgattttttttcacatttcatgagattattgaatataatttcataaaaatgagaatacyctttcagataaaagtgtgcaaaatattttatttatgaatgtaaatttttccatccaaagccactgatcaattagttaagtaaaatagaaagcggaagaaatttttgttctgaatgatattaaaatttttctcagtttttgtcttggctctcttaaaagtaaagattataatcagatagtcaagatggtattaatgtgtttgtttctaaaaatgctttgcaggcagttatctttgaagaggatgattaatagtggtagagataacattaaagaaaaactggttctatggattgtacagatggtcttcaaggggtggccgtcctgaccacaggaactctggctgctattttaattaaacttgagggcagaagaaaagaaactgttttttgttttttttttctaagtaagtaagtattgaggttacacaatgtgtttaacctcggggtttgtcaacaattgtagaaaaactgaacagtttacaagaacaagccagtttgcagtttttcagttcagtaaccaaatgactttcctattgtaagtgaaagtgggaaacagcttttcttagcaaatgtagactttgttcttagaggagttagttattgtcttcaaacaattggtattgtaaaatgtgacttaggaacagaaaagaagtgtgtaatcttatggtaattttattgtgatgtgttacattgttttaaaatgttattttatttccttaaacttatttgtttttctttttttaaattataaaagtagtacttgctggttgaaaatattagatgattttcaattccggcatcataatttctgttgggaaagaagaactaaataatacagaagtatgtgaaacaaaaaggagtttctctcttcattccctgatccacccagtggtcatgcttgtgatcaatttgatatgtcactatatagaacattttattctaagtagaggcaaacatactgacatagaaaatcatcatatataacatgcacaagtgttcatcccagccctgtcctatttaagtgcttttatacactttagccacttcaattttactcactctgttacccatgctagagtgcagtggagcgatcctagctctatataacattgaactgctgggcacaagtgatcctcccaccttagctttccaagyagctaaggccacaggcttgtgccactacacctggctgatttttaactattttgtagagatggggtattattatgttgtccgggcttgtcttgcactcctggcctgagccaccgagcccaactttataaatatttttaatgtgaaaagtgtaactttactggaaatatatctcttaataagataaatgagaccatcttttcaaaaaattatttcatgtgtctggggtgaaaattattattactaaaatgaaataagcattaatatcaatagtatttctctttttctttttcataaatgtacatgctgaaaataatgctcacataaataaatgggtggtaatggaagtctgttttatagtcatgcctctccaatctttgaactcctaagttatatgccaaaaaacatcatcagtgctttgtcaccaaaagccattttattaatctgttgatggaagacttaagtaggcttacctttaaattcattaaatctgagaaattggaaacaacctgacttgtaggaggatttatttaccagcattggagtcttttactttctcaatttggggcaagggatcaaaggatcattctctgtatcagttactttttcacatagcagaatcatgtaaaacttagaaaggttcagaatattggtaatttcagtacacttttgctcatgtaattttttttaaggaaagcttttatctgaagtttatgggtattcaatccttggagttgtagttttaattcattcaattcaattcatgggaaatgttatttacatataatctaattggagaactcagccctcaatgtcagacaaactctgatttcatttcttagttcaagtgaacatgttaatatgtactgcaatgatcttcatttcatttctgaaattttgaattgagatagaagaggcacaaggcttggtgatgtgacactctgctgctgtcaaggtgtcttccaactcattcccatttgtcctcctgggactatccctcaggatggatgcatgcattctcaatagcagggataaagaggcaagattatttaatgaaaactgttagctctaccactgcctcactctataacctgtctgcactctgagcgtgtgtatgatgcagggaaaaccaaagcacctttatatgcttatggtgccttggatggaagaaacttattacatccctttgtttggtgccccagaggattctacttcctgagattatgccccttagcaagattctggttggatgagagacttggctttattttttaagggatgagaaggacaccagtttagggtggataagaaaggagcaggagtagccagcagtgccacagacatctcagacttatcagacttgggaaagttgaaaacctaccggaatttcattcacttaaaactctccacgcccatgtttctcttgaaaaatctttatgtatacttctatctctatttgcataacaccattttagaccatttacatggaagtgtttgttggctactatgagaaaaatgccagtgatgagcatttacaaattttactgaatttggacttttaggttctctacatataattacattcaaatgaagttgtagggatatagattggtctatataaatcttcagagaaaggagaggatgcagaatgatggatattgatgatgaagtaagataggaacatatagactgtgttgttttgagttgccgagattccttaaattttacttagttttgtgttttagagcagaagatgtattcatttcaatttctcttaacatctattgcagttcttttgtgaattatgattggaacagattgcaaaatctcccagtgtatcagttttcctaaaataaatcattaaaagcagttcattatctataaatctttcctgggttaaaataaaaatctgctttctaggtcaatcttcattaagctattaatatccttttcatattataagccttttaatttcttttattagcaactgaaagtagctgaaatatgaatgtcattgttttgaatattaattgatgtttgaattatttttagtaattatgctccgacgtcagtgaacttcattccagcccacccagggacaaggaacttctccaatatatttatatttactgaactgtatttatatttgtatatttgtattttacttcttgtgatagatgttcctagtttctatgatttttattgcagtaaaattcaagaattgtcacaagggtgattcattagtggtacattagaaaagcctgatttttgttttgctttattttcaagcaaatcaaaacttcttcagcataaatacatgagaactcaatttcctaagtctagaacagcatttgaatttttagctcatcatagtaattgttcaattttttccagaattactatctaaccattttgtatgcattttattctaaatacaattgacatcaagaaaatacggtgggtgaaaagagccctggagtaagattctgacaggagacttcctctttctgctctgtgacctttttcaagtaaacatgtctctgagtcactttgttaccatttataaaatgaaatggtttagtcatagtgattcttcttaattgttactgagatttataattttaaaagcaatataaaattagagaaaacacaagccacgtaggcatacaaaacgcaaaagatgaaacatctctacaacttcagaccttggccaaaagcattgttcactgctgatggctgaatgatatacccttgcatgagtatgccattatttatttgcctctcgaaggacatttagagcactttgaagttccagttgcactccacatgcagagactcccaaagaacattctactacatattttagaatttacatgtgaaaatgcagaatcaaagtatgtgaacatttaaattttcaccttcgttaccatgaaagctatatcaaaagttgacattgtagattttttttttctttgcaaatctgtatgaaggaaaacaaagtttcttccttcctgagttctcttcctccactcctgtctttgtgaatggccacttcattcaagcctcttcaggtacctttgagattgcacaccatgtttccttctgagtcttcacaactctattgtctcaaagcttgatggtgacaaaaagtgtgttcactaattcatccaagaattttgggggcctggtgttaccctgaaggctaaagtggtaaacaagagcattatgtttcatagttgcttttgtgaagcttaaggtctagtggatcaagaaaaaaatgtccattagataatggcaggaatgcctgtgcttttccaaaatgcgaagggtgaatacagaaggacatgattcagtctgatggtggctggcagtgaccagggtcttcagggaaaagctcactgggaagtgatcttagctccaaaggtgagtaagaactaattatccaaagtaatgggggtaggaagtgggctgggaggaagagctttgaaatcagagacatacaaaggccctgcagcaggaggtagcagagcaagttagagttgttgaagttataaggcccagtggctgagcccagaacacaaggtgaagtttggtcaaaggtaaagccagaacaggggtcagaataaagcttgctctgttgtgcattttttgttacatctgaaatgcaataagaagccaatgaagaatttaagcaaggtggaaataagggaaatggtggtggtggtggtggtgtgtgtgtgtgtgtcttcataagagtaacatgattaagtttgcattatcacaaattgtcatgaaatataaaaagaatgcttagaatttaaaaattagatcttgcttatcttgtatgacttgtaagcagattgtaagcatgtaagcagattgttcatgattcttttggaggaagttctccccagtaatgcggttactttccagcatttagcaaggaaatacaaataacgtcattttccgacagggcagagagtcctagtctaatttagtgtcacaactagcagttctgttatactttaatccttaaatattagaccaaagcagggacaatagaaaatgtgtttacaaaccctcctgattaaggtgactaaaaagcaaaagcgaaacaaaggaggttgaggtaaagagcagtcttacacgtaagcttccagctttgggactgatttacaaaccacaactgaaatgggtattatatatatgctgatgaaagtagctatgtaacatagtttggatctgtgtcgctgcacaaatctcctgttgaactgtaatccccagtattggaggtggggcctggtggaaggtgatgggatcatggaagcggatttctcatgaatggtttagcgccatcctcttagtgctgtcctcacgacagtgattgacttctcaggagatctgcctatttaaaagtgtggcgcctggctctttctcttttgctcctgctcccaccatgcgagacccctcctccccctttgccttctgccatgattgtaaccttcctgaggcctcctcagaagcagacatctgtgttatgctttctgtaccggctgcagagccaattaaacattttctttataaattaccctgtctcaggtatttcttcatagcaatgcaagaacagcccaataccctgtgtcttcattcattaaaaggctactgaactatgcctactactgcattttgcagacttgcttttcctccatttagaactaatgtcttttatttcaagacctaatgtcacctcattcttttttcatgtgataatatcctctgatgtggcctgcgagttgcccataaggaatcgtggagtttgggatgatagttttgggggtgtgtgctattttgccttcttttttcactctcaaatataaaaaggatctaagtgctactcctgaagttatttgcggggactgtttgcactttcttgcttgaggtgtggctgtggagggcaagacagacaaaagtccaaactaaatggaaaatggtgcagttattgctgaaataggtttcccaccatctaattcctttgtgtgctactggctgaaaaagtccttttccttctcagctccacagctactttttcaggacagagtctgatttacatagacaggctgaatgcagaagctgtgtgtttaccatgtgaatttgaggccactgagaagattattttgttgttctgatctcttgaccttctgaaagctcccatcagacctttctcctcccaccttccaccacactataaataaaagccaacccataagcacccactcagatgtatctgcttcttaaatttcggaatcgatttgttaatctcaaaaggccgtaaaaacctgaaaacttaagtagctaacagagaaaaaaaaaagttcaaacagattcttggaaggctttgaagctaggatgcttggggagcatctttgtagtctgttgagggattagagacggcaacatcatgtcgcctcgcaagccagaggacagctttgaattgcagccaatcagaagccatagtatgtttttggaaggtggtgggggccagttttttcccttcaaatagctgacatttcgcagcccccgtccctcttggagcacgacagccagagagtatgcaatttgtttggaattctctcacaacagtcctagtttgaggctaaggctaggttgtgaacatttagagtttttgtacgtcttgacaaatttgtgttcatcaggtgctccgtgaccatcagtattgttttggttatacagaccaagtgttctgggctcagatccaaaacttgcacaagtaaatcagcctcagaaggcagccttagagatctttgaaaagtgctgaagtagggctaaatattagacaatctgccataatttaagttttatatgtatgtatatatatttatatatatatttaattcacagcagggagcagtacacacatcgtaagagagaaatctactttatgcagagttaattggatgataccctaatttgatgatacccacatcattcagtaattcagttttgcgctttctttctttttatgcttttcatttaaaaagcctatttatatgatgttgaggagtttgttaaaattagctgatattttaggatccttttgacattttatatgattataggacatggggacatgagttcagaaaaattggaaggctctcacagttgaagaactgccatatttgggagtccttggcaaagttttatgtaaactgtatgttttttacttagggagtctttataattgaaagcacccatcatactttgtgcatggacttctattcacagaatgaatttagcaaagctattgggcaatataaaattttaggataggaaaacatagctcaaatgctatggtcattgtggatctcagactgagtacaaggctgcaatattcactcctgaagctagaaacaaacctcaatctgaaaccatgctggaattctgtaattctcttccacaaagctaaagtagaatgtgttgtgttctgttttggtctccacagtttaaagaggacttctaaaacagaggcagagttcagagatgaatttgagtttaaaaatacgattctaagtaaagatagaaagtgggtatggttgagtagaaatagaaacctgatcgtgactcatggtgtccactcaaccaaaggtagtttcctgggaagtagaagatccttcccctcaaaaaggtcagagaaaaggccccacaaatcctcatatttaaagatatcttataagagtacacaaaaatgatatagcataagagggagaaattcagagtatttctcttgctatagatgaacataaaaatatttgacatctgcggtgcctatatagaaactcaagtacatggagctctaagtctattcattatagagcattcagaaccctgggcaaaccaaaaccaaaatagtggtgtcaacccacttctttgacatgccacaactagtggcagatacctcctattctcccccttaccagggacattctcccaaatgtgtcctcttgtgcgtggctcaccactgaggtgctttgtcactcaccttctctatatgatttcagtctgactgtgagtgggtactgtgatgaagcctttgtccacctctcctaaaccttgttttaaacccactttactgaaggtgacatttccccagttattccttattcacatctcctttgtaaaagcatctgaaaccttcacgcagaagccaaagtgtgttacagttctgagtaaagaccccattaaatatgaagattctagggctagtggatctctaaccctaggtgatctctgcaataagtgcagtgaaaccatggggtcagagcctcaggaaatggtagagttgaaggccaagatctgctgattgataacytcacagagaagaaaactcaagaagaaaccaagggactgaatgaagaagaaagaaaagagatgagatggagtaccccatctctccctgaggatggaaggagggaggacagaggaagagcagcacagaggcttccaggtggagagaaaggtgtagctgttcaataatctgatgaaagtgataggaaggaatttgtgagactgtgatatcaatgaccttggacttcttaccaaagtatgaaatgcagtgtgatttttccagtaggatgatgcatagagctgaagatcttgaggaaagttgtaaaggaatggtgctatggtttcagtatgtcctccaaagtttatgtgcattggaaatttaattcccagtgcaacaatggcttttcagaggtgattaggtcatgcatgctctgcccttatgaatgaatcaatgtcattattgcaggagtgggatagttattgcggaagtgggttcctgattaaaaggatgagtctggctcctttactctcttgttcttgctcccagtttcactcttttgcccttccaccttccatcatgggataatgcatcaagcagccccttgccagatgcaggcacttgatcttggacttcccagcctccagaactataagaaacaaaactctgtttattataaattacctagtctgtggtattttattatagcaaccacaacatggactaagacaggtgggctaactattgaactgaatttttggttcacatttattcattcatctatgcaataatattcatgctcttcattatatatccattatatgtgttaggggcatgtgcagtgaacaaggcaaatgtgttccctgttttcattggtggggaatgctcttgcaagtatggtttctaaaagggcagtgttttatcccctgggagagtgttagagatgggagtatctaaaggcgctttggctcttccctgcataatacatatgctcagagttcagataggtcatagagtgaggcagtggtagagctaacagttttcatataacaaacttgcctctttttccccaactagtaagaagcattagtacacagaaaagcgttgattctggagccagactgcctagttcaaatttcagcttccaccgcttaccagctctgtggcttcgggccagtgatttaattcctcagttacctctaatgtacactgggagtaataataatacctacttcacagagctattttgaagattaaataagttagtgtttataaaatgtcttggcacatagtaagcactctatagctattgacaaataaaaataggcccttagacaaaatctagtatgtaaaaggcaacagagagcatgaattagtcggtctcaaggaaggggcaatgctactccctagaaaatatttcagaattttgtgggcattttggttgttccatggattggggaatatggtgggaaagggccagcacattcctgcacaagtttcaaatattctagcagatatttatgcagatgcaaaaaaggcattttaaaatgatctgaactacatataattccaccttatatgtaggtgtgtcagtgttttattgagctgtgaattagaagtttcagagttttattctacactggatttccaggactgtgactgccttctaaattgagggatgatttcctttgttttgttaagaacattaccaagagttactcactatttcagaatgtcactgatacaccaatcctagcatttgaatcccaatgtaatgcacctccatcaatgtgtgacactcattgtggttctccttatttgtacaagcatctcaagacttcactgtgttttctagtgaagctgtaaccaatcactaatatattgagatgcatatgctgttagaataacttgctttccttttacatcttcatatttaaatgagagtattatattgtcttttaagaaatcrtatcagtggctagacagattgcatgatgaatacattttattttcttatacgtatttgttagtggcaatgttgggactgctgtgggtgagaacttctgctacaagcaaaggccctggggcaggtttcagttagagttatagagcctggatagttgttagaaggtgggatgctctctataagggaactactgctctccataaggaaagcatttgttaaatgggcaggaactgtaacctgagggatttagcattgtcttagcttgccaagctctagtttgttgatgtaagatactgacagttctctttaaatctttgtaaacaaggtagaagctcatgtctttctgatagagagtagtcactacacctaaaccaacagctcggatttatgtccaaatctatttacatactcacacaattctagagttaagttcgcttgctcacacaaatgtgttatttgacccatttctcccacaaataaaagttacattattagagggatacataagaatttgaattgttatatgttaaaaacttatttcttcacattgatgcatttgatatattattatttataagtagtacatgtggcccatttaaacaaygtgagggtttcataagtgattttttctttgggttgcaaactattgacaggtggggagtcaaatttgaatatctttgtgctcttgttaactaaaacaatgcctggcatacaataagaatgcaatacatctttgataaatgaatgagcccttatttgtggggtggtggatttgggaatgtaaatggagttaaagttatacattctagattctacttcctgatctgtcacttaactgagttttgaagtttgagaaatgacttaaaatcttggtatcatcatccaaaaactgcgattggtatcacatgcccaggttatgtataacatttttaagatcaaaagagagaagacagataaaaacatttgaaatccacaaagtgctaatcaaatacaggtgtactaaattccacaaaaacaacagaatcagattagggcttattcagagagaaatgatgcattcactaggggtttagttggttgaatagtgttccctgcaaattcacatccacccagaacctcagaatgttaccttatttagaaatatattttttgaagataaaattagttaagatgaggttatattggatcagagtggacccaaaatcctatgtggcatcctgataagaagaggagatgatacatggggagtcacagagaagaaggccatataatggcggaggccgagattggggtgatacagctgcaagccagggaatgccaaggactgccaggagccacagaagctaggaagaggcaaggaaggattcttcgctggagcctagagaaggaacatggccctgctgacaacttgagcttggacttccagcttccagaactgtgagagaataaatgtctgttgttcaaagtcacccagtttgtgacagtttgttatgggggccctaggaaactaatacaagtgttcattattttttcctcttctgaagaaagggacaggatcagaggtgaaataatgcttctggaaatttgcctcgtgtcctggcatcagtacaattggccagacctttatggaaatagaagcagttagcctaaggtttaaaagtactggctttgggacacagatgagattatggtttcatcactggcaacactctgggaagttggaaatcttccacttcccacctgtaaactccaagtgatgatagccatatccagtccattagttgacttgaaggttaaatgaaatattatatgcagcttgaatatatgcatacatatatcttctcaatgttaatgattattactatagactagataacttgaggcaaccatagttcaatttcagatagctctagtttataagactgtgagccaagaacttaaaaaaagaaaggtgacggttttcattttgattcaggactcgatcacctctttgtcagagcatctgaattagcctttgtcatcatgatgatgataaccaaaactggtcaattaacttcacttggctgatttgcattctaattgcaattttttttatatatcttttaagtaactgcaacttttgggcactgtttaataaaaccaagaaattgaaagtgaggagcttgaaaaagtccttgaaccttacaatttctttacagattctatatgtttcacaataaaggcaaggttttaaatctcagttatcatgagaaggctccaggctggctctttgccagtgtgtttaattgagagatgaacacgtcagattcatctctcacacactatcactatcactgtcctctctgagctcaggctgggctcttctgtcccccatcaataaataattcttccttaggtttaaaatctcaaatagcaacctaagtgcattaacaaaatatgtattatataagaaacattcagagaagagaagttcaaggtcaaagctaaaatttacacagagtttcaatatttaaatgggtctgaaaactccatattccatagccctgtacatttacctatactcctcaaacatctctttgcataattacttatgctgaattgaagcaaaaacatcaaaatgtctggaaatttaggtttcactttccattatttttccaagaacttttagtaaatgttttcaaaacagctttaatactatatctcatcatatagaaatcatgcaatcatagaggctcatttacatgcttcttggttccatagtggttgtatgctaattacacctacatactttctgaacctgacaagacagtgtttataatttggcttcaaatgctaatatatattttaaagaaattcagatggaaaatcatctttaaaaacaccttattcacatatttaccacgatcagtgcttgttattaatttctgaagttctgagtttcacttctcttcagcctagcttcctttagcatttgccattgtacagatctgctggagaaaagttctctttattttattctgtttaaaaatgtctctacttttccttcatttctaaatgatattgttttctagatatagaattctggggtaacgtagttgtttcaatacgtttatgatatttgtcaacttattgtgcctgttgttattaatcactcaaattcatagttcatgtctaagtaatattttgtattactctagtggctttcaaaattttctctttacttttggttttcagcacttatactatgatgaatctaaacatgaatttctttgtatttattctacttggtttttgctgagtttcttcagtctgtaaattcatgtctttcaccaaatttggcaaaattttgttcatttcttcaaatatcttgtcccactctctgtcttctcttcttttgggactccaattacatgccgttagacttttttatgttgccctattttacattatttttaataattttgttcaatatttgtcttcaatattgtaatcagatgcaaataaactggctttctcaaccttrattacatcagccttctctgtgaaataaattcaatcctttattacacagtttttttttacaacagctattcaacaaatgtgtatgtcatcctttctgtaaatgtgtcatggtaatagtatttgattagctaaattatcatttcactcatgagtgattacctatgtccataggtctactgcctgtcctaaattgaacagttttgtccacttaaaacaagcaaacttccactgataggtaaatgttccaactttactgtagcttgcagcagtgcctctgttaagtggaattctatttctgccacagcatcaataagctttcctgtgtatgtcccatataaggacctggttgcatttctattatggaagccatagttgccctgctaaggagtcttgccctttcagggaatttgtgcttcagataaactgccaaaacccaggccttctttgaacatttatattgtctcacagctctatttagaacagtctgtaagatcactctgtcctgagtaagacttgaagactcatttttaccatcacattggataataccctgcaagccagccctttggaggaatcaaaattgaacaatcaagcctgaggacttgatagagtctcaactttgactttttagttttttttytctctctcaatctttttctttcttaraaaatagaaaaatgactgcttactactgattgtaatgtgtctcaacttttgaaattcagccttaaacttgttttactgtgcacatttgcttttgttgaattaagtccaggtctcttcatttcccagggcaaaaaatcttggttaaattccatgggaaaggattgtgttttgggtatgtaaacatctatccaaatacttgtagaattcaaaaagagcatacattcttaagagtgactcagttcaaacacatgcgtgcagattaaacgtcttctttaaggaagcatatagttaatagttttaaaaatgaatttccccaacctgattcaaagaactctcattcttccagaataaaatatatcttaacttcaagtgggataattggcctcacccctacagtgcttgcttggcgtctagcaattatgcactagaaagcacaaaagggatagaattaataggtaaattttagtgagatttggcatgtgtgaggttaagggaatttttcaaagttgcttataaagttgcatacagtttcaaattgttttcattttgagttattttggttaaaaacagaaaccacattttaaacaagcagtctgcttaatgtaaaataaacatgtaacttaatttgcacatttgttgggtgcttgttttggaaatcattgtggtaaaatggaaataatcacagaggcttctgagccaggtagatgtggatttgagtcctggcttactaattctgtggcatcgggtaagtttctgagctcttcttagccaccatttctttttctataaattaaaaatgatcgtatctatctttaagggtggattagagggttaacagttcagcacccacagggtttttaataagtactttgaattttgagaatagacaagacctaaacattaaakattttgcttttgactaataacgtctagattattagtctaataacttcaggctgttcatagtgatcttgctgggttgaggcaattgagactacattttgaaatcttttgttttgtgaagtatacaccacacataaaatgcataaaccataaatgttaatgaatttaatagtaatagacacctatgtaatcatcacgcagcatatcagctttaaaaaaaatttttaaagaactttttgatggtattatagcaaagatacagaaaagtgaacaaatcataaagtttataattcaaaataattttcacaaactgaacaacctcataaccattgcctgatcaagaaataagacatttctggcaccatccccccgcccaccacgccacccctagaatctccgtgtgttctttctattcactatccatcctcaccaaggtagaatattctgacttcctctcattagatgagtttcgtctggttttgaacttcatatacacggaatcacagtgtgtactcatttatatcatggcttcttcagctcattatgcttgtggtattcattttttaaccactcattatggaaaatttcaaatgtacacaaaatatgagaaagtatagtgaaccctaatgtgtccatcacttctttaaaaccatccttaactcataaatactttgatctaaacaccgtcttaattctctgctgtccccaaggcaatggattattttccccaaacatcctatcatttcatccatgaatattttagtaagtatctcagcaagaaaaggattctttttgtcacatctacgaacttaacagtaattacatgttttcaatatcctatcttggatcagcatttctccattgtgtcataagggtttttttgttttgttttgtttcttctgttttgtttttttctgcagttggattttttacaatagggtctgaatgaagtgtgaagataccttattttaaatgcctaattgtaaattgggggagagtcccatttatataaactgagtctttgagttctttatggctcatgtgaagaaacaaacatcttgcatattttccaattaaatatgttgaggcttatagtattttagaatattagaattcgagataatcttatagtttcttgatatcttgtgtcttggcatacttggaatcccctctgtgttttgaaagtgaacttttagcttcaccgactttttcacctttggtattatagagtctactttctgctatttttgctctcttgatttacctgccaagtggcaggcacaatgggcaattttagctcagctcatctgaagaaattcatcactgagacctacaaaaattccttgaaaggaacagagaaagccaaggttgttctcactttcagttctcacttttgccagttggatgggacagtgactttaaggatataacaatacagctgacacgattaggtgtttgtttaaatgatttttcatttcaagtttatctttgtttaagctgaccacagcaaatatttgatgttaccagttaaatatcttgcagtcttttcacgtttaaaactttttcagccttaagtttctgccttcttatttgtaacctgtacaagggttttcctctctgtctcttccatcacgggatggtgtctaggcacatggtaagggccatcttgttcttgcagttgtcactggttggttgagggctcttatattgtttaatgtcaagccaggtcttctgtggttattgaaaattaagtgtcttttgcaggtcattctcacacccctgttgatgatcttcactgttgcttcgagccataagcttacctttcactgtgaactctggccccaaccccagacctacttctgtccactaatcctacagcttcccttggtacttgtgcactccctgctgctttctctccactagctgtagtgtgttggaccctgtgaggtcacctttkcctggtcacctccctcacgtttgccatttgactgtgcccaggtcatactgagcacactgccaggaggaaggttgagcttggaggacatgaatgaggagaagctgggggcctatagcaatgattttagaatcattgattcaaagttggatgctttcctcatatcttctgcatttccctgaagaagtttccaggacctctctatctcctttatattataacctcctacttccttctccatggcttgtttcagtcttccagaattgacgcaatgacttcctttaaattaacaggtaatgtgaaatagtctagttgccaaattaaagagaaatgaaaaggagcaagtaaaactaatttttttttttttttgagacgaaatctcactctgtctccctggctggagtgcagtggcgcaatctcggctcactgcaacctccaccctctgagttccagtgattctcctgcatcagcctcccgagtagctgagattacaggcacctgccactgcgtctggctaattttttgtatttttagtagagacagaggttcaccatcttggccaggctggtcttgaactcctgacctcatgatccaccctccttggcctcccaaagtgctgggattacaggcatgagccaccgcgcccggccaagtaaaaccaatttttaaaatatttttatttagcctaaaacatctgaaatgttatcatttcaacatgtaatcaatataaaaatttattgagatattttacattctccttgtcttctttttttgggaaggaatgggtacagagtctggatcccagagtgtgtatttttccctcacaatacaccttagtttggaccagccacattgcaggactagaggctaccatattggacagaatgagtctaggtcatgaatgaggaagcttctagataattttaagagaaaagcaaaaacaataaataaactcttaggatggtgcggctttgcctgtctacattagcatttcattaactccaggtgcttgtttcccactgccacttggtatgtaaaatttgtcttccactcaaccaggcagatttttgatcacagaaattaagcctctggtttcctctcaatccacccaaacacatagcatactgctgacctcacagcaggtactccagccaaccaatccctgaattaaaaactgattacaggcagctgctcgatgccttgccacttccmctctcagtgagtccattttatttgtctgacagcaaagctccaattctgtcttcacccctaccaacccacacttttacaaattgctttttagcttaatgttgaaacagccacgctttaaaaatatcatttcattatgtacaggttggcaatcaagaaagaaaaattcccataggactcaaatgaaacaaatctaaaaatttaggactgaagctcgggaatggtcaatctgattttaatgctctcaagagtccacataaaatatatgggcttagcaaactttctgggaaaacccactcaaagagatgacttattgatgcatggatgaagcaagagtgactcccagattttatccaaaaatatatctaatgatatatgaaaatgatcattctagttaaatatattctaatgatttgaacatatctaaataagttggttctatccctcataaaatctaatgacaaacttcggagacttaaaaagtgtgaaaaataaaagtcgaattctggagggtaaggcaggagaattgcttgaacctgggtgggggaggttgcagtgagctgagattgtgccattgcactccagccctggcgacagaagtgagactctgtctcaaaataaataaataaataagataagataaaataaaataataaaataaagatgaataacaatcggcccatacaatttttaccccagcaagaggatgtttggttaaatggccagcactgattattcatacaagtacccacctccccactatctcatacacccactcagtcaccaacctttatagagcacatctttttaattcccctcaaagctgcactttcctctctgttccttgccatccacctatycgtctggattgctggaatggcctcctgacaagtctccttgccttctctgtgcatccccacccccgcatttgtcctccaggtcagtgtttcaaactctggtttctgttttgtttcgtttctgagactgggtccttcacccaggctggmgtgcagtggcatgatcatgatcacagctcactgcagccttgacctccctggcttaagtgattctctcacctcagcctcccacagaatactggaattacagatgtgcaccaccacgccccactaatttttttttgtatttatttatttatytattwgtagagacaaggttcatgttgctcaggctgaactctccacttgtttttcagtttttaattttttaattggcatataataattgtacatatttatgaggtacatagtgagttttgatacatgtctagtgatcaaatcagggtaattagcatatctatcacctcagaagctcacmatttgttttgttgggaacattcaaaatcctgtcttatatatattkgaaaatatatacaatttttgactgcagtcatcctacattgctrtcgaacactagaactcattcctttcatctagctgtaattttgtgtcctttaacaaatccccccatgcaccctccccgctactcttctcaccctctagtagcyactgttctattctacttctaagagatcaatgtttgtagcttccgtatrtgaatgagcacaagcagtatttatctttctattcctggagaagagcaggctttttcctgaatacattgctgtccaatattactataaaacataatacacatgaattattagaacaattaaatgagaaaaacccaggcatgcaaaatattaaaaaatatttaaaacattattttaaaaatttaaataattattaatttaaatagactaaaattgctctctcaacttgctctgtaagttcccatatttactctcagtttctgtacttatcttcctgtgagattttaaaacagcttggttcataattcaggtagcactgatatagatccacagtccaatactatagccagtactcacatgcagatgtttaaagttaaatttcaattagtttaacttaaattcattaaaaatgcaattcctccattgcattagccacatttcaggtattcagtagccatgtatggctagtgataactatattggacatcacagatatggaacatttccatcatcgcagaaagttttattgaacagtactgctgtagacccttgctacttacagagtggtccatgagccagcagttcttacttcacatgagagcttgctagaaatgaagaatctgagctgggtgcagtggttcatacctgtaatcccagtactttgggaggccaaggcgggggtgggtcgcttgagcccaggagtttgagaccagcctgggcaacatggtgagagcccatctcataaaataaaataaaataaataaaataaaataaaataaattaaaaataaaataaaaaaaataatttagccagatatggggacacacacttgtagtcccagctacctgggaggctgaggtgggagtatcacttgagcccaggaattcaagcctgcagtgagccatgatcacatcaccacacttcagcctcggcaacagagttgcgacttggcagcaaaaaaaaaaaaaaaaaaaaaaaaaaaaagaaatctgaaaaacagaaaacaaagtaggcctaaacctcttgaaacagaatgtgcaattcaataagtttcttaggtgactcctatgtactttaaaagtagaagccctactctgggatgtttctaggacaatctaaagtccaaatctgatcagactatcctactaatccttttaaattgatacataatatgtgtacatatttgggatacatgtggttatgggatacacctgatcttttggtacatgcttagaatgtgtaataatcaaatcagggtatttaggatagccataaccttcaacatttatcattttttgtgtgtgtgttggaaacatttcaaatctctcctagctattttgaaataaacaatatatacaatgtatcattgttaggtatagtcatcctactgtgctgtccaacattagaatttattccttttatctaactgtatatttgtacccaccactaatctttccatagcttgcaagaccagctctatctaaagtggtaggtattagccacatgtgtttatttcaatttcagctaattaaacttaatttacattaagtttaatgtcaattaaacttaaagtttaaaaatcatttaaagttcaaaaattattttcccagcccgccagtcacatttcaagtactcatttgtcgcatgtggctggtagctactgagttggacagtgtagatacagaacattttcttaactgcaagaagtttgattgcacattgctgatttagactctagtttaacatccagagatctcatcatctagcagaactaccccctgcctacctctcaagcccccaaaccatggtgcaccaggttggcccttgtctctaacacaatgagttacgtaatttagttcctatgcaccatcaccctcattgttcctttaccttgaccactatttttccattcccttctttccattcacctctccataatcttcaactaatctctgtgtcaaaatttacctcatggtcagctgctccagaaagcttttctagaaaccatcccatgctgcaaccctgccacaatttagattgtcccctttcatttcttaggtagaagcctatgtatgcatgtatcacatgcttttgctgttgacttattctctccatttagatcagcatttctcagcctcagcactattgacatttggggccagataagataactctttcttgggaaagtagacagctgtcttgtgagctgtaaaatgtttagtctcattcctaacctctactcactggatgtcagtaacctccccagttgtgaccatcagaaatatatctgcacattgtcaaatgttccctggggagcaaaatcaccaatgcataagaaccactaccttagacctatctgttttctaaggagagcctcttgaggtctgtgagacacttcaaaccacagcatggtacataggtcctgcacacaattggcactatgttggtatacatgctgaatgaatgattgattaggaaatctgttgtcagcaggtgtttcttctttccttgcatcctttgtttcttctttcttttattctgcttctttgcacgcattcccaagtctaagcaacacattcccaagtctaattctatttcatgagtgaacccattgaccaaacaggagagccctgcagggcagtcattgatcataggtgtctcccgtggccagttggtttggttggctgatccacagtagagggatagacaaaattatcaacctcttaaaatgaagactgggactgggaatgaatcagatgtaacagcctccctgtgatgctcagttttattagctattttatatatactgtatatatgtatgtaaaatagctctatcttatgtaactattttatatagcttttagctatgggtcagagtcgccaatctatcatcttttcagccagctgtcaacacatggtttcagaatttggaagaaacctaaaagattatgcattccagcagggcttggtggtgtgcgtctgtagtccctgctattcaggaggccagggtaggaaaattgcttgagcccaggagttcaaggctgtagtgcaccatcatggtgcccgtgaaaagctacagcactccagcctgtccaacatagcaagagcgcatctctttaaaaaagagagagagagagagagagagaraaaagatcatgctttcagattcctcatttttttctacatctggacactttccttaggtcctactccagccatcattagcatcttaagataaagatagaattttgaagttccatcatttataaccaatcaaatgcaaaattataagacagtgatattcttgatttgaaagctstaaactctgatgtctgctgctctgctcttcactagtaagttccctggcactagagcaatgttataggatggtgacctagtttagctctaccgtatttctcgagccaagtagagaagaactggaagttctctgccatccaggcctgcaacagctttggagtctctcatttgctttgctcttcttctatctggaatcctttcagaagcctgatcccccacttcgtgcattctgaaagtctgggccttatagtatttgtgcttcttgctgggcaccatttctgcccagtgttacctgatatgtctttacacacctagctctaattgtcctaatattggcattctcttgttttggactggaggaaagatggttaagtcctctctcctttcttggtttagcacttcttgcaatgtttttctagatttgacctacctttaatctctgcaggcatggtccaatacccttctagcagctggcgctggcattgcaatgtgaatctgccactatgctatgggctgggctctaagtggaaatatgtatacattttttcactgcaaagaatcagctccctctctcactccaggagatggttgcctcagccctgtcacactcttggtcctaggcagctttcagcttcctctgtaactcaaccatatggccagttagatggattgagagcatgaccaccaaatcacctgggatcctacttatcacaaaaccgtgaagctttgttacagtcatttattcaatcccatcaaatatttatcaaatacctgctctgggatagctccagtggatacagtaagatgtcatattcatcaagctgctggtcatctaatgggaataataatgaagcaaaaacatgattattgtacagtgagaaatggatatacaaagggatatggaacacagataagggggaaatcagagaaagacaataagaatgaatcctttttagtaacagtgtactgtgtgccaggcaaggtgcttgtaatttctatatagtttacatttctatttaaagtctcataaccacttggtgaggcagacaggcattcgaaaatagcggaaaccctctttagaaattgataacttggttaagttgattatttttttctttcctttaccttttcttgaaatataaaatgcagttaaaaaggtacactcttctaaatagtatagctcagtgagtttttacaagatgagcacatccctgtaaccagcagtctgataaccacattaagaaacaggacatttcctgcatcccagaggtcctcacatccccctaactgcaccctcctcccaccaccctgctcccttcctgaattctgctgcctctctacccaaggctaatcttctggctttaacagcatagataagctgtgcctgttttattcttacgtcaatgaaacaaactcatctactctttttgtgtgtccacattttttcactcaacgtggtgtttgtaaaattcatcccacattgttgcatgcgattgtaatcctcattgctgtataatattccattgtgtggatgttccatttattcattctactgttatgggcagttggatagtttcatttttggatcatagttcatagcattgctatgggtattctagtgttcatattttcttgcacacatgtaaaaatttctgcttggtgtgtgtcttagagtgaaactgctgagttataggcatttgtgggattgaaggtggaatgggaaagagacgtatgcaatcagctcacgagctggtgacactgctggtaaaagggagtgcctatacctagctttaatagatattgccaaatggttttccaaaatggtttaaaagtgttgagttttgaggagcatgcaggagttaaccagaaggttaaagtaataataataataacaacaacaataataaaagggagcagggtggagttacagaaatagtgttacagaaatatgcagtgtatgattgtcaaatttggttgttactggttagctgggtgcatgaatttgcaatcctgtcatgtgttcattttgcttattcttccctgaaatttccagccactaatggaatgtaacactttaccctttttgaacttcttccttctcaatgcagtaccacattaaaggtcaactgtgaaatttccacgtcctattaaatactattcctagagctggatataatatttcagaatgctacccctgttccaagacatacgcatactttagtgaacatgaaattctgtgtttgaatatccagatttctttttttgcctctattgtctttgctttgactttgtggatttggcaatggttgataaattgttttagagtagaagatcactagattagaaacagtatttaactaaaaatagacctcttggctgattatcagtgtctcaagagacagtgtgagtgaatttctgtttctttttgccatgatgctaactgtcacccggaatataatgcttactggcttaaccccttttgttttttatattatgtttagaatgtgtatgtctccttgtaagaatccaatttgaggggttcagaaacacatagtgaatatgcctgatgagtagtgatttttcaataatgatttttacatgttatgtctcctcaaagataacaacagagcaccatgttgcctaaattcatgtaacttccttctgggttaaactgtttattggacatttctgaatatatgcaccatatgtggctatctttcaaagtatgtgtctgagatattattcagagccttttccagccatttagagatatatgtggagcttagagagaataaaaatataatgtgcattatttactagtaattcacataaaatattccatttctaaagcatgttgcagaattattctactggtaaattaagattgaagttgtccttagataatagctagcagtataataaaaataccacataatagaaattgattctgaaatgtaagaatgttttattattggaaaatatatccatataattattacttctacagataaaaagaggaaagccacatgatcatactgataaggcaacaaaaagatgtgacaaaattctaataattttaaaaatctcttacaaattagaaatagtaagatgctatcacaaaccaacaacatcatacatgatagtaacattcttgagcatgtctctaaattgggagagagccaaagttattcgtgcacgtccctattattgaacactgcttaataaaatgaattaagcactataaatattagaattgtcattttataacttgcgtatgagatgactgtctaccctgaaaaaacaagatcaactaaaatgttaatcccaaggaagagttcaacacggaaattatttctaaaatacttttataaaatgagaaagttttttatgtccagtaatcaaaagttagtgaagctgacattcaaaacctcaagctcaaatataaaggacctatatttaaaaaaaatcttaaggcgtgtataggattcttgtattaaattgaaactctcaaggcaatccaaagtagttttaaataagtagaagcactatatttctggaaggaataatattttaaagatacatgttctttccaaattaaattactacaaattcagttaaagttaggaaggtgtttttcaaacttggaaaatgactcaagttaatttgaaattttttgaagaaactactaaaaaatgctgagggaattatgccaaccaaaatttcaaatatagtgtaagacaactaatatagcactctattgatatggaaatcaattcatcagtaaaacagaatagaaagttcataaatacactaattactataaaaaataacacaggcacagtgactcacacttgtaatcccagtaatttaggaggctgaggcaagaggatggcttgaggccgggagtttgaaatcagcccagataacatagtgagacccctgtctttacaaaaaattcaaaaaattagctatgggtagtggtgcctgcctgcagttctagctgctcgagaggctaaggcgggaggatcgcttgagcccaggagtttgaggttgcagtaaactataatctcacaactgcactccagcttgggtaacagaacaagaccccatctcaaaatattaattaattaattaatataaaataaaggtactaaatcaattgggtaacacaggattattcaatgagaggcagaaactacaaaaggagagtaaagacaaacttgatagcaccattatttaaaaatacttctacacaaaacaattcacaaatgccaagtccgaaccaaacaaactggaatatttttgcaaaatagatgacattttagaaactttaaatccttattctgtactagcctttataaattaaagaataatagaaatatgggtaaacgatatgaatgggaaagtaaagycccccaaagaaagaaagaaatgcaaacayaaatagatatgagaaagttattaatttcagcaataatcaamgaaatacatactataacaataattattttcacccataaaatttcccttattttcaaaactaaaagttccagtggttgacartggggaggttaaataccactccaaggtattttgcagataatttacattggttcagcttttctggtagcctttggcatatttatcacaagcatgaaagtcctcaagccctttaattcaaaaattttatttttaatgtattattctaaggaaattataatgaaagtaggcagacattacaaggaaattgcttgtagtactgatcaatagtataacaaattgaaacataaactgtaagtattcagccaaaggaataaattaaataatcataatatatgtcaatagtggaatcgtaggcagacattaagaaagctgttaccaaattaaataatatataaatatgttcatgctctagtgtcaagggaaatatgcagattacaaaggaaaatgaacaataagatcttattttttaaaaagaaaaaatgcccagaagtcatatggacatgcacgaaagtaacagtggttttctctgtcttgtgtgattataaatgattttaatttacttacttgtacttgcctcacatttgcaagtgtttttctacagcaagcatatattacttttataacatcatgataaaaatcatatttcattgtattttacaatggacattttgttttctaaaatcagaaagcagaaatgaaataattataactatatcttaattcagagtttaaaggagaaatctccatttactggtttccccattacyacttaattggctaatctagtttttcatttaccctgatgtagacacaaatagaatctgcaatataatcaggcaccaaccatgggattaattagctaactaattacgtaaatgggatcccagttttaacagtcatacctctgcaaaaattgtctttttctttgcaaaaacaatgaagtgtcaacttttaaaaaattaatcctgccaacttcttataaaaagattgtgtaatgtcttggggaaagatttaagatatacaagttaaagatggcctttgaaagacagacagatttgaatttaatatttgactcttttctaagaatttaaaattattctcaaagacgaaaatgaatggtctgaaactcaacgaaatcttttccatgtgagttatgcactcatggtgtccctgtaggagttagagaggtgaataaattgaacgagtaatgatttgtactcttaaacttcctggaaggagaagtggcttggagggtgttggtgggaatagccaaggtatgactgtgatttcaggtaagataatttgaggagctgacaatttacctgcgtggaagtatccagcaggcatttgggaatatgtaattggctcctgaatcagacatgtcagtgaggtgatactcatataggagtcagttacctaaaagtgacagctaaaccttatgaaggcaatgaattccaggttagtgcagagcctctgcacagttccaaacccaggggatgctcttctcattctcttatctgaagttaagctccagggcttatcattcacataaactacattatgaacaatgctgtttccatctctctatcatgccagatgtcatatactagatgaggtctctcagaagagctagacagaagtataaggactcacctttatatatacaaagtgaggaacaagacaatatgtacaaggactcatattaacatatgcaggatgaaaggggaaaaagaggtcagttaattggttttaaaaaaaagatgaaataagacaggctcaaggaaaacggaaagggggcaaaattgcgggaagtgtttggcctgtggtttcaaatgttatagacagacctgaggcaatgataactgagacaagccactgggcctaaaagtatatagaaatgggtaatcttagrgatggtggagtccattgagtaaatgggtggckggggggaagacatcagaccccgagaagcagaagctaaggcctggggaggaatggaagactatggacttaasagtgtagcatcattggtcgaaagacttttatttatatttagggagactagagcatgtctttaggtagagcaaaaggaagcaggagagaggggaacactgaaatacaggaaaaagaggggatagttgagtaaacagaaagaaccctaagtgaaagcaggaggagattggagcagtataccaggaccgggatgagccctggaaaagagaaggagcacctatttctcagagctaggatgagactgaggtggacagggaactaacgccttccagaacagaaatatgtggtccgatgagtattgaatgcaacttaaaatctagttggaatgtgatggataagaagagacccaaagtcatcaacaagccttctcatgaactttcagtcattaaccttcctatatagtaaggacagaaatgatgatttaagccatcttaggcaaggcagtgctaacaatatgcttttgtaaagtcaccatccggtgtaaggmataggcaccagcttagtgatgtttgcaaataagccagtggtgggtgtggataaattagagagagtaccaaatgcagtttgaaaagtgttaagttttgtctctagtaaattgcatgtagttttaccaaatagtgcttcagtgttctctttgtgtttcctctttctggtacttaaaaaaaaaaaaaagtaaagtcagttcatgtagctgtgagataaatcttgagaaaaagagtattgaatagggtactgagtttattggttaacacttaggaaagataygatgcttgataggagatcctttttattaaacacaaagaatagcattttattctatgccttagaattttgtgatagaattggcaacaattcagttcacaaagagccttagcactgtggccactaatgcactgtaaaatgggtttttgttgatgttgatttggaggctgtgttaaatatcttgcccacagctctaaggttttgggtacaaatctataaaactatttcacatttatgctacttccttttaagacgataggtaattcccaatgatttgcttataaatcagttatggtttacaaagcagaccaagagacattcagatttctgaaaacaaattatccatagttttctattaaacatagaactgggaaaagacttagtgattacttagactatgcctctgatttttaaaacgaattgtaattacaaccataatctatgattttttttcatgaaaaaaaacaaaagctgtgtgaatgaggtcagtaacttcctcaacacctctcagtctcccaaacaacaacacaggttaaccgttatcagtttgctgtgaaaccttccaaaattttcatgatattgacacacacacacacacacacgcacacacacacacatttgcttaatatgcagtatttaatgtatgttcaatacatagcatttttttgcattttgctttttatacttagtgatgtatcttagagatttttgcatatcagtatgcctagagctacttcactatttttatttgatgcamaatatttcatcacatggatgcgccatcatttttttcactttctccttaaatggatatttggcttgttttaattttttttctgttaccaatgatgctggaatgcacacacctccttgtgcataagtattggccttctttgggatacatagggaagcgtaaatgcattttacattttaagtggcattgccaacttatccttcaagatgatagtatagcagccttttaattttagaaattaagaaggttaagaaggtaaggcacagagattttatagcttgccaratagcataacaatttaggaactagaaatcaaatatcctatttcctttatagatttctagtgtctacatcaaattttttccaaatttataaaagaagaaaataatgtatattaaactagccccatgaaattttgcttcatacttttcctattctttaccagcaaagcaaaaccagttctgattggtcatttaaatcaatgagttgaatacaaacagaagtataattgccaaattatgggttttgggaaactatgatgaacacgagattctttacttgtctgttktaggttatttttccaggttatgtgatcctgtgatcacatatctgccaacattttcatgttttgggtatttcctaatgtaattgaatttctcctggtttagaaatttatcaacagaatcatctttatttcttcccttgatgtattcccaaatgtaagaaaaatatgcatagtgagttgataaaaagaatgcaagtaatctacttgaaaaattaagcctctactttccaggaaagataattttaatggggtttgggttcattctctatgagtccttctctatcctaatgtcatgttgggtcacaattgtctgatgatcctggctaagcatttggttaacctcattttgggtcctctttctctcttcacatggaggagcacagcacttgaackctctcgtgtttgaggacaactgggctgacatcgagtgaatttttggaaaactattatgtctttgtagtcacttaatgtcagcttgatgttgaagcaaagttctgtaggagtaaaaaaaatacaagaagtgcaatgaaatattaattaggcaccgagtagaggcaaggagctgggctaggcatttttatgtatgttatctaatctatgctcacaagacttacaacccatgttgtaagtcttgttttgtttgatttccgtatcaggaaatggaggctgagaaagagaataacacatcaactagtatacacagaggttctctagctttccctacttctttctaccacccttcctcccacctcagtagaaatcagtgaacactggagcaaagaagtcctcttggaagaagcagagttggagctaagtcccaaaaggtggctgagatttagatgattgaaggaggagggttccacatttaaagagggagagtagtctgtgtaaaggcacagatgaagacaggcatggtacacacatgctttcactgggttaatgtacaagaacagagctctgttcaactggctttgggaagtataattttggaggataaagggcattggcaagaaactcattggggtctcatgataaacagccagatattaggagtcaggagctagaaggactccctgtgtctctccagagaacttagtgtctcttctttctcccttgaccttcctgctacatgtttctgttgttgttgtttttattttttttctctctgcagaatggcttatttgctctacccagcgtgtggtcacatcagctgcagcaaagattccagctactagcatcactaggcctcagtgccagattccacgggccagatgtctatccctggtccactcagctatgatgaggataatgctttcagattcttgtttacctcagcctgggagcaggttcttttatatcatggcacaagcagctcctctaagaaggcaatgattagtatttgaaccacaaggaacaggagaagtgaggggtcaatgtggtcagacttactaaggagtacttaaaggccactgcaaaacyaggcacytgatcctctaattgagaggggaagtttgcaagggaaaggtgtttgatatatggcaagttgaaagggtggagaggctgagcgccagaggtgagctgaaaggtaatggtaacaatagaggcctagggatacattagtcgacttagagagaaaagagaggaatggcaattgctgaggatgcaagaagttaccttgaaagaaggaaaagcaggatttattgactggttataaaggcagcttttagctccagggatagggacaaggttgtgtggctttgggacataaagaaaggagaaggaggaggaacctgaatgtcaggagagacataatgcttctggtttggaaatgtcatctctggttcaattgtgctatgggaataatggccataaggctacaaatggggtgtgcagagtgaattggataagatatgaagctatgttaattggaagttaatgagatgagaagtggggaattttggagaaaaacaggaagtcagtggccagtagcctcaaatctaaatttgcatcgttacgggcatgctatctgtgggtttgtgataggatttcactcagcttccaggtggctaggtcatattatcaggtggtgaaacagttaaaaaatatcacgacctaagataaagttttggtgtttgctggagcacagtaataacagatgagttctgttcggtagggaaaactctagaagcaagcccagcacttctgtggataagactgattctggaacctactttaaagcttgtgctaggcaaatggccgatgattcccaatgcttgccttagactacaaatgcaaagaggaaaaggttaattttctaacacaaatctaaatatttccttcttgtactaataggacctagccattctgtaatgcaggcaacataggtctgaaagaatggttgtattttggccaaaccatgaacttctttttgagaccctgccagttcctggtggaagccaggaaatatatttttaggcgtctataactccggctaagggagctatgtacctcctaatggttgtcatccaatggatataaatagaacctttaaagagacaagccatatgctttgtggtgcttactttatttaactccagatctgatttacaagcactttaattcctaaaaaccactctattttgttcattaagaatatgcaatgcacataggaatgctttgtaacttggctatggaatcagagatcaagaatattttcctccccaaaacttgtgataaggtcaaatgctaaaggcctatagtaattgtttttagctgttctcttagaattgaaaacaaatgttttctaataccaccaaagtggtgtgctgttagtaatgaatctgtatggcataatttcagtttcctcataatttttatgcatgacctcaaaattaaatgtggttctctaattttttaataattgaaagaataggtttttactaattaagatcagatttatactcttttgtatcagagaatgtcatggtgaaaattaatataacaaagtcatactgacatttactttagatcagtgtaaagatatactacatgtccactggaatggcaaaaattgaatgactggcagtaccacatttggcaaagatatagataacgagaactctagtgcattgctggtagcagtgtaaattggctactaccactttggaaaactatttattaatgtttgtctgtgccctacatatatctactgtatcagtctaagataaatgatcatatgtgtccactagaagatggttacaagaataatcatacagtcgtatttgtaatagccccaaactgtgaacaataaattatttatcaacaattggatagataaacaaattgtagtatattcacaaaatagaatactgttcagcaataaaaagaatgaactattaatccatgctacaatatggataaaatttcagaaatgtcatgttaagtggaagaaataggacacaaaagagaaatatgattccttgtatatgaaattcaagaaaggcaaaactaattgaagctggtagacatcagaagagtaacccactctcttcctggggagggtttttccaggaaaggggtgcctgataattttggagatggagatgtctaagtggtgctttcatgagtgtgtacatatgcaaacactcatcccactgtgcacgaaggttagatacttccccatgtatatgctataccgcagtaaaagtatgaaatatatgttttatacctcaaaatgtttcacaacacattattttctcctttccaattccacagagaagagagaggctaagtctagtacaaaaggttggttctgggccaaactggagaggagatgatgcaatggaagtatccaggcaaatacaaagggattttaacttgtctgtgtttattgcaaaaaaggaaatttgttatattgtgaaaatagtaaaatagtgtggcttaggagaggttctattttggagggggggatgtatgacaagtaatatttttatattttatatcatatccaattagatacattgaagaagaaaaaatgtgttttaattttaagcagagtttttacttttaaaatgtttatatgtatataaatatatacccactcttgtaaatagagccttatgcatgcttgtggagcattttggtgcagtcttttttgaaaatgttttccctgtttcttctacctcttttactttacctctctattgtcacaacctatgtgtgtcctacttaatatgtaagctcatataataaggcatacttatcacataaatatgtgtgtatgggtgtatatgtgtacacccacacatactaacattcatagataagtacagctttatttgtctttgtgctataaaaatgatattatagtatgcaaacttccctgcattttgcttttattcacccagtaaaacttcatggaaattcctgtaagtcaacttgtatattatggtggcccagtagtccctgctgtagatatagcataatttacttaagcagttctttgtttataggttttggttgggcaaggtcttttgtgtactacagtgagaaagctttggcctcagaaacagcaatcagagtttgtcacttagatggtctgagcccatgtctcctcatccatcaaagggagataaatttatacttggccactcacaatacagagcaattataagaatcaaaaagactatatgtaagagtgtatgcgtttggtatgatggaaagagcattgccattgttaacaatcaaatttgtttgtgtttagtacttgctgtaggtgaggcactgttctaaggtcttttcatgtatttatttaatatttacaataacgaaatgtggtactgtgtagtattattcttttaactctttccaaatgagggaattaagaaaaaattgaaataattttcacaaaatcagcaggagacctcagattcaaatcctggattttccatttgagtgtctgtgatttttatctaccatgcaatattacttctcaaatatgatgttcaccgtaccttttattttgtacatgagcattcattggtaacatgaaatagggtggtttataggagaatgatctcattacattgccaatcataaaaaatactaaaatttaaaacacaaaagacatgcatcagatagctatttttgtgcaaaagccatcccaaaatgtagtgatttgaaattacaactacatatttaggctctgattatgtgatcatctggtmagggcttagcagcagggttcttctgttgcatctgggctcattcaagcatctatgataagctgctgagtcagctaggttgctttgctctgaagattgacttcagctatgaaaataggggcaattgagccataaagcgcttatcctccagcaggccttttcaggcttatgcacatgtaggggtatggtttcaagagagaatgtagaaacatgcaagaattcttgaggcctgttgttagaactgacacagcatggtttccaccacattttctgttaaagcaagtcacaaagtgatctcaggttcaaccacctgatgggaattactaccaggacacatagcagaaggcaaagaaagaggttgaggaataattgcagctatttcattcagtgtaggaagcaaagcaaaataaattttcttactaccttatttaattcatcccatagagcctggacactgattttttattattactatgtaagtatgtgtgtgcatatgtgtttctgctgagaataccttgtacatagtttttatcttttaatttgcaaatggctggttttcttttctcggggaatttttttctgagatgaggatttgcttcctctgaatgactaagctgaactgaatctttccactctttagagctaccctcatgctcttgaagtccttatgtctgcaatgattttaatctctatttctcaggtagccagaagacaggatattatactgtggttttccacagcagcaggtctgtttggctagataatcaaggtatcaaaactaattctttaatacagatggcttacaatacttgtgaattgcattttccaaggagcactgtcatattctcaatattaccacacttcctacacctttagcatcctctctcaatactatcagttcccaaaacctttgccctattgtgccaagaaaagacatttatcagatgagtaaactgaggcataggaaatatctatcagtttcataaagggttcatcacctgagatgcatgggtttcttatttcttggccctcagccatatgaattatccaatttgattttcagatttctctttttttctttatacagcttaaaatgacatattctctaactcattcattcaacatatcatttcttcttgaaggcctagtgacatagaaatgagggtatctttagaaatcattagaaattttaaatggttaaatgaaggagctttagaaaaccatcttaaattaggagcttagtgaatgttgctttattttttaattcacatatagtaaatgaaaacatgaatttaagaattggccaggctaagattcaaattccagtgccaccatttataaataacatgagtgaacttagacaatttaatacagcacacacacacacatacacgcaaacacacacacacacacacacacacacttttgcctaatacctggaacatagtagtaaatgctcaatatttttttactctcaaaagcaagggcagcataggaaatgaccctctcaagtcagatcaggagtggtgactaaatgacaaaggaccacttgtgcagacgtccttgtgtttcttcatcttagctttagggttttctttcaagtgtccagattgcacctatattacccttgggtaagagccaatgagataatccatacagaatgcctagggcagggtctggaaggagtaagtgctgtataaaattatccttcttcttctttcacttcctctctttcttggggctgaccagctgataaactagtcctctgtcctagattgtgttccccagaaacagaccttgaaatgaggattatgtgyaggggatttattagggaagcatctcaggagagactggcagaggagcaggccaaggaagggaaagaagacacatctgggttccatttcaggtgaagttccagcctcttcatgacctcatagagtactctggaacataaatagcacctcagagtatgtcctgcctggaggcaaggtagcttggcttttacattccttcatccatctgtcactggctatgggccctcctgggtgggctatcacctcccaagcacttccagctctccatagtgttagggcagttgcagtagcaaaagagaaatttctgaagaaggctgctacagatactgctgcagcagtatcttctgttgccatccagattaccatttccattctcagccttctgaagaaggctgcagttggaaataaagcatgtaaaagctgggaatgggagcacagaccctgcaaaagggacagaggtggcaactctggtggcagcagcagtatctgctacgtcctcttgggttttataggcaccagcaaaacacatcttttgttaaaatggtggccttctgacgggaagggcaggtctactactgaggtcaaaattcatgtgttatttttgtaagcagctactaaagcagtatcagtccagagaaacgagtctatctttgaagaccaaatacccaaaagatctgcttcaaccttccccagttaatcttttgccagaagattcacaatctgaatgtggctgtgagtatttgattagagtattagtaggtgaaggaaggtggtatgcaagaatcagctttaatattatccccgtagaagggaataattggtgattagttttcaggctatataggactattcctcctaaatgaatggataagctgagagatttacttctaaagaggtatggtcttttcattttaactcgagattttaggaaagaccaacttaaaaagaaagcaaaggaagtttcaggagatttcagaatttagaaggaattctgaaattctcttctggggaaatgaaatcctaagacttgcatggatatttctgaaaatcaaaatgaaatattttggttgcataaatcgtcaactgtagtttttaactaaggaaatgtaatttaaaaaatccaagtgttcgatttacataagaaatagagttatttaaatagaagatttccaaaacgctgttagtggtctttgacgtctttaaaaaggcatttatatttgtgaaaagatgatctattttaaggtgtaattatttctaatgtgcctcattttggggtctcttgagagattagaaattgctaataagcaattttaaatattttcgaggtaagttaataaaacacttcatcggtaattcatgacttgttatcattctcacattatccttgtgtgggtaaaggcctgtccatcattggaagtaattggaaagaaaactttgcctgaagctacatgagaactggaacccttaaatcatgaatggtggcaagattccaaaattaattatgaagactattggaatgatgtagcatcctttaactcttattgtgatcgacagaaagtatcatagatggacaactcactttccctttgctctgtgcttcctggtgattttaggtcacgtccactctgaaatctgagctgtcattaaagccatgtcttcgtgtctgtctgtctgaagcagcaaagatgagacagtctgtcgctgtgtgtgaccccagtgagccccataagcagaaggccctgagtctcaatttgtttcttttgattactggcagatcactcactgtgccatttctctgatgtgactgagcatattagctgtgccctcccctaattattcatgcttccaatgttacccattcaaaatttatgaccatgaggatggtgggttagaagcctgaggaactgaggctcaagcctgttgccagagatttactgtcattgttttaggtgcaaagtattaacaggcaggccaactcacttcaattcctgacttagtacatttagtggagaattagttgagaatgagtacattttccctgacacagctgcaaaatcaaacacacgaggagttattgaaaaactgggatttaagcttaaacctatcatttctatatctgatgggcgccatcccatatctgtgaaaatctgacattggggaagtgaaatgcaggcttaaaagaatgctttcaaggtgcatagcaaaagcaatcttactcctttagtgtttcccatttaatacttttcaatttttagttagttaattaaggagaaaatcacttaataatcacataacatagattgctactataaatacctgtattgtctatgttacaattttcgcatctattttactttattatttgtaatctgttgggttttgtgaccttgtgctccaaatgattttgcatctgtaaggtggttgggagttagatacccttcatcatatcttttgccatctttgagtggcttttttaacctttccttttaaaaaaaaatcccttaatccacagtctaataaagtaggaaaaacaatcaataaagcatacctacaaaagttccattttaaacttttagtgaacttaagtttactcatagtgcatttaatcttcctttctgtctgtcagttagcaaatatttattaagccccaacaatataacagagacattgctggctgccaggtcagggggcaagagccatgatgcatttcatcttactttgaggctgtcggtctacaaatatttattgagctcccaacaatatgccagggactttgctagctgctgtggattcagagatgaaaagacatagttccttttattcacagaatttacaggagtgatacaaacaaaacaacataggagacataagatatgtactctgattgtcttggtctgttcagactgctattacaacaataccttagactggttaatttataaacattaggaatttattgcttacagttctagaagctgggaagtccaagatcaagggcaccagcagagtcagtgtctggtagtggtctgttctcatagatgagtgcttttaaactgtgtctgcacttgtcagaagtgcaaagggacaaacaggctccctcaagtctgttttgtaaggacactaacctcatttgtgaggggatgtcctcatgacttaatcgcctcccaaaggccctacctcttaatacgatcacagtgggagttaagtttcaacataggaatttggggggaacacaaacattcaagcaacaacagtgatgatggttaggccaagaacggtgcagtcctcaaggagaaaagctttatatctgctagggagagtaaggaaagtagccttggagctgaggcttggtgcacagagaggagtttgccaggcggataagagcaggagaggtctttcaaagcaggggaaacaacatggtcaaaagcatgaagacctgccagagcttccagaatctatcagagactttgagttgttggagaatgaagtataaggcaaggagtgactgcagctgaggcatggttggatgagggtcagattacaaagaaactgtatatgctgttcaaagtggttcctatattttcttcctgctggttattagaagggcatgtgccccttttaggaggcatctgctatggttaagataatagaaaagggaattttcctacaactcagattacatagttgcgagtgagacacattcctaggtccctctccccaaaaagccttcagaattggaacagattttttgatggtgaagtttgtggtgacatcactggtttgctgctctaaaggccactggaattaggaatgcccgtggatgaaagatattttttgccatggacttaggaatctgggtgtgagtattttctcattggtgggtcaagactgacagctgccctctgcaagctctttgaaaaggtaggaagccctgaaggacctaggtgatgctattacttgatggctcaagcagatcttcacaaattcaatacatgaaagataggaagtaagacgtatgagtgatgggggagtgaggttagagtggtacatctatcatagactggatagaaaggaaagaaaagcagaggaggggaggatacacaacttggcaatgtcgagatccagccatccaaacaagcatggaagtccttggtgaagcttgactcccaaggggcattgctttgcatcaggcacctgctagtctctgtatgcaaagacagcatggctcttctagactgtaatgaatagccaccaaaatctcttggatgtgaacctgctgacttcccttgtgaaaactatgcctaaaggtcagtgaatcctgttttggagctgcttagggtcactaacaccaagaaaacttcatacttcacttttctcttatccctgcagaatgctggaatggaagaaaaaaaaagatgaaaagtaggtcatataaattggtaatgcctaattctaatccagtgatctcatatagcattagaataaattagaatacattttgatgaaaatttccattttattaaatagttgcttcgtgcataagcagtgcagctggaccacactgtttctaagattgttttcaataaaatctcattagctcacaaggcaaattgaattctcacttgctttccccatccactgtcccttactcacccctgctgtatatagagcactgagtgtagaatttcgctagccagaccacttactatttgacagagatgtgtatgtagggaacagcmttaagctatgccatgacttcctgtcatggctataattagcatcagttcaataggcttgagttaaaatggtttctrtggtgccattatagctttgttttgccttacttatatctaggtgaccacatgttcaggtttttctgggacagtccctttttatgcctgttttctcagtagaaattcttaataatgcccattctcactctctgaagtattccagtttggattaacaataatatggtctcctgtagcaaatactatgagtgttctcatagccctcagacctgagcattccagaatattcttactggcatcagcctgttgatatcatgtgcagagtgctctattgaaacgacagaaactcttggcccactcaccaagctggaattcagaggtattgacttccctaagggcatccttcagccaataactgataggaattggtggtcaaattttatttgttgttgttgtttttccttgttgatgtacagttactctagcactattcacttagaaaatttccttttcctagtccatttcattggcacccttgtcaaaaattaattgattttatatatgtcagtctatctctggactctcttctgatccattgacctacccatataccaatacgagactgacatatttatcctcaggtgactttaatttgccactaggtctgagaatcaccattttcgacaaaccatgatttattgcctggggctaaatgcatttctggtctacatgaatttgtggttttattcacagaggacaggaagaatattgagttgatatctagcagtgtctctcttcacatatatttatttattttcaacttttattttagatacagggagtacatgtgcaggtttgttacctgggaatattgcctaatgatgaggttttgggtacgaatgttcccatcacccaagaactaagcatggtacctgagtttttcaactcctggtccctttcctccctccccactctagtattccccagtttctattgttgctatctttgtgttcaccagtatccaatatttagttcccacttataagcgagaacatgcagtatttggttttctgttcctgcattaatttgctcaagataatggcctccagctgcatctatgttgctgcaaaggacatgatttcgtttcttgttatggctgtgtagtatcccacggtgtacatataccacattttctttatcaaatccacccttgacaggcacctaaattaactccgggactttgctattcacacatatattgaaarcatttatactaaacaatatgtttgttatgaatagtgctatattgtacacatttcagagaaccttttccctgctaaatcttcacgtgactcttggacacattgtctttgtgaccactggagcacattttgaagtcatctagtagacttttccagaacacatatttttcacttatatttatattgtttgaggtgctgcaaacctctttaaattgtgtacaacatttgcaattgttaggttatacccacctgggaataattactaagtctgtgctcatttttgtttaactttctgatatatttgtttcatttaagtaaacctctagaagtatccaaactaggattagtagaggtaattttgggctaatgtatcttccccaaacattgttctgttgttcaaaataaggtaattacgaagacactggtaacatgagtgactttgttaggacttgagtataaatcaggctcctctttcctgaggagtgcttaatcaagaaaaaaaaaggcttttcttcatataaaggcttatgtaatatacaggctaccaatctttggctttgtaacttcgtttgactatagtgcaacctgatatggttgacttattaggttgaattattttataccgctacgaggcactttttgtttaaaataatgtatgcctcttccagaagatccctgcacatcacacattcaaaactaactagattaccaggacatgggaaaatggtgtcatatgtcttagttgctgaaggttcactttatcttgaataataaaattacagatctacctagaattgaacttaattgcacaatattgtatttcctttgccaattaacccaatggaggtttgaagtaatatatttgaaaaatgctttgtmatctgaaaagcaccaggcacttgttaatcgttgtcattactatattggaaaaactacctgtggccacttgcaatggagaaaaaagtcttaacactgagcaaagaacagctcaacccttaggcaagtactttatcatcaaaacattttccgatgaccatgattcacagcagatgtaaactaactccagtgtttttcaaactagtggtcttgacccacgrgtaggttatgacatcagtttattggttggacatcagcattttacaaaaatgaacagtgcaatagaacataacagaatatactagaaaatagtaatatcagaggtagtaaggataaatattcttttgagaagatctccatatatatacatatacacaaacacacagatacaaacactggatggaagtagaaaatgttctaattgtgactcattgctcagaaacaaaacagaacaagacaaattcaataacaatgtcattgccctaatccttatttaagatttttaaagaatgttatagttgtccttcagcttagcagttattgtattacttaaggtatgatacaaaatgttaagacttttatatatcatacgcttataattcctgagttcatagagggtctaagattttaccattaatatccttctaataaagcattgcattattgaagacaaccagttagccagttcaagtcaacacatttattaagaattaggaatgtataaaaaatataccaaggaaaataaattaagcttatataattatactttatgttaaatgacagtttaatttcttctatggggtgtaaatatttaataaattgtcgatattcaaaagaccaatacatattttaaaatattctgggggttatttttacatayatcatcatgatccccataatgacgtttcaatcagcgacgaaccacatatatgatggtggtcttataagattataatatcaaatttttcctgtaccttttatatgtttacatatacaaatactttccattgttttgcagttgcctacagagttcgatacagtaacatgctgtatagtttgtagccaaggagcaatgggctataccatatagcctgggtgtgtagtaggctacaccatctaggtttgtgtaaatacactctgygatgtttgcacaatgaagtcaactaaggacacatttctcagaaattatccccctcattaagtgatgcatgactgtatttcctgtaatagagactgtatctgttaactattgctatataacaaccatcccaaacatagtaacttcaacaacaaccatttacttagtgccaattctatgagttagcagtttaagctggyctatcctgrgtggttcttcctggcttccttgtgtgtatggtcagccattctgctaagccactctggttctgagagtcttttggctgtttgcctggggcacttcagttctcctctaccctggtcstctctaatcctcaacagactaactagcccaggcctgttcaaagggcaaagacagggctccaagacaatggaagaattgaaggcatgttgaggcctaaactggatcaagtacagtgtcactttgaccacatcctgctcgctataggaggtcacaggccagcccagatttaacaggaggggaaaataatctccaattttttgatgggagaaatggcagagtaacaaggcaaaaggtagagaaaaaaataaggaggccattaatggaggccatgaatgcagtcaacttatcagatgctcttctcctccctacccttttcattggagcaatataaagaaatccttcagtcaagtttccataaagaccctctttcctgcttctggctgagctcctactaaaaagaagattaatgtggaaattaatctaatccaggattaagagtagaagacttacttaaactgggcaattttctgtcaatttgattgtaataaatattttgcatttaagagtttactattgctaaaggaaggattgtgttttctctgggagcattgtgaatcttgtgttactgaacaaatgatttcctaaaagggtatgggtaaatggaactgtaaatcaaaccaaattttttattttgagcccgcaatttaaagggatcgttttacatgtgttctgtctccagagatacctctaaaagttctaggttttagatgaacgattccccaaagcaaccttcacctggagaacataattcctatatttagcttaatacttgggccagaaaggctaacatgtcatttacagtttacaggtaagatgaatgtaatctccttagagtagtttcatcaaccaagtctagaaaaatcaggtactagagtgatttttacacaactgtttcttattgaacaaattacaaaattagagaaaatgaaaaagaaaattagaaaggatagacttaaatatctactcatatggtaataattttataagaaaaaaatcaaaatataacatctgtttctacctgcctggcctgtgaattttgtagtctaatataatgagagagataatattacaaaatagttaggatggctgacttcaaagacagactgcttgcgtttgaatttaagcttagttatgtgttacctgtgtgttctacattatttaatctttttacgcctcccagtagaacagggataataatggttcctacgtcacagggtgattgtgagaattcmgaaagtcagtatgtgtggaatacacaggccagtgatcaatgcctggtaggcaataaatgttaactctcactgtcaacactacagttggtttctattccaaccttcatgaattttcactgatttttttcacacttgtttaaagttacatgctgtatgcctctgccaggggcctgagagacagagataaaggacaaagacactgttcccaagtagcttgaggtattggatgaataccccccgaccacacacagatgcacagatagtgatgccacttgtaaaagggatataagacttaaaggtcattcagaatgtccatgagactcgtttatttttaaggtgatttctaatatataattttgtgaagcaatatgcattttttaggctgttggctaaaatgcaatgaattacctagatttactcaagtttacactcattccacatgtttttctaaatacagaaatttctcattatgtatggcatgatttttttaaaaagaaacattatatataaagagtacgtgaagcctaagaaaagtggcacattctttactcttgtaatatgccagcatcttattctttatttggtggtttctaattgttccctaaaaatgtaccaaccataatattgactgaattatgccacaaagaaaagaaagtgattatagttctcttcatagatccttggacctcatataaagcattgattgattgtggagcctgcctggagaacaggctgtatcagtgctatagaatctttactactaacttcttagatactcttgatttggtctcattcgtgggtttacatttgctctggaagtggtgagcttagatgatagaaaaacgtttggtatgtgaatttcatacacttgaagaaatagatcttgagttcagtttttccctgcaaagtgctagaccttaaaaatctgatttgcatagactggaattcattgatttaagaagaggaatttattacagattaataataattacttctgaagagaaaatactttgaatttgggattctaatacttatttaaaattggcgataatttcactcttaccaacaaatacactaattctgtttttaaaatttcgattagtgttatttttggcttaatatgcacattgttaagccatgtgggtttttttttctgtttttaaaatttaagtatactttgcacagagtaaaaggtacctgtatgtgtctacagttgtgcgagtcttaacaattctatacattcatgtatccatcaccaaagtcaagatatacgacagttctgtcactggcaacatttccatgcattcttttgtcattaacccctttctccggtctctggcaaccacagatttgtttcctttcccaaaatataaatggaatcatacaatatgtagccttttgagtctggctcttttcatgtagcataacgccttttagatttatccatgtatcagtgattcattctttttcactgatgagtaatattttattggatggatactcacagttcccattccccacttgaaggacatttgtttctagtttttggtaattacaacaaaagccatttaattatgttcttacttgttttggaaaaaatccaataaaatggtaaaataatcactttgtgtgtayaggagtagggtgtggcagggaagtctgaatccaaaggtgttactstaagtctctgctggctgggcatggtgggtagtgcctctaattagagcactttgggaggctgaggtaggcggatcacttgatgtcaagacttagagaccagcctgggcaacatgrcaaaccctatctctactaaaaatataagaagtagccaggcatggtgacacactcctgtggtcccagctactggggaggctgaggtgggaggatcgcttgagccccaaaggcagaggatggtgtgatccaagatcacaccactgcactccagtctgggtaacaggatgagaccctgtctcaataaataaataatataaagtctccactaaaagcgattatctgttgtctactggtataatcaggcataccagtagatctcagactgtgttcccatttgattaccattgttttgctgcttaaatccaaaatatgccaattttaaaaataattttcasaattagtacattgcatttcatcaatcttaagttttcctctaataaatcatttgaaatacttgggtatctcacagaggatcccgtgttacctggtttggcacacaatcattacattgattttcctgaagttgaatctagtaatttttgggtgtctcacataagcatgtaactttcagactytctctccctaaaaaaggagtgtcacaagaacatattctaaatcagtctatctggatgtgaaaataggactcttcttgtgttcacagtggccaaggaataaagactactacattctttttcttttcatttcttgtttctttttttttcttttttttttcagacagtgttgcccagactggagtgtagttttgagatcatagctcactgcaccctcaaactcctagactcaagcaatcttatagcctcagcctccttatcagctgggactacaggcacacaccgtagcacccagcattttttttttttttttctgttagagacaaggtctttccatagtgcccagactggtctcaaactcctgggctcaagcaattctcccctcctgagcctcccgaaatgctgggattacaggcatgaaccactgcacatggcctaccactacatttcttaatgaaaatcacaaagtaagactgggaagcttggagaggctgagaaagctgagagtgggtcctgtggaggactttagggagagtcaggaatgttgtctgagtcctctcttacacctctagtgcagtgagatggggcctaacaggaccacttgcaggatggcctgtgaccagtgtgggagtattcttagattctgtccaaggtgctgttataagagggacaagcaaatcctagcttagataagctagaatcatctatgcctggtgctaaagagggaataaacaatgagctagagggaagcatagcatgcccatccaaagagctcctaaagaaagagctcttgtgggagcgtggttagcagtgttgttcatgtcatctataacttctatacccaaggcatgtgcattcattctcaagctgctgcgggtaccagttactagaaactcatagctgcccccattctctggccaactgccctgggctgacaggagtcccctttcccagagatgccttgtagtttatgccttccaccaatctggagactgcccatggtcagcgaccgaaaaatgcagaggtataaaagaaagcacggctgccttgcctcaagacctcacagcccttgtgttgcaatccatgctccagaggtctccaagggatcgggtggggactaaatttcatctgaaacaacatgtttgtcaagctccttctactgcccccttctgcttctcttgatcttttagagggttcttctgagagcacttcctcaaaaatcatttgcacaagaatccctgtctcaggctctacatttagggaaccaaacctgatatagggaactctgagaaacgcccccaataaaacattaagaggagagagagagagaaagagaacttcatacacttgccgcgcttagagagcatattgacatgttactactttaacaatcaggtaagaacccctctgcctccccttatctcttcactaagctcctctaagtgccaaaattcatgttagcaaggtagaaaaggagatgtctaactaagctatttagggaaacataccttaaggctattaaactctttccttcctataagattccagctttgcggttgatstygagccttatgaagagaagctttaacgtgaaatgaacgtgatctttccatgagccattaatggttgaccaggggatctgggagagtataactagaaaatttatggagacttttatctaggagcccaagaataaccaacccacctaatttattgaaggtgacagtggggtagagtgcaygatatctcctgagtcttgcctatttggttacctgttatcctaaaacaattgaaaggacaaaaacataataaatgctgaatcctgacaaatgaagacagaaaacttacttttcttcttaaaccaagaggataagcattgtatttagtattgagattaattctcattgaaataaagtccatcagacacacaagtctccatgtattattggtcatccagacattgagatctaatccatcacaaaagtctctatgagttagacatccaggtagccccacatacatctcagacagggcactcttagctgctttcttcttgatggcagctggggattattccttcccttcattttttgtttttatgtgcgtttttgtttgtttgtttgtttgtttttgagacagagtcttgctctgtcagagtcttgccaggctggagtgcagtggcatgatctcagctaactcactgcaacctccacctcctgagtttaaggatttgcctgtttctcctgcctcagactcacaaatatctgggacaacaggcacatgccaccacgccaggctactttttttttttattgtattttcagtagagacggggtttcaccatgttggtcaggctggtctcgaactcctgacctcaggtgatccacctgccttggcctcccaaagtgctaggattacaggtgtragccattgcacccggcctttcttcccttcttaacacaaggaaatacccaaatattagagggatgcagcagtggggaatgtataatccatggtgtctttgtttcgtgagaaccccaatgaagaaagagaaacagggagacatagtttagagcatgccgctcagcagaatttagaattgccttcagtcactggaagagtctaggtgtacctggctatttgaaatatatgaatacccagcttcattatctgaatgttttatgctccccaaaatttgagctctcttttcgtacaggctgctataacaaaatatcatagacggagtggcttaaacaacagacagttatttctcaccattccagaggctgggaagtctaagatgaaagtgccaacagatttggttcctggtgaggacctgctttctgacttgcagctgccttcttgctgtgtgttcaactgaccttccttttgtttgtgtatgagggagaaagagaatgagagagagagagaaagattcgtcttcctctttttacaagggctctaactccatcatgagggtccccctctgatgacctaatctaaacctaattacctcacaaaggccccacctctaaatataatcacattggggattaagggcttcaacaaatgaatttgggggaacacataarcattcctaatgcaggacaggcaacatttcagctctgccactgactgcccaaataatcctggacaacttacttaacctctctaagcctcagttttgtcatctgttagatgggaatgaatgagttaatatctatagtaccaaaaaaaaattgtgtctggcacagagtaagtgttcagtaactggtaactgttgattattagcctgggttaaactctggagtagttaagaaatgaggcaatttctcattactagaagaaaaatcaaaatgactgtattaaaaaggagatgctgagcatatcatcaataaaagttttaattggttcaatattatttcagattgtgacattaaacatcactttcaaatgctgaggttatttcctcaaatatgacatcagttgactcaatcccattaggagaaatttgaacgccttcactatgtaacataaaaattgctaattctttccttattatatattataatcatgtgtcacttaatgctggggattcattctgatattgtgtgaacatcagggactgaacttatgcaaacctagatggtagagactactacatacctaaaatatatggcatagcttattgctcctaggtacaaacttgtacagcatattactgtgctgaatactgtaagcaattgtaacataatggtaagtattcatgtatctaaaygtatgtaaacatagaaaaggtacattgaaaatacgatataaaagataaaagaacaatggacctgtataaaacacttaccatgaatggagctcctaggcctggaagttgctctgggtgagttgttgagtgactggtgagtgaatgtgaaggcctaggacattaatgtacactactagagaatttataaacactgtatacttaggctaaaataaatttattttaataaacttttcccctcaataataaattatccaccttagctactttaacttttttactttataaacttttaaattatttaaacttttgactcttgtaagaacactcagcttgaaacacaaacacattgtacaactgtacaaaaatattttatttctttacagacttattctataagtttcttcaatttttaaatatttagtttttactttttaaacttgtttgttaaaaactaagatgcaaacacacacattaacctactcagacagagtcagcatcatcaatatcactatcttccacttccacatcttgtcccactggaaggtctgcaggggcgataatatgcatggaactgtcacctcatatgatagcaatgccttcttctgaaattgccactgaaggacccacctgagactgttttacagttaatttttttctttaattattaggaagagtatactctaaaataataatgaaatgtatagtatagtatagtaaacacataaaccagtaacatagttgtttattatcattatcaagtattatgtactatacataattttatgtactagagttttatacaactagcagcaatatagttttgcttgtaccagcaataccataaacgcatgagtgatgtgttgctctgcaacgttatggcagccatgacatcactaggttataggaattttttcagctcygttataatcttatgggaccactatcatataggcagtctctcatggactgaaatgtcattatggggcacatgactgtgtgtgtgtatgtaggtacacacacatatgttcatctcttatgcctgattttgattctttattaatgtggtgtaagtcaatatttattggcagcaaaggatattttcaccttagcaaatgacagatatgaagtttcattctaaagaattttggtgctttcctcctactgccctggggaaatgtagcaatccatgtaatctgccaacatgtatggttggagatgcattttagggggtcagggagataattaatgaggaaaccttgagagtcctatccctatttctagctcttacctcaaaaggaaattactcgtaagtccaggaaatggctacgctgaaaatacttgtcatttgtctgacactgtacagaattctatgtttaagatcatcagttttagtggcaggtattcttggacttaatcctacctctaccaattacaccagtcattagctgcataattttgaacaatctcaatcttctcctccataaaatgggaacagcagtgtctattccttagagcagttgtgaggattaaatgagtgaatgcatataaaaaaacacttggtcctgaatctgacacatgaaagcactgggatagttgttaccatttgaattgtctaattcagggccttttcattccacaagcgaatggcgaagtaccatttaagacttgccaatgggtgggggaggcatttactatccaaataattatatcactgatcatgtctaactgaacacrtttttggctagaagggaacttggataaaatataaaaacagagctttcacaggcatttttgttatttcatttatgctttgaaaaaaatattttggggcayctactattatgggtagctaactgcatctcaaatttatatcttaatgtgttcttgtcctttaatttttattctgcaacatatgaacttcagtaatttctaatttccagaatggtggaacataaatacatgtctccagttcctatcaactttgctaagtcataataatattattaacaaaatcatagtctttttctttaacctagcaacagttacttaacaataaaagcaggtgccaacacagcaggaacagtatttagtgttttgtgagtcattgtttttattatttttaactttttttaccatcaccttaggaaatcatacaaatgtcattgtggaaatcaatcattagagtaaggtggaggactaatttttattgtaaaaataaccatatttacctggatacttatttagaatctaagtaagaatgcctgtcttcttgaatcccttactttatttagtcaaatgctaagttaacttgctgttaaggctttgggttcttctttttcagtcgatgtcagtgttgaggctttgtgtgttggcaatttttagttgtgtatcgattaaccattgctacaataatgctatgtaacaagccatcccagaacttcaggcttacaacacttacttgtagtttctagtaatatggttgcattggttctactgatctgagcatatcccatcagggctcattcacatgcctacactcagctctgtattagcttgttggtttcatttgacttggaggggcartgatgtggctgggctctcagcagagaagaatgggctctgctccacatggtacctcatcctccaagaggctagcactgggtttttctcaggctagtccagtcataatatcatggcaatcacatagcagcaaaaagaaagcataaatgctcaggcatcatttcttcttgaatcgagtcagctaatatcctgttgcttaaagaaagtctatggccaagccaagagcaagcgtaggagggagctacaaagttatagggcaaacgatgtggctacatggaggctattaattggggtgctaatgaaaccaatctaccacagatggcatggatccactgcatatggaagccaccacctttcaggaagacctccccamctggacttttaaaatagcctttctctccagatgccctacctatcatctcatctgcctgttaagaatgggtacatctgggccgggtgcagtggctcacgcctgtaatcccagcattttgggaggccaaggcgggtggaccacctgaggtcaggagttcgagtccagcctggccaacatggtgaaaccttgtctctactaaaaatacaaaaattagctgggcatggtggcaggcacccataattccagctacttgggatgctgaggcaagaatcgcttgaacctgggaggcggagggtgcaatgagcctagatcgtgccattgtactccagtctgggcaacgagagcgagacttcgtctaaaaaaaaaaaaagggaaaaaaaaagaatgggtacatctgggatgaccgtaccttaaatacaagacatgacctgttaacactgccaaaaagaaatgcttcagtgataccttctaatggtggaggaacatagcttgtcaatactcagcaagcaataatcatgccttaagggttgatgttggctttgtgcccagatccccttgggctggtgattctccagctgctgctagtgttggcttttattagcccccaactgagtcctatggagaactgctcctagcccacggttcacatcccacccactgccttctgcggggtagcctgtctgacacagtgcaaacatcccaaccagttttcctcaagatgggacatctctgtggtataatccatgctccagaactcccttgggtccacgctcagggtggactccagctgaggccacagccttactcagctctgcctcattcactttctgcttccctccttctcctgttcctgagagtcactctcaagaaatcacgggcatcccaatccctgtctcagactctggttttagaaaactcaacctgaaatacatgttacaatgttattttctgtcattttcttttgtttttttaaagcaaaaaaagcatagatttattgaaacaaaagtatactccacagaacgggagcgggcttgagcaagtggctcaggagcccagattacagaattttctggggttcaaatactctctagaggttgcctattggttacttggttacaccctatgtaaataaaggagtggcccatgaccagtttgattggctctaggagaggaccaatcactggctgaagcagagttacaaagttacatatgaagacttggcccacaaccagtctgattggttgtgggacaggaccaatcagaggtactttccatctgtctttattattattattattattattatactttaagttctagggtacatgtgcacaacgtgcaggtttgttacatatgtatacatgtgtcatgttggtgtgctgcacccattaactcatcatttacattaggtatatctcctaatgctatccctcccctctccccccacctcatgaccggccccggtgtgtgatgttccccaccctgtgtccaagtgttctcattgttcaattcccacctataagtgagaacatgcggtgtttggttttttgtccttgtgatagtttgctgagaatgatggtttccagcttcatccatgtccctacaaaggacatgaactcatccttttttatggctgcatagtattccatggtatatatgtgccacattttcttaatccagtctatcattgatggacatttgggctggttccaagtctttgctattgtgaatagtgctgcagtaaacatacgtgtgcatgtgtctttatagcagcatgatttgtaatcttttgggtatatacccagtaatgggatggctggatcaaatggtatttctagttctagatccttgaggaatcaccacactgtcttccacaatggttgaactaatttacagtcccaccaacagtgtaaaagtgttcctatttctccacatcctctccagcacctgttgtttcctgaccttttaatgatcgccattctaactagtgtgacatggtatctcaytgtggttttgatttgcatttttctgatggccagtgatgatgagcattttttcatgtgtctgttggctgcataaatgtcttcttttgagaagtgtctgttcatttcctttgcccactttttgatggggttgttttttgtcattttctctatgtattttttttttaattctcaatgccttgaaaaaatagagaaaacttcacagataccaaaatgagattaaattcagacatttatgagatatatttttaaaggccctatttcaaaatattcagtgcacatgtatgtattgaggcagtcttggaggaagggacatcaactttgcttcagagaaaatgaatttatctcctcagtctacctggctctgccacttattgatcctgagaatttatgaagatctttttttaaataatttttttattatgctttaatttctggggtacatgtgcagaatgtgcaggtttgttacataggtatacacgtgccatggtggtttgctgcacccatcaacccgtcatctatattaggtatttctcctaatgctatccctaccccatccccccaacccctgacaggccccggtctgtgatgttcccctccctgtgtccatgtgttctcattgttcaactcccgcttatgagtgagaacatgcagtgtttggtttttcgttcttgtgttagtttgctcaacttgattctctgtattctcatatgcaaaatggtaataataattactattgcaagggattttgttgagaattaagttaaatgagataatgcatgycaaaggagtttcaagggctacagatatgctatttttacttgtagactgtattttcttataactcagagctttaraaacccgatgcaactacctaatgccagtaaaatggagtcgtaaagtaataaagaaaactgattgtcttgtttcctattttttttgaaaactgattttgttgcttactgtttttatcatttggtcaaaaytgaaacgtaagttttgtatctctatccagatacaaagacagatttttggctttcgttacaacagcacagtaagatacaaaaatgttcacttcattttaatgttatattttgacttcctctcctgaatgctacttcaggcatatggcaaaataaactttcaaaattaggaagctctgagaaataaataataatgtaaacattctttatttgtgaaatgtagatcttttcctttaaaaaaaaaaagcctggctaaccttatttaattctactgagctttacaatttgggggtattataatcaggagattgtagattcgagctgaaaaggacacttttcttggtactgcatcagtggtaaaattcacctgtgttttgggttagtccagggttaaattgaaaataatactttttagtatttgtggccagaatgattaccaaacaatctctatcaaaacagccatttcttcttaataaaaataatgttccggagatgttgcatagcactgtgacccagattcacacacttgtgctaagagtacctgtgtgtgcaaagacttctcttgtcatcactttcctaatcacattacattgactttcttcatttctttctcccccacaccctgcccttcaacttgctaagtacacagtgtattttcttcctaaaagactttctttttggttcaaaaatatttttttcaggaatttgaaagattcaagggaaaggaaaagagttagctgacttagattcaagtcaaggttgatgctgattgttatgtaacatgggcatgtaataaatgggaatgcaaatctccaagactgttgatactggacaaggtttggggaattttggacagagattttcatatatgttacagcatcttcagttaatgmggagaaactatatgtgcttagattgatagataagtagattgattaatcagtcaatatactgattaatctgaaaaaaataggaatcacattcttcaaagaaaactcagtgatgagaattcttaagatgaagatcttaagttttcattctttggtatttattctttagtgtgtgtttatcctgctgtctgtgacttaaatccaatgtttcctcttctactttttgaaagtgaatactggtagaagattcttgcttatttctgtcaatagggtttgaaataattaatctgacttgattaaatgcctcagttatatagtagcatttaaaaaattatggagccactgttacataattggcctcaatcccatcttgtaccccttttgctgatagagcaaaacaaacctacgcaaatatggaagaaattacccacagcagttaccaacccccgtgctgcttagaagaatgcattgttgtgcataaactcaggataaaaatactgaacatttttcaaccatggctgtgtgttgatttctgtgccattgtgttttgtttgctattttaaatttttgtctacaatgtttcactgacagtggtagacatcattcccttagatgcttttggtttgcctagaagaaatgtgggaataaaagagatgaggacgattacactttggcttccttcaatttttcttttggcagtttagtctaacctcatcttcttttgttgattttgtaatatgagaatttaaggcattcaatagtaggttatatgattgaaattgttggccatctctacttccatgaagggtgtgtacatacctacctccagtagaatctcaatatcccattgtaattcctgatagaattaagaatccatgctttagaatgaatgaaaaccttaaaaccaggttaaatttattttatggaaaaccatttatattactttaagttcatggttcttatttgttcctctcattgttattactttttgagtctttgatcttaagtggagaaatttctgcagaggctcctcaaagaagtagcacatatataatagctgggtcataagagagcttgatttataaaatgtttgattaatagagaaaagaggcaaggtagagagtcttgtctccagaaacaaagttgtctttaaaagtatgtaaaattaaagcttgaatctcttggaaccaaccaagacagaaataaaattaatattcatgtaggtgtatgggctgaagcatcctacaatccaattacataacagggacaaactaaggtaaccctggtgtaatgtcttgtaaaagaagaagtgaggttatataattagactgcatttatcaagtagcacattccacctacacaggctctgaagaaagaaagaggaagtggggagggaaagatttctaaggaataatgactaagaacagtttgatatgtacgtttgtgtcatcctttcaagattttttttgcttttagtattatgcatagcatcacttaggcgtctaatggcttacagttttgtccttcaaagaccttgatcaagccagtctttggggcaaaaagaagagcttagatatgggtggagggaaagaaaaactggaccctttaagaattgtgtctaaggaaaacggtcaagaacagttaactaagaatatgtttacttggaaagatcattttcatattggtaagtagagttattaggtgaatagagagcatatgttttgtgccttgagaggattagactagggtaatattatcactgttgataatgcagatattgcagtatgttttgttaatccaacaaaggtatcataggaaggtacaaaagatagaaaaaaaatccaagatggtaataaggagctttattatggtgaccagtatacaggaggggcaatggatagggcagaatcattcgaaccaccacctttatggttgtctctgtttcactcgttcagcatcagtccttgtaagatgtttctcagtgctgtgctattaaagttgaaacaacagtaattcctgctgaagaagtatatttagccaattgacctcgagtatacccacattagaaaactacactccaaaccagtttcccaggttgttttctcctattctttccagtgttggagtttgttggaaatgctaaggaaatgtcctcgcaccaaatttatcagatatcagaagtgtagtaccttttgcttgtctcaaacttggggtgatagctgttgattgaagaaataaaaaatattgaagtccctgctaagttaaatgtaattgctgaaatggccaacatttcatgcaatcagtacaatcatgcaatcatacaatcagtacatgaatactctgccatcgttagtgtttttgctccctctgagtgcaaaacatctggtgaggagcatgcagcacatgtatgtatgacttccccattttcagtggatgtactcattcctgacacaaaggagagcaaataaaagtaaagcaatgacaattaaaatgtaccaattccccaaatacagactgatgcaataataagtttaagagacagcaataatgaacaacaaagattgttgaatacatgagaaaatttgtttcaaattctaycctttggagataatcatcattaaagctggatgaactaaattttaacaaggaagttggcgagtaaccaaatctatatttaaaggctttcagcctaccaaatcttgcatgtatgtaaccgtcattttatgacttggcttttcatttcattaatattaaccaacaataacttccttttggctctgatggacttaagtctaaaggtctcgaagttgaaattggaaaaattgagttgctttttatactaatttctgattgctatttttacttcttttatggtagaggctatattttatatatacatcatttggcaacagtaattcacttctaagcttttatggtgcaaaatcaattgccaatttggtgataatataggcaggcactaatagtgctgctttgccacttcaaagcatccagcccgagaaatttcataagcaggaaacctaaccccgctggctgaactgatataaagaactgcctcttatgtgttcccttagatttgaatttttcaaagctcctctggaatattgtatttttggagcaatcacaattttcatttatttcaagaagttgatttcctgtaggcttcaaagatattacagttctgcatggattagttttaaaaaccggagtgagcatatgaattgtttctaaaatgtatggtgtaagtgccatgggcactggtatggaatggatatggattctgatgttccctcttccatataaagtgtacttgggaaaatctgtttcctgatctgtaacattcagacaacaatagttcatagaactaatgactcagaagatgcaaatgtatctccatatgttaatactattgaaagtaatargaagatataggagaaaaaatcatcataytgaaattagtagaagtgatgaatggaggcagaagaaactagctggatattttcagtggaaaaactcattttaaatcatgaataaccactgttagcaactttccatatttgctctcagtattttttaaagcgtgtcattgtttttgcaccacacacacacatttgtgtttgtatgtgtgtcaaatagtgaaaaaaatcacaaaatcagagccccaagtctaccacccagaaacaaccattatttcattggcttaacatcattttaaatatacatgcaattatcaatatagataaaagcatataaaatagttttataaaaactaattatacagatactattttaacatgaagccttaaaatttttgttttaatattgattgcctctctgtgaagcatgagaacgtttgtccccttgtgtgtccctccctctctgcctctgtttggatttttgttacttgtgtcrttttttttttacactgtgtatctctaaaacattcatggtgacttgaaccatgatttccatatttcattagtactagcactatatttaaataagatcaatgttctcctgcctcatttgccagggctttgcattcttaaattattcatcttgcttcttctctaaattgtctctatttcatcatcaaggtctatttttttaatatttttaggaagggttcagaagtgtatgtgttttatgagatcttccatgttggccaatgtcagccatttgccttaaaaattaatactttagcataatataatatttttggagtcacatttgtagccattgctccatgggcttctagcactaaatattgctgtgcagaagtctgaggagaacctgttctttccctgcgatgagttatttgcttttcgtgcctggatgcttgaaaaagtcttctctttattttcctctggacaaggatatttttcatagttgttttgcccttttttaaaaatcttgcttcgatgccccttttcaaacattctctcttgtcttttaaagtattggtgacttcttgtctttctttatctgagaacagaatgcttctttttcacaggctttttggtttgagagctgaatatttcacgttctttctgattttcttgagaagggaggctgaagggaatactgatgtcatatatgttctttctagaatttcaggtctattttctctcccgatactttgttaaatgtccrgtaccaggtttgctttgcatcagcgtgagtgtgtgtgtgtgtgtgtgtgtgtgtgtgtgtgtgtgtgtgtgaagcggcacatggtcaggcttcattagctttctcaaatcattctgaagcagtggatgaattcttcccttaattcaaagaaattattgtttcctattgtcctcagtgagaagcatctttgctattactcagactagggaaactaccaggacacccattcaacttgtttctttctcaatttgtggttatgaacaagaattctcagtaagtttggactcaaccattgacttggaggaggcatcagtgttaggagtcagtgacttgctctgccctagaaatttctgttattttcttagctgtcagagttactgcattaggtctagctttgtttcttgtatgttcttgttttattttgtttataactgttttgcccatgtttaaatgtattctgtgaagtagtttttatcttctgtcttaacctgaaaatcagtaaagggttttaacctaagcccggaaagttactgctatttcctttgcagatggtgcattgtccctgtgggggagctgtctagagggtataaccaactgtgtgaactaggcctatcagaaggacatttcactgaacacctgctggcttttatttttttactttatcttttgtcagtgtcaagggtattatattttttcctttttttttttcatcaccacttacaagccagataagacagaacattcacacctcactgactttctttttattgggaaatttttatttttcctcttgatttattttttcttgctctgagtaggtttataaaactaaagtgaggaacattcagataagatgcactgtcaagattattctaaaccccagcatctttactattttgaaagcaaaacttaaaacaaaaaagattaattaaaaatgttcttaaaatttgaaggtgttttcctttccaaaatgtatttctgcaggaattcccactgatttgaaagataaaattgtatcagatcaacatctccagttaaaaagctagttttccatgttttatttccaaatgctatcaaggggataaaatttaaactttttttgtgcacacatgttattcacatgtgagaataatgaaacataatattccatttttctgctgtatcctttgctacatgtagagtgctgcttgggaaacctgcctcacagtatggttgtgaggattaaatgtgcaattatatagaaagcacttgataagcacttaatacatattatctgtggctgctgctcctttcattgttatgtcatacaatggaaatttcctcatggatttcttcttttgagtgttctttttttacactgttaactccttaaatgagatttttgcataatatttaaagtacaaattctattggttgtccaaagctctatttgagcttttttccaaaatatgttgttttgtttgataaaatgggatgtaagggaagccaatgggctatgttggagataggcctcgagtgcatcctttgtgcccatcttcagaaattggccctcagcctgaatcaccaagcccagtactgtaaaggattcatatatacaacagcacaaccatagccccgccatgaaatactgctggaattcaggagttggacttctatatccttgattttaatcttaaccccactcttgggtagcttcttcgtcttcttcttttcttcttcttcttcttcttcttcttcttcttcttcttcttcttattattattattattattattattattattgttagagatggagtctcactctgttgccaggctggagtgcagtggcacgatctcggctcactgcagcctccacctcctgggttcaagtgactctcctgcctcaacctcctgagtagctgggactacaggtgcacaccaccaagcccagctaagttttgtatttttagtagagacggggtttacattgcatttctccaatagttcaattccctttgcacacatgaaaattatatgtgaaatcatcgtatatgaggatcccatcataccaagccatgtataaaagagaaggtattttgagcatagcatcctaagtctggattattttaaatgaatagttattgtacttgatgatttatttcaaatttcctctttaaattactgtaaatgtttcacaacataaatgctactctaatatatttcttagatatataaatgctactctaagatatttctatatatataaatgctactctaatatatttcttagatatataaatgctactttaatatatttcttagactcacagttttgacactaagtttgttataagtgcagaatctcagactccaaccccaacccagacatactgaatcagaatttgcattttactgagattccccagaaattcctaagcatgttaatgtttaatattacagaactaatatagttgatactgttaatagggaaagccataacactcaagagaaatatggatttaaaaggcctttaaacatatgagactgaagctctccattcataattttaaaaatcacaatctaaaactacaacccaataccaatgttctcttcatagactggtaaaagtgcaaaggggtgacaatatactgtgggttgtccagaaagagcactagcattgctggaagttgaggaatgcagggggtataatccctagaggtttttggcatatctatcaaaagtgtatgctttaacccaccaatcctacctctgaaaatttatcctccagatatgcttgcaaaatgaaatatgtacagaaatgttcattgcagaattatttgtaaatgggagttgcataagggtcaatgagggactagtgcaataaatgctgcaataaaatattatacagctatacaaaagaattagagcatatccccttatactgattggttaaactcttcaagtacattggtaagggaaaacaaaagcaaggtgcagaaaaatgtgtatgatactgtttttttgtgtgaacaaagaaacaatcatatatataaatatattatataaatatatatttatataatatataaaaatatatawttatawaatatataaaaatatatattatatttatataatgcatttatatattatatatttatattatgtatatatatatatttgaattagcctgtatggacatttttaaaacaactttgcagacacacataagaaacaaattaagtatctgtgatacatgtaactgatgaagagcttgccaagacataaatgtaacttctaaaactatataggaaaatgacagataatgcactgggaaaaaaktagacaaagatttttgaccagtctattcataaaagaggatatcaaacagccaataaatgtataaaagtgttcaacatcatgaataataatgcaaattaataccaggagaagctatcactatatgtccatcagctggccaaaattaaattttcttacaatagcaagggcactagggacttggatgcatgctggtagggtgaagattggtgtaaacacttggacaaaaccatgttatgaatatattttctattaaaggtgaacatacacgtgtgttatggctaagcaaccccaattccaggtatgcactgttggaaatatattctcctccaccctaggaaacaggcataagaatgctcttcttaacattattctcagtagcctcagaccagaaataacctaaattaaatatccaccagcagcaaaataaacacgactatacagtgttttttaaaaaaaaaaacaaaacagaaaatagcaagtgttggcaaggatgtagaaaaattagaacttttgtgcattgctggtgggaatgtaaaatggtccagctgctgtggaaaaaagtttatccattcctcaaaaagttaaacatagaatcatcatatgatccagtgttccatacctagatatatttgcaaaagaatygaaagcagggactctaacaaatacttgtatgccagtgttcctagcaaaactattcacaatcaacaaaaactggaaactcaaatgtccatcccagataaatggataagcaaaactatttagccttaaaaaagccatgaaagwctgatatttcctagaagacagatgaagcttggaaacattacactgagtgaagtaagccagtcacaacggacaaatattgtaggattaaaataggcatattcacaaagacagaaagtgagattacaagggactggggagaaggaagaatagggaattattatttaatgagcacagtgtttctgtatgggatgatgaaaaatgttttggaaatagtggtaatggttacacaacattgtgagtctacttaatgccactgaactgtatgcttaaaatggttaaaactgtaaattttgttacatgtactttaccataataaaaaaacaaattatagtatgttcatataaaatagtattatacagtgatggaaatgaatacactataaacgcactccacaggttgaatctytcaaatataatgttgagtgaagaaagtcatatacaaaataatacataaaattaattgtatgtaagttcacttacataaagggcacacaggcacaactaaactatgatgtatcgggatgcaactatcaggatgaagtaaaaagaaaagtaagaaaggaactgccctagaaggcaggttagtggttatctttggtgaggagcagatgaggcgtctttggggtgctggcagtgttccatctcttgatctgggtattcacttcataatgatttgtttagctgtacatttcttaatgcattttacatatgtgtgttacatatcacaataaaatgttatttaggcagggcatggtggctcacgcctgtaatcccaacactttcagaggctgaggcgggcggatcacctgaggtcaggagttcgagaccagcctggccaacatggtgaaaccccgtctctattaaaaatacaaaaattagctgggcttggtggcaggagcctgtaatcccagctacttgggaggctgaggcaggaggattgcttgaacctggaggcagaggttgcattgagcagaggtcacacaattgcactccaacctgggcaacaagagcgaaactctgtctcaaaaaaaaaaaaaaagttttttaaaaagaagtgaaaaaaggggttatgtgttgaggttggtaatacaagaactgcatggtgtgggcatgattctcttaactctactattttctatttgggtttttaactgtaaggcttatgtcatttaattttttcaattcaaataactaaaccagtaaactacaaaatgacctggatcaaatgactgcaagaaattttgattctacatatttaaacaatatagccttccaggaaatgtaaatacttgttttatataaatataaaaacaagtgtcttaaatataagtattgaatttgatttgtcttcagaatccaacattcagtactaagttccactttgaaaccctgttttttgacataggttattaaatattaagcatttaattattacaaattaaaaggaaaatataaaggaggatggatttgtttgtttctttttcagattgaaactgcttggccaaggcctagccagggtagctggcctacccatggcaaggacttgcagcaagccaaattaacttccttgtttggatcacacattaaatttcggaataaagccatttccctggaaaggatcaggaagcattaagcagtagtgctcaagaagattaaacttccatgttgagaatctcactggttatctttggccttctggatagctagttcttttctggcctgtgtacctttytatggctacataaaaaaattaataacctttctaaaagtaaaaatcctatttggagtaagatggcattgcaaattaaataagtattggaataaacaacattagcatatttttttcaaagctatgtgtttagcactcaaaacaatgtcatgttgggcatctataaaacagcttatcaacatttgcagttggcaaataggtgtgttttggagatgttatgagcccttcttttaaaatcactaagatttcttattagtgtaaagaaacatcatgtaagtaaacccagagctctttttaatacatttttttctgttttctcttgtgctactgttttatttttttaaaaccttcttaacatagatgtcatggactctgttcataattcagcagcaaagatcagatttttttttaagttcatagaaattgaagctgtttgtttactagatccccttaaactttgagactcatttttaccartaaatctttacacactaaagaacaacgatctatataaatagttcaattaggtagcctttctctctgctccttaatctgtttccaaagagactttgtaactttggcttagaacttgcatgaagatgttttctagtgttattttcttggtatggttgcattgccttttacttttttttggttttaaagtaacacataattcctgacacacttatcattcaacacataagtgcttctatttagatgtctactttcattttattttttaacattgtactgtaaaaagacaaaacatacctactacaacaacagggattgttctaaatgctgtctacctactaactcaattgtagggaggtttgattttccattttatttgtgtgcacttctaatatacttggcaactccctatcatattcattaaagaaaaaactttagataaactatcataggaaaatctaaactgaaatatttaaaaaaaaattttaaatcagccttatttatttacatgcatatacaaatacacacaaacatgttaaaatgctcaaattatccattttacattccatacctcataactattatatacatttagtattaccatgtactatatgtttgtatgtagtgcagtttatccaacagcataagtcataccttctgggaagatgaggtgtatgtcaagcattggtgttctactgcctgccagttttagtttttaataaaaacaagagaatcacaaagatgaaacagaagcaatccaaagtgtataaatcatgcttctttcccttatgatcctattcttgacttttattacctcattggaggacaaggttatacatctcactgttaatcctgggctaggtcacctgttgagtaaaagaaaagcctttggttctcagattttaagtcatctgacattttaaatttgcatttggagacaataaaggaatataaccaactttttctgtttctttagatcttgaaaaggaagttgtttgaagtcaattctttgttttgatgtttggtcaataatgaaataatcttcattttatgttatatccggcaaagaaaaacagtaacagcaatatggagccaggatgtaaatagattgtattgcttgaaatccacttgggtaaaaaataagcatgcaaagcaagggaaaataatcaatcaaaggggttggtagatgtttttcttggttgtggctttttgggtggctttttggactataagccaaagttggatcttgtcccaactgcttttaattaaactcctacttctttttcttttaatactattttttctcataaaattaataagggatcatggtaggacttttggaaagtatgagtattaattaggatatgggtctagctactctaacagacatccaagtgtcttatgattagagtttatttctactctgagataattaggcaagagctgacrtggttctccgtggtgttcaggactcctaacctggactccctccatattgttgctatgctgctgtcctccaacattgcttccacctcctgatctaagatggctgcttcagctccagacttcacagtcaccttccagtaagaaggagaacagaggaaaggatactctggacattcccagaagtgacacatattatctccatttaaaattcattagtctgtgctcagccacaacagaaaactgggaagtttcatcttaattctagttaatcctatgcccatgtaaaattggtggttctacagaaagaaaagaagactggttattgggagagagctagcaatctttcccagaatgcaaaaaagtataaagaagaaaataactattacccataaattcaaaacctaaagatactgttacctttaatttttggcatagttcatttcattactttactgcattacatatttttaaaaagaattatactatatattataatatgctttttctttttttaataataaatgctctaacattctaacagtctttaaaactttattttaatggctgcatagtatcatatacttataataaataaataaaataaatcaatcaataaataaaataaaaaaattatttttcagttctctaagatatgtaacttataggtcaaaatactcactttaaagtttttatttttcatattacctctcaaaaaggtggtgtaaaattatactcccacagtcatatttgagtactcactgcatcaaatatttctcactactaaatagtacaaattttaagatgattactcatttaatagttaacaaatggcctcttattgttttgatatctatttctttgtgaacaacatagaatctttgaaaaaacaattcttggtaatttgtctatctggtttaaattttctctatatgaccgttatctgtttttctacttataaatttatgaaaactctttcaataatatggatacaacttatctttaaccatggtgaaatattttcccaggtttgagttagtcttttctttcaatatttatattcttggaaatttgttctgttacaatatttagaataaatatttatttgtatctagtaagcaatcaataaatgttaatttaataagggattgaaagagtgaataattagatttattaccacattgtattactcttaatgcttactgctagtcttttcttcttttaactaggtctcccccttttggatgcttttcattttggttttcatcttgaatgactagaacatatattttagcaatacttttgagatgcatatatgcttcatatacacatgcatttcaaaatatccttctattgactttacccaaggacttgggtgattgtatagaattcattaatcctgttttccttcaaaactctgtataccttttcctaccttctggtatgtgacataacgtgtaagagtggcctgagttttatttctttgtaagaaattattggccaagcacagtggctcatgcctgtgatcccagagccttgggaggctgaggtaggaggatctcttgagtgcagaagttccagaccagcctagacaacatagcaagactctgtctctgcaaaaagaaaagaaaagaaattattgctcttttggttttatcgtcctggcagttctaaggtactttttctctcctcttgaaattgccccccaaaattagctcaatataatatgagtgcacattgataacatttcataacttcccctgggaatatcaagaattatattaaatagacagatctggaaatgtttccttccactttgcccttaattcttatttctcttgggtctgcttggcctcttcctctggaacatcagtttatactacttgagtttgcttttcatatatgttgtcttctttcttagtctaagaatctgtttgtcttttgtgcctcttcattctgggagaatttaaagggtttgttcctgtaccagtggtttgctttttctgatctgacatttatgtgctcgttttctaataaagattttaatattgttatggtatttttatttctcagtgttatgttagcctaccctgttcttgttttgtttctgcatgtgtctagctcctgttttatctcattctctggcatttttgtctcattgtttatagagttattgtttcaaggaattttattgatcctataaaccagatgcttcacttgtgtttgctctagtaaatattttcccaaatgtatgctccttctcttcgttttgcttttatatatatatatttctatacatataaatataaaatatttctaaatatatatatttatatctatatacatatacatcacagtatcttcagggctcaatcttttgaaatgtttttattccttttcatatttattcagaattgaacatagagactatgaagtaggccagatatttgaccataaacatgaaataatggtggctagattctagtatattttcacatccaatttttaatttttattttttaagaaccctatctcatctcttaacctggaagactggatattacagtcataggttcatgtggctggttcattgatccagacacttgaaggacatggccattttctgtgtttaactttctgtttggactggtctctgtatcaggtacatagtgtgaccatggatacatgaccctccttgagcagctacccacggcattattgaaatgaagctccaggtcaggaagatgagccatagtttacttgggtagctgcttcataagatagagcaacctactcctatggccttcacacctgtacccaccagtgcggggtttgtaggatactgtgagcattgtcatgtaatcatgctgtgtttatttctcaagtgagaggcttccaagatagttcctggtgtttcccttcaaacaatttctcttctcactaatatttagctaaatatttatgtttctcaaatattgatggtattttttcagggctggatacattagtcctttcatatagtagtccattggtcattttataaggaatccaagaagcatagcataagagaaaaggataaattttcatcctggcacagtggctcaygcctgtgatcccagcactttgggaggccaaggcaggcagatcacctgaggtcaggagttcgagaccagcctggccagcatggctaaaccccgtctctacaaaaatacaaagatttgccgggcgtggtagcatatgcctgtagtcccagctactcaggaggctgaggtaggagaatcgcttgaaccctgaaggcagaggttgcagtgagccaagatggtgccactgcactccagtctgggtgacagagtgtaactccatatcaaaagaaaaagaaaaggtacattttctcagcaccaagtttacgtgaatgccattaacttagcctgtttactgccctgattcctgatttctcatattatgtaatgatatttccatgttattcaatatactgacaaaaattattttatattactatttcatcatagaagcaatatatacatactcccagaagtatttgaaccagaagataatggactgttggccagtagagcagatctgggcacgggacccacagcatccagtacattaatcctttacagttccttccatgtgaattgtctgagtgtgctctttgtccattcctccttttgttaattaatttttaacaattcaacagttattgtctactatatgttagagctcttgaatctttctaagcgctgtccttcaatgaaacacagggatttatttgccagttccttatattaaagagaggatctccttatagtagctgctatataatagtctcttgtctgctttatttttaatataatactttctcagtttcctgttctccttgtaagtaagtatcatggttttggcctggacagggtgaaaattctcatactgtagaaattatcagtggayttttgtctatacttcttccatttgctttgtatatagtaagaccagccaaggatataaattctcatatccaaatttttcatctaatattttaatatttaactttttaatccaacaggattttatgttgaattttttgtgataagagagatttaaaggaatgtaytttcctcagaaaacaagacaaattctacagtggtgtctattaaatatttcctacctattcatgtgtgactctttactctatatcccaaaacaatctcacctcagtataagtaaacttagtccatatttatgtttatgtataaatatatttaatatttaatagtgtgttatatatgatgttgtagtagcctgtgatataatatatacatgtacattgattttttatatatttagcacagtgtttctgggatcacgaatatttaataatataaaatttgtgattagaataaagaagaggataagatgtcaccagcttattgatggtaactgccacccccaatacctcatcttgtccccaggaggcttgctaaggcatgtggaggaggaatggagagccagatggtgcctgtggctccatgtagatgattcctacagggctggaaagcaattactcagtaccagtcccctgggaggctgccgacaaggcaggcatgttccccgcattcatctttacaaggtgtaataattaagccagcagaatcatagcattgcctgatggatgtacaaagaatcagcatggaccctcttggcttgttcattacctcaacgtcacctacacaaactagtaattactcacggaatttatggcatttacatgtgacaatgatctttgctgcattaacgcctcctaaagctaaggtccatggggccagttaaaaacctatttattaccaatgaagcttaagcattgaggatttgggtagattttactgacattacacttagagaaagattttagatgtcttcatcaagaagaagacaaagatgtgtgttggacgcagccattttgaatatatttggcagcagcttattaaatgccctagagttagcctgtttaactctgctttaaacaagcacttgacatgtgctaaaccaaagaacttctctatctgaggtgtaactgtctattatatttcttccactgacttaggctagttgcagaggaccctccaatcggtacattggraattcttggctgaacttgaaggctgtgttttaggtctgcccttctctatcttgcgtttctatccagatgccaatatgaactaaaatagagcttcttgttagtcagcttcttgtccttgaggggcctggaggctacaaaaaaatgagaagtagccattcatcttgatatctggaactcttgccctgggaggctgtcaaagaaagaaaattctggaaagaagaggagaagttactattttttgtcagacggtctagaagcagagcttgagatggagattctgatgcaagtgatttttggagggaatgctctctggagaaagagagtgagaaagaaaaatagggtaggattagaaataaagtaaaggtgggacagaaggtctagcctcaacctggtcccacagggagctttggggtaggaattgcaccacagagctgtcctgcagaatgtcatggactaccagcagcctacctctcccagaggtgcatgcataaacttccaggcatcttcggccagggtggtactcctcagccaacaacagtccttcagagaacggtagaggtgccagctgttagcagctgacaccttcagcatctgcaggatgggtgcaatggccccgtgaagggaacctgagtggggcacggaagtactaactacagttactgayccaccttcctctttcttgcctccaacagtcactctattactctgttatgtatagtcatagcatttatcactatctggaaatagcaggtatatttatatatttactgcttattatctgtctcctttccactagataccataagctccagagcacrtcagtgttgtatcatcagtttctaaacaagtgccaggcacatagttaggtaccggggacacaatttgttgaatgagtaggggcgggatgaggtaggaactttggaaatctgtgtcatgcccaactgtagtggatgctatcagtgtcccatccagatcacctcagatcctggctttttcaaccygggttcccattctccagcttctgcatgcttcactcctaacaagtgtcgtctgcttattagtgtgtgctttattagttgagatagtaatagctagaattgattgagtgctttcagcctgtctaacactgctttaaacaagcacttgacatggactaaagcagtgcttctcaggctttaatgtgcacacaagtcccctgtggatcttgttaaaatgcagactctttcagtgggtctgatgagggacctgaggaactgcatttccactgagaytcccgggaaagctgatgctgctggtctccagaccacactaagagtggcaagggatttgttcattaatcttcataacagctcggtgaaataggttctattattatttccattttacagatgaggaaattgaggcagagagaggttaagccatgtgctcaaaatgacacagctggcaagagatggaagcagaatttgaatccaggcagcctgaatcccaaatgtgtcacctgaaatactctgaataaaggcctctattgaaagatgaagttataagtcaggttgaccaggctaacaagtaaagacaatgcatccctctggtggatctcacagtgaataaagtctatacactgccccaggacactcggaatcttgaacgagcatgactcaatgggagactgttccactgtcagtttctcttccagcctcccatgactccaaaccattaggctgcagttttgacagtrtttcycaatggcttgaaagtaactaatgagtgagtgccagtgcctaatagaggtggatgatggcagttataatttctcaaagatcatttgattcatcttttgtaatatttcaacatttaatataaaacagcaggcaactggagatttataacttgattcattctaattgatttcttggcttccttgggtctaattaatttttactgtgtaccctaaaatggtgcaataggcttcctgaaagctgttagaaggcagctgtatcatagtttataaaaagctgaaacttggcttttatttgataggtaaatagaaattgattttgcttttgaggtccagacataaaagagaaaaattgactccagaactcaagagaagatcctggattactctgtcttggtttgggttcccccaggaggagattccgagacaaggactctgaatgcaagtagttttctggaaggtcgtgccaggaaacctgccaagaatgggaaagtgagacagggagaggaggaagccaaataggggatgcattgtcaaataagtcatattatgggcagctggtgttcaatctatggagttgtctaggagacagcacaggttcacacttaggttttattccaaccaggaacaagtcaccaatcacatcagtcctgggttgagggctactttttcacattaactccaagcattctggacataggcctggctggttttgacagccagagaaaactctccatcaaagagatgaaagcgcttgcacttgaagctgtagggttgggtctacctgggaataataaatggcaaggggatatagacagagaacacagtgtctgttacaatgtccaaatataaactgtgctgctttgaccttttgtgcaccagtgacttctccccagttcccagccgcttgcccctgaccttgtgtagagcccataatcaagattcctgtgccactgacttgaagacctttaactaaggcagttgtccatcttacattttataatacaacactgtatcaccatttggaagaacataaattataactataaattatataaattataagttacaactattgacaagattgtgcatagtgtaaagtgctttgggattttattcatcagtgctcagaatagacctcatggtgacttggcttttagtggaccctccagtaacaatctttttgtgaaaaaaaaaaaaaagaaatgagaaaagaaatgccccatcaaactgaaaattgagtagaagcttctgtgttgcagtaattttttgtgggcttaagatttaatcttgaaaatgcaacatttgtgtttagcattgtcaaaggcaaaagaggaataaaatagtgccttccaggtcaatgaaaaataaatccagctcctgatcaggctctgctgcttgcagggtgttgttctctgagtgttctgattggcacaacacaggctttcttgccacctcccaggcccagctgctgtttgcccacctgtgagccttattcctgcccaaaacaaggaaaacagcaaaaacagtggggccactgaaactgggctcaaggtccaagaacagctttccctttgggttctgttattgccaccatgaagctacttgtggaagcccaggagcaactagttattaatctgttcctctcaactatttctttaggaatcatgtgagtgtatagacactacagacaacgaggatgatttcaaaaccaaaccatgatttatttgttgatatttggaaatgtacattcaacttcttgtgttttgttacacaactcgatggcacattttcatttttgttttagtttaattaacaaagggtgtgctcaccgtgtgccagaccataccagcacttggcaaattaaactcatctagtcttcataacttcaccatggtgtaggtactgtctttattcccattttacagatggggaagttgaagcactgagaaattgtcatggtggtattatcatgaaaataacattaagattgatgaaatgtatatattaactaattttgactcacaggttaatccttctgcccttccctgatcctatcccagatggcttttggaatgctttccaatacatattaaagggtttatctgtgctatctctggaatgttgcccaggctctgttatagtgaagggtaggttataaagtcagcacatagtggagaaaatgccatagagtccaaattaactctgaaaatgctttcaaatacctcaaagtactgcagtgtggttttatgcttatgaccctctgtggtaattctaagggagctaaagttctagaaaaactgagcctgactgaagaaagaaactttcaaatcactcagcttttaagataactctagggtcgaatggggattggatgaatcaatcaaaaagcttctgcttgcctgcaaagttgattcctttctagttacacatcaagattctttaatctcaatgtctggtaataggcttatttgttaccttaaacatatttgttcaagcacagttgtgctttttagtgaaatgtaaccaattgcttaagaaaagggtctcaagaagtagaaggcctgagtttgattcccagactcttcatagatayttagcaatgacaaattacataaagtatttgaccttcagtttgttcatgtttaaaatgggtgcataatctgtacctaaccttataggttcagtgtgaggactaattcccatgaagctctttgaagggtgcctggcacttagtaagggtgcttgaaatgtcaactcttcctgttattctaaagtcaggaggaaatttaaagaatcggttatgagattcagctgtaccatattgtcctgcataatgctataattatgaattgacttaaaaggggcctggttccattacttacaagcttgtgacattaatcaagttactcaactcctatggctcaatgtccacaactacaaaaagaggtttttaatgttacatttcttataacattattgtgagcattaagttaattaacatatgtaaaactccttggacaatgtctgggtttttaaatctgttaccactgctgtacccagaacgtagcacatagtaggtccttttgttaagtgggtgaatacactatcagtagccatagtaggaagagcttatcactttaaagtgttatgttttgattgacactgtggttgcaaaaacatggtttttggtcacagtgtgatttgatgtcatatgtggtcacattcattaatgtcaccactgatctcttaaaaaaaagtctgtaaatattgagaagcccatcaagctcacagtggtggatacaagcttcccaaaattctaagttttgcttggtagcttgcattttattattggcaacacatactgtcagttatttaccttgatagacccactttattcattttcaagaaaatatctgtcacatatccaagtctgaataaccctagttttcctgtcattctttcaagtaaaaatggtgttacttgggaagaatgactggttcagcttaaaactcagtctcctaagtgtttcagtataccggagaattattttatgtatagttctcattttgtcatacagaacatttgaaaagccacaaagagtaaaaaaatttaacaaaattaataacttttagcacttcaaggatgacattcttgaagtgtgtttttaacagtgagtgtgtagaatgaataatcaaatgatttctggtacactggaagtctggtgccattgtcttgatttgtatgaagacataagcagttttttttttagcaytgcttttgtataaagtgcagatttcatctcagtgaaaaaggcaataacctcttaatatcattatgaaattattttgacctcagggaccctcaaagggtcttggggaaccccagagatctgtgtactatgctttgagaatcacttagctacggaaacattcagtagataaaactggccagtgaaagggatagcagagtcaaggatgacaccatttcccattctaagaaagtgagtgggcacagatgccattgcagagaagtaagggactagagaaagggcgggtctgtggcagaaaagataggttcgtgttggtcatgaggcatctagaagatctatttgagttgcacatcttgggacgtcttgtgcaattgttcattcaagaaagattaatagaacatccactgtgtgctggaaatgagaggaatgtttttcattcccaacctttttaatgcagaagtcattttcttagtgaaattgtaagcttctttagaggatgacctaaattatatatttagaaaaaaaattgtatgaacctaacacaatgcaagacattgacaaaatatcccagtttacaaaaaatgatattctccttcctgacttcccacaatgacatacagtttttcttccaccctttatccaggtcagacagtagacacagtcattctaaacttcatcattaatcacgaaaatgcaaattaatatcacagtgagatattgtatatacccaataaactggtgaaaatttaaaaatctgacattaccaaaagttgaggataaagtgggtcattagggatatgaaacataccctatgactcagtgtatgtacacacaatttatatgcatatatatacacatacttacacatatgtgtgcatgtatatatttatacatatttatacatgtgcatgcatgtatatgtgtgtatatctacatgtctatatgtatatgtatctaagtataaaattgaaggtaagatgaccctggactaatcttccaactagcagagcacaagcactcctgataagatggccttatcagaagtgcttgttctctgctagttggaagattaaattgacaccaccatttagaaaacaatttcacacaatcctgtacaattagacattacactccctataatccagaaaatccacttttagggatataccctgccaaaagcctagcacaagtttaccaagggatctgcacaagaatgatgatagtaatatgttaataatgtcaacttaaatgaccatcgataggaaaataactagtggtatagtcccacactggaatattacactgtggtaaaaaatgaatgaactactgctacatgcagcaacatcttgaaatcttagaaatataagccttaaagataaaagaaaaatgcaaaagactacgtgcagtaygatacattatgttcaaagcaaacataactttaaacatattatagtggataatacctgttggataaaactatacaatgaaacaggactacatttaacacagaattttaacaaggtgttttctcctggtgggtgtgtagacaaaacgatgtgatacaggaagaatatataggtcaaggcaatgatataggtaaccttctatgttttaaattgggaggtagataaattggtttttattataatgacagaatacacacaaatgtgtgatacacatattgctgagtatttttatatttataacaaaataatattaaaatatgataggaggaaaggtttctttggtaagcctttaaaattttgtaactttcatgttttacacatgtattgtaaatatgaatttttctgcatgtctcctaataaattatgagagtttccagggcaaaaatcttatttcagtcatgtttacatcttgccttaaaacaaaagaatttctaggctctattatggaccaaatctatgtttgctaaccaaaaagaattaatcaaaataaataaataaataaaagctgctttctagattgatctatagccaaaataattcactgatgttttcacttatgtacttgccaaaggatattagctatcatttggcatttagtctctctctatatatatatcctcttttttattattttatttttgagacagagtctctgtcacccaggctgaagtgcagtggcacaatcatacctcactgtagttttgacctcccgaactcaagtgatcctcccacctcagcctcccgagtagatgggactacagttgcacaccaccacgcctggctgatttttttctatttttttgtagaaatggggtctgactttgttgcctaggctagtctcaaattcctgggttcaagcaatcctcccacctctacctcctccaagtttacttatttttaacaggagaaagattactgaaccaattttgactaagtttatggggtgagttcgtctcaaccaaatactacagaggattgaaatctatattaagatagtcactgcaattattttcatgttaagaccagatatcagaacatttttaaaacgaatatgtggtgttctgtcagtaattagccattgaatatgtcaagttaatcacctaattatgtcttgctgtagaaagacatacatgagaaacttacaagcctgttttgtacaacgttgtgtcttaaacactgtgtgtgatccatctgtcctctgaaattacttggagtcacctcccatcacccgtcagtgttctttcaggaatcatacagattaatagagtcctcacttccgtgctgtgctctgaacctttttaactttaatttagtcctgacagtggggaacaaggacaagtatatgccctccaagaacccgagagctctctacattttgtctagctgaggtaataaccatgtttattggcctaggcaatgtcttttaggtcccttttcccattaactttgtagttgtgaacagttgtcttgaggttaggaggaaaggtgatttaaggaaaaagaaggagcagagggatggaatgtgtacatagccctttctttctgaattatgtctccttgtttggcattccttcctctgggtgttttgtttcattggctgtggttgagcccagcctttattgatccccctgtcccaccagcactgtgtgatgtaaatgcaaatgtctggagtcatcggggatgcttcataaagtgtggagcagacctagagaaaggttatgaaaatgtacaatgcttttccatygttgtagcttcatgcagacattatatatcatgaaatgaccatatgtttgagtaaccatttatatggaagatgagagagtttgaaagttcatttttttgatacaaagtattttctactcagtcgcagccttttctatctcagtatatcatcatttatcttgctttgaatgaacttgagtacatatagttgtgtgtatatgtatatatatacacacacatgcaaacacatgcatacacacacacctatatatacatctgtatagatgtatgtatatgtacatgtacacacaatatatatgcatacatatatacatgcatactcctgtatgtgcatatgcatgtatacatgcatgtatatatttatacatatgcatgtatatctatatgtgtatatctatatgtgtatgtttataagtataaaatgtacgtataaaattgcggataagatggacctagtatgcgactataccacttgtgtttcttttccatattgaaaattgtcaatctttccccatttctgtagaaaaaatgaatttacactcaaaaaagttgattagccatgttaatagtaataatgttcaatatctggaaattagctgagtacatcgatatacaaattagtcaatacaaaagtagtatatgaaaaagccactaaataacatggcctctttgtttattgataaaaaattccaaaagggaagtggagaaaatggagaaaggcaattgaatgccaagtaataatcgttataaccactgaggggtggctgagagtggatagtattgattggcaaaagaaagctttcttgggattctgaggatatcagtatcattaatgcacaaccactgagaaggattttaaaaggtgaggcatagacatcactgttagaaataacagcagggcattttttcaggaagctctggccatttggtcagtcaagagctattaatttcagtgaattctgcctgcataatatgtgcagcccctagagaggccaccttcaattctaaacctcaacattcatttgctgtcttaccaccttagtagatttctttttgggtttttttttttttttgccaaaatcttcactgcatgattttgcaggctcacatgcttcttgtttgccattttaaatcacagtccccatcaaatgcccattatctttaataaggtgaagcaagaggctgggtgcttggctcacatctgtaatcccaacactctgggaggcctagccaggaggattgcttgagctcgggagttcaagaccagcctgaacaacatagtgagaccctgtttctaccaaaaataattaaaatatacagatatagtggtgcacatgggtggtcccatctacttggatggctgaggtaggaggatcgcttgagtcttggaggtcaaggctgcagtgagccatgatcacaccactgcactccatactgtgtgacagagcaagactatgtctcaaaaaaaaaaaaaaaagatgcaagaacttgaatcaagaatataaagctctgcgtctgcaccacaagagacaagagtaattggtagagtttgtgttatcctttaaagagtgcttgtgactagcagatgctgagagaaaaaccaacatatttttcttgttcctcaagctactcattattatcttgataatatttctaatatttatttttttaaactgacatgctttaaagtaaatatactgaaaaaaaccttattcactgactgaactaagtattccatttagaagtgtggaattggggctttttttttttttcctcaacatgtaatgagtcagtgtggaatattgattattcatctgaatatttaaatcttgttttgtttttggttttgtttgcatgtgggttttcttggctcaraaaaataaataattgcatgtaaaaaccatttattctttaatttcagaagtatttattcagcatttcttctattcaaatctctgatggtattacatagcacacaggaattcaaatgcagcagagcatctaaaacataaccaaacagatgtgtggggcatgtgttatgctaataggaaaggctatgcacagcatcactttaaccataaacacgctccattaagattatagacatagacaggtaggtattaggttggtgcaaaagtaattgcaattacttttgaaccaacttataggtaggtagatagacagacagactagattcattcattcatttattcattcatttttctgaagaagtagcaaaagagagactgcaaaactttctaaaatcctctagaggcaaagccaacacattatagcacctgtacttcccatgctgcatcacacaccaaatgtcttttcttgctggagtggccccatgtctttctgctggaattcagtttagactctcttagtctgttctctctatccattatcctgaccaacatataaaggtgtataagccaagctgcccaataattatgctgtaaaacagtggttttgagtactttctttctttgtgtttttgatgaatgcacaataaaatctacatttttgtcattttgccttggaatacaagtaaccatctcacacacacacacacgtagacacacacacaactttcaggcccaggcactctcccattctcaatcaacagtcttgcctcaagggcatatcattcaatctcatggatggaaacatacctgctgtccactcccaaattcacgtcactgtttcttccatatgccccttttgagtttaaggctgtctgtctgacatttccacttacatgtttctcatgcaccctgatttctcaactgcaactgaattcttaattttcatatacctccaaaacggctgttcctcaatctttcctttttagtaaattcgttagctatcaacttagttgcccaaactggatgtcaaggagtctctctgggtaccccttaggttctcatcttctatgcaatctatcaccaccacgtcctgttgatttaatgtccaaaatacatctaaaatccacccacttctctccattttcactttttctcaaggctcaaggacttactcttgcttaacttggctcactgctcctcagggcgcagctataatgttgccttatgtatcagctatctcttgtcacaataatgttgtgtagcaacaacaaaacctcactggcataaaacacaacagtaggcatttgtcacatttgagtgggtggggttcaccttgatgactctactgaccttggctgagctcactcacatgtctggggatcatcgagctgctggctgacttaggatggcttcagctaagaagactgggatgactcagttctgctccatgtgtctcatcctcccataggctagctagggaatgttctcgtgggaatgacagaggcacaacagcacaagtagagatatcaagtacgagtatttgttcaatgctctggtgtgttacatcttctaatattccattggcggaaacaaatcacatttcttagcttgtgatcaaggggcagagaattagactttgcttcctgaatggagatctgttagttccataataaggacggggatatagagaggatgatgaattaggatgattaaagccataaatccaccacgctaggtcagaaaggcctttctccccaaattagagtctcacctctctcccatttatactctctcacagcaccctttctatgactccatagccatttgtttggaagtggtttttttttattattattatactttaagttttagggtacatgtgcacaatgtgcaggtttgttacatacgtatacatgtgccatgttggtgtgctgcacccattaactcgtcatttagcattaggtatgttatttttaaagaactatgtactacccaaacttgtaagcctcatgagagcccagagaaaggagctcccttttgtttattcactcacagagcctagcacaatgcctggtacattgttaagtgttcagtaaatgtggagtggaagacaggaatggattggcagtggaattctcaaggtgcagatgatatatcctcactatagccccaggctagagtgctgcttacacctgcaggtaaagataaggacttcagctaataaattggccctcctactacaaggcctctggtttcattgagccttttgggaaatgtaccagttcccgaggctgtgattgtgatgtacttctcaccctggaccagagtcagggcaggagtcagttctacaatgctgcattacggagagccttgcctgcctatttctgctggttacaattccattattacaggacccagtcaaagcagctggagaaactctactgtatccctgaaaattcagctgtcctttgaggagtgtaacctaagacaatgtgtactctggtaatgccatgttctgcaatatcttccatgccaaggttggcatttttgttagtaatactttcttatagtgcaaagaaaagaagctgcttttaaagagctgaatttggcacctcataatttaatagtcaaatcatttgctgtctattttcaagggttttcaggggaatttaagaaccaggaaggactgaaagatccataatactttctttttctagcaaattattaatgcaaacagcattagtacaattgaatacaattgcaaggaatcaaggggattataaatccaatgagagaaaaggcagccagaatgctaagagagccaccacccactgctccaccatgacccgccattccacgtcccatgctatcctccacacactagacacatgcaactcctgctgccactgggttgtgatccccattgtccttctggtcatgctgtttctaccgtctggaataccctcccccacctttcctgacagcccaggctctactcaacatctaggcactaggtataaatttaaaatgtgcaaatgctttgacccagtacatttgctttgaaggatttatcctcgggaaataattggagttgtgccttgagtttgcacggcaatatgccaggacatttgcagtatttacgtcatctccaggagttaggatctggtggtcaagaatgtggctttggcatcagactgccttgattcaagtcttgccttcaccatttgctggttctgtgactttggacaaatcatttaatccttttgcctcaactgcttcatacctaagatagaattgatatcggcaactaactcctaggtttactgggaagagtaaaagtgtcagtaaatgtgaaatactttgaacagtgcatggtgctcagtaagaactcagtacatgtaagcacctatgctttcaaatggactctcattcgttgagaatttttcttcattttcttgctgtagttgctattagtggaacggttagaaccttctctttgtattctttgcaagctttaacctactgttttagatatatttgatcttcagtgaacagttgttagtatgtcaagaaaagtaatgaaggttcttaaactaaacttaattttttatggaggaacacaaggcaatttgctaattcggggatctacttctctttcatgatagcatctgcagatgtcatgacagtttttcaagaccctggcaacttgataatgtggcccaaatagggggccaatttcattctgctatgagtccaatttaaacaggctcgattgcgtcaaaattagacttttaattatactttatctaatgtcaggaatcagtgttgtgctttagctatttaaaactttggctttcaattagaaatttgatagcaatgcattgaatgcatctcttcatcatgttttcagaatttaaatatctaacttttttcttctttgattaaagaggattccaatcattgctgcttgtatacaatgtaagttacatacgctaatgcctcttcagttttttaatttttttaattttattttttaacataccccttcatttatctatatacaaattgtgtcagaagacaaaattatttctgtgtttttcaaataaaaaatagggtcccttttatttttcaaggaatgatcttctttattaaatattatattataccacaatataacatctagacattgggagggatctttgaagatggtggaagacagtcttgatataataagattgaagatgaaaataggctaatagaattgcaaccgattatactgggtgtacccactgctatgctgtgaggtagggatcaatgacaaagctttgtgtacttccagagattggaaatatctatacaaagagaggtaaggagtagcctttccttgtaaaagtagaattgattccatattatatatcctctgtatgtccccgaaatagaaggtctgctcccatgagcagcttctcagaacataagaagagcatctgggctgaaaaaatgtttcttgtttcctccttgttacctattctttgtatagatccggggtttcaacgtaaaggtcatgattttatctcctcagtcatttgttgctgggcacaatttgcctttatggcaagtgttgttgctagttcttaaaactaccagaagagatacttaccctcctgagcagacagaagctcaggagtgccacaaagatgaatatagattttaaaagaaatttaggtaagaaactagggaagtgataaatcatggccccctgttaaacagaaaactcattaactggaatactgcgttctagttaagtgacattttactatccttttttgtacatagagcattacttctttaataaaaggattacagaagcacaatataaagagggtaatttaaaaatctctaaacagtgaaaatactactttttacgctttgaaatggctttttatgtccagtccgagtgacacttttcttccttagtaaaatcagcaggcacttccaggtggctgaaatccaccctgtgcattgttgctgagaacatttatagcacattgttcagattagaatagctgagaacgacagggggctcttcaaatgtgcctcatcgagtcccaaattggagatgtgtttttgtcatttcaaagttttggcagtagggtctaggattcaaagcaaacaccagctcctgcagaacacaagccttaattaatttccagcaggaaatgagtgattgccaataagccatgaattaaaatggaatggttcaccaaaaaccaggtcctcatctcaaatgaatagcatttcttgctgttttcttgaaagatcatctcagactaagaagtgagcaagctcctatgacagctctctgtctgtaagggggtagttggtatggacaaacaccaaacagtaagtcctggcccagtaaaaaatggggaccaaatctgatggactcaagggcattttgtcagtatctctatcatgtagcctgcaatttttatggagaatctgtctatttttctggcttcattatttatcatgttgtcattaagattcagtcttgagaaggtccttaaaggtcagctgttttcatcattcagtcagtgcttacagtacactggggctacttctgccaaaggggtgtccagttgctgcttgaactcctcttgtggccagaaactacccccttctaagagaagcctgtttcatctctgagcagctcagccagttttcattttttcttaaaattgagcaaaaacgaatcccctgttgcttaaatccattgagcctggtttatccctgagggccaaacacaatgaatcaaaaaccttcttctgcttgatagctctttaataaaaggggaaggcaggtctcacactccccctgaggggcctcttctgtggacaaacatctctgagcttttcctatcttctttgagagtgctttgtgtgtgtgtgtgtgggtgtgtccacttgctcttatgtaaattctaattactattgtaataataaatagccaatacatacagaatgcttccagtgggccaggcagtgttctaagtgctcccataatcctcacaacaactgtatgaactggttactaggattatcccattttacagagaaaaaatgaggcacagagagattaagaaacttgctcaccaggatctgaatccactattccacactcttaaccccagcactataaagtttctcatgtcctcatttgtctatttcagccatacctgtcctggagacaagagccattgctagttttctatggggaactgacattgctatcatctactccacactggctatatgctaggaactatagattagttggtctgattaatcctttgaacagtcagcaatcattgtttttgaggatgtgttgttgttattgttgtttggtccagcacttccccatactatccccattaatcattaattatgttgttaattaagaacacctgtacttaactcgtggccatttattccttttctagaactatttattgtctatattttagagaaccttaaatatgaaaatggttaatccagaattttttgcttgggccaagcaagcaaaatgcattgctgctttatgaagaagaccttcttttggtaagaagacagtttttcatattttcatagccagcaattaaaaccacatgagacaggaaaaccttcaaattctttctgagcaaaatactcttcctagtgagaaatgtgctcaaagtggttaaagataatgggaagcagcagaattaggatttgaactcgtgtgcttctgggccaaaaccatggagttcccattttgcaaacacaccttggggtctgtaaccaggtgcggctccctgcaggtgccaaccacctgtggtaaaggcatgatgagtccacttcctgtaaggctcagccctgctagtcgcgactagcgccctctagtggtccaagagaaagggtaaggtgagttccggtttatgatttgacttgaggcattcggaggctaaacatccacaaggttagttccctgaacccctataaaccttgctatttatatctcttcctcaactctgaggccctcaccctacatcggctgcagtacagattcagcctttagcgacggaattatgtactgaaacactcatttctgtgccgctgcagtggttagctttgatttttatagagatgcacatgagaaaacagtctgagcctggagagtgacttgtgggctgctaaggtaaattgaacccatgtgtgtggtatcctcatgattgggagcagcagcagatggtgggctaggatgcctccagaaatgggcttcggaagcataaaataaggacttgttctcttacatctgcctctgttggggtgtttaaagaattgttgggattaatgcatttttcatttgaagtttaaacactctcagaggatgtttagccgatggactattctcattatagaatgaattgcttcactgggttgcactttgcaaagattggctgcagggagtaagtgatttgttggaaaagaaggagcaaaaaagggtggaaagagcaaagactcagtgtctcagacaagtcttcaacttttcctctccatccaaaatgaattcattatgactgagaggttccagttggactcctggagacatttagaagtgccccagaaatgccacctgcaggtcagtggtcatgtcaaactagaatcttctgcacaagtcaaatataagaaggaaacttgtttcatttgagtcagatttacttaagttttggattgactcctagatcggcttctcactttgggcaagctccttaatgtctgcaatccttgttattttcatctgtaaagtggagcttgtgatgcttactttgtgagatgtctttggaatcaagcgaagtaatgtctgtaatgcgaatagcctagtgcaggcatacaacagatgccccatctaatgggattatattaaaattattgttgttttaatattggttatgaaaatattgcaaagtgaatgaagaactctccttttacccaatttttttgttcaattttgtacgtgaacagtttaaggaatcttttaacggaatttttaaaaacacttggaggcggtgactctttaaaagctaaaccatgaaatgttaccatcagaaaagagctgctgctgccatttacaagcattaaccaaatcctcaagaattaagctagaactgagcacattcttaacaaggtggtttcgagttttcagatacatctttatttcttcagctcatttgcaaatacttatctctgatttaaatcattcaaatgacttcaggaacacaatggaagcagagcagaactaagtgtttccaactgtcaggtctggtgagggatgatgtaaaacgggacatttagctggcatcctgcatagtctttaaatagaattaacaaaagcttccacgtttcaatggctaaaggtagtgtttattgtaaaggcagcatgcctggagacctaagagtgggagtaggggggtgggcatgggcacgtgtgggtgcaggcagggcattctgaggggtcagttgaaaggctctgtctctggattcagctttaactggttctaaaataatgaagcagaaatgactttccttctctctctggtgtcagcttcaaatgaattatggatactgaacctacagaggtaatgctgattaaataattgaacaatccattgattaactacagattgtcaattggaataatctgtcgacgacctgactgcccacctttagcatttagacagtattttaatgttaatgaggttttgaactttttgtgcttttggtttggtgggggttttttttgttagtttttgagggtttttggtgggttttttatttttggttcagcacttccccacctaatcccaattaatcattaattatgttgttagttaagaacactgggctgggcacggtggctcacacctgtaatcccagcactttgggaggccgaggtgggtggatcacctgaggtcaggtgttcgagaccagcctggtccaacatggtaaaaccctgtctctactaaaaatacaaaaattagccgggcatagtggcacgcgcctgtaatcccagctactcgggaggctgaagcaggagaattgcttgaacctgggaggcagatgttgcagtgagctaagatagtgtcactgcactccagcctgggcaacagagcaagactccatctcaaaacaaacaaacaaacaaacaaaacaaaaacacctatacttgacttgtggctgtttattccttttctagagctatttgttgtctgcattatagagaactttaaatatcaaagtagttattcctgaactttttacttgagtcaaataaacaaaatgcattgctgctttgtgctttatgcagaagaccttctcctggtaaggagacagtttttcatattatagccagcaattaaaaccacatgagataggaagaccttattctaattctttctgagcaaaatacttgcccttaatttattatttaataaacacatatatagcacttaccatctgccaaattatttatattcttttaaatattaaccaatttaatcttcatagggactttctgagtaaagaactatgaatgttcagccgggcgcagtggctcatgcctgtaatcccagcacttcgggaggccaaggtgagcggatcacctgaggtcaggagttcgagaccagcctggccaacatggtgaaaccctctctctaataaaaacacaaaaattagctgggcacggtggcaggtgcctgtaatcccagctactcgggaggctgaggtaggagaatcacttgagcctgggaggcaaaggttgcagtgagccgagaccgtgccactgcgctgcagtctgggcaacagagcgagattccgtatatcaaaaaaaaaaaaaaaaaaaaaaaggacaactatgaatgttcctgttttacagatgagaaaactgaaatacatggaggctacataacttgtcagagatcactagtaagtggaagaggtgggatttggacccaggtagcgtccatagcttaatcagtgctctctcagtactttttggtcataactcttaaataagtgtaataataataaaaaataataataatgtctgccattcatagcattgtacttcttctgcctttgtagtgtagttcattttgaatcccagatagggactcatagatttttttctttttaatatttaaaaaatctcagatttgttgacttaaaatccatatagttttttttttaaatgtggacctagaactgagtattattgggggaaaaaaaacattgtaaattagtaagtagtgtggttcatgggatcatcaactgttagcgctgggaggaatagtatttttctgacccattttattttgggaatgaagaatctgaggtgggagaatctctggttttatacaacagtaggttgcccatggctttctttctgaggagactgggggagacacttggataagagaaggacttctgtgaacaagggggtatgcttttctaaaaatgatttgattaatccttgaaaatatccttctacgaggcacagagggaaatcctccctacccccgaataatgcacaagaccttactggtctacaaaggtcctgcagatagaactaaggacaagagaattcctatgccgctgtaatggcctacataggaaaagcattcttcttgttgttgaataagaaaacataacatcctccagatttctaccagtgtttttcttatgactggaaatagtaagtagaacaatgtcatacttggacaactatattcaaactggctaatagttttgttaattgggactacaaatgagaaatagaagtcccatgatgacctagtccattgaagtgtcaagtttaagtctcctagttcagaatcaaagggagcagctatagggtgagaagcaatcgcgtccataattccgttgacagcagttttcttcgggctttgattcatagctcatctgctccctgctgattgccctgagctcagcaatgccatgctggtttccatggtgctgatttgcataccaaaccaggacttgtatttttgtgtttgcctcacacatttccagtgctaagtgttcttctaagaaagggattagcacgctagccaattaagggagtttgccagaaataaagcacccagggaatttttcttcaggttatatattgctactgctatgcctaagtactgatatggttgattggttttcttaggtcagcaatgagtcttaaagataaaatttctactgtgtaatctttagtgttttcttttttttttcaactatcttttaatcagtttcaaacatttcagtgattaaaagagagatttgttgtggttttgttgtggagcagaaatggatttcaaggagtttaccttcagagcttttgtttttgttacggtgggtctctctagtggaaaaaaaatttccccatccctttggaaatattttctttaaaggaaatcatgtttttaaaacaaattatcgaaatcagctttctaatcaatttgaatcatctgaacaaaagctggaaaatgtttagttgtaaatttcaccaatgaatactacttagcaacacaaagttgaatgaagttcaactgttagtcccaagcttatggatcaatctcaaaacatgatgctgagtgaaagaagccttttaccaagagtatatactgttttattgcatttagatgaatttataggacaaaccaaattaatctatggtgaaaaaagaaacagcagttgcctctgggtgctgggacagggatggcctggaaaggggtatttgggggctgtctagggtgatgaaaatggtccattaatcatcatttatcttttgtttgttttgtttaatttccatttttattttagattcaggggttacatgtgcaggttggttacaaggatatattgtgtgatgctgatcccgtcacccagatagtttttcagtccttgaccccctcccactctccctccttttggagcccccgtgtctatcgtttccatcttgatgtctgtgtttacccaagattaactcccacttataagtgagaacatgtgatattggttttctggctttgtgttaatttgcttaggattaaggcctctagctgcatccacgttgctgtagaggacatgatttgttattttttgtggctgctgcatagtattctatggtgtatatgcacccccactgatgggcacctgggttgatgccatgtcttttctgttgtgattagtgctacagttttatactactctcaccagcaatgagtaagctttcccttttttctacagcttcaccaacatctgttattttttggctttttaagaataaaaaatggtctatattttgttaggagtttaggttatgtgtgtgcattcatcaaaacttgtaaatgcccacttgggatgtattcatttcactgtatataaattttacctgaatgtaaaaaacaatctgtaaaaataatgttcttcattgtaaaatctagagtgatcgttatcaaagacttagaaaaactagaaactgagaaaaggtggtatgatttgtggcagttcaattggcagaatttagaaatcatgaatagatatgtttattctgctatttcaaatacttatgtgaatctctagagccatgtgggaagatatctgcttcctgaagctctgcattcatttatagttttatgtggtcagggaggatttgattgagttggaaagtggatcatttgtacttcactttgatccatcttcctttttagaaacgagagaaaaggcatctgtgattgtgcctctgattgggtggcatccaaaatcttgtttctcagggtgagcttarggttcatctctattaaacgtatcatttgtcagacattggcatgtctagtgattcggaaagcccttggagtagcacagaaatgctatcataactccggagtgatcttttgcccttaccagtactttggcttttttaagttgccacttgaacttgggtaagaggccaaggaggtggtggctgaggcagtcaaatcttgtggaatgtggctgtcaattgatgccctaaagttaaggttggtctgtattccacaattgacaaaaacacatatacagttgtgggcccagaattggagtgatgagaagaccttgcataatgtctacacaggaggagagcaagcctttaaactccaactgccttgtgaatgttcttctcttttgatgtcccctcttccctctcactgctcaacctctaagtccatgctgcttgcatatacagataacggtgagttgcagatgatattataggtggcctatccagatccatgtcacctggcctgtgcttttagagccagctgctgtgaggattagttgggaagactcacagctgccttcactctcagagagttatccttgattgctggaagttatctagccagggttggttatagatctacccacccaccaatgacatcccctctccccgcctcctcacgtccgcttctcaagcgcgcatacaattcttctaccccgcaaaagcctacaggactatcccattcccacagttaggaatgactccatggtacttttcatggtccagagctctctgtgggatcaggccaaaaactrcactttatttatcttcttcatgaagatggtgaagaatctcaacagaccttcaaagagatcaaggcttgcatctaagacaggatcaatgattgcctctaagaagaaattacacctggatatttgggtacctgtaattaggtgttggctatgttaatgttttgcctgctgtgaagctactgcatgcggtgcttgggtagtgccactcttcttacatgaggcagaaccaagaggaatgaccctcccacatagtaatgaaggggaaaaaacaaggcaaagcatgtttatttttaacattttgctcttcttaaaagggcatcgtttacacccattccatctgtagaactttcaacacaagggacacatactgaagtaatataaactctgaccttgagttattagaatatgccagagactttgtagttcctgagagccacaagcctccatcttttctctatagaaaaaaaaaaaggcttaaatcattggtcagctctcctgtgcttgaaattgtcaccgtttgaagagtggctgtccttttcaaaatatttggcattatagagtcacagaaaaagtgttaactattctgtgcatttacttatgttgaaaatgatgtcatgtatatttgtatttaataaaatgtgaaaggaaaggaaaataagttcttttcaaaataaaattttggtgccccggaaggtttctcagcctgcctgcagcatgagttttacttaaagcaaaaagcactagcattttttttaatataatgggatgcaatagaagataactatatcaatcacctatttgtaaaatagtgctgtgtaacaaactatctcaaattaaaataattaaattagctcaggtatttttagtttgtcaacatagactgggctcagctggcagttcttctggttctggctgggctcgcatgtgcctggcagctggctggtgtttgagatgatggagacaatgaagctacatggttctcattctccagcaggccactctgagcatgttctcatggtggtgacagaagagcaaagatgagagcaagcaaggcacttacaccctttcaagcctccacctgtgtcttacttcctaagatcttattgactaaagaatgtcacctagtaaagcataaggtcactgtaggaggtcaatacaagattaatgatcaaatatgtgaatgctgggaggagcaaagaattggacacattgagaaaatctaccttatacaagaatatacatacataggaaattttattaagtgaaacatgaaactcactagctagaaccccaaagctacaatgtacttcacattttctctctgttttctttccagaatcttgctcctactcactgaccttgacctttctcattttgaacacttcatttctgtttcttggaatatctgtttttcttttctatccaaatccaaaatattcctcaaagcccagctcaagtttatactttcctggaagcctaatatctgtgtcattgttcaagtttgtttttatattactttatagtcatgattatttttatctgtataacaatgtcttgttgcttcaatgtagtctaagctccttcaagtaaggaaccatgtcttatacttacttgactctcccgaagtaggcttattgtatagtaagagtttaatagtaagttgattgacaggtagttccattttcaaagttctatgctaatcccttttttctttgtctctgccaacattatcttcctctacatctgagatggcatctcgagagtcatcttcagtccattagtaacagctgtcttggagaattatataaagaacaactctagccataactaggaaagttggaatgagagctaccatagattagtaatgtctgccataaatagaggaaggggataggccattcatatttactaccaaaatagttcttaattttttttcggagttgtatcttatcttctaagctcagtggagaaatagtaatgatattcattgaagggaaatgatagtgatggcaaaatatcagaatatatgtaagaagccatatattcaggaaaaatcacttaataataggcagtattatgcccacagaagggctttcagccaacagacttgacttcaaattctggttctgctgattactatcactgtgactttaggcaagctatataacctttgtctgcctcagtttccctatgtgctaataaatggcaccaaatgagggttgttttgaggacttaatgaattaatatactcaaaacgcttagcatttgtcttggcccatagtaagcactgaataaaatactagctactattttttattaagtagtggtaaaaattacaaataggtaaaacatacctttaaagttaagatacaatgtaactcctccatttgaaatcttagatgagggcagttgatgagaggaaggggaggtgagtgaccctgggcctaacagagagctaggctattcctatgataccaggaacaactttgagcaatgattttgccagctacyggcactttatttcagtcatatttaattagagacacagagccactaatcaagattggttaccggatttgaccttatgcaattgtggaagctattaaacagtccctatgagtctgtagtcttcacatctgaggatggagctcaaagccaacagggaaggaaggatggatataaagtgggggagagcaaggcaagctgggctcatgagctagagccagaccttaggagaacagactggaactcaggtcagttcttacttcttccatccttggactaagcagggatcctgtaggagaagctggctccttcgtcatggagctgaacatatgtctgaccgaggaagtaacatatatgtagggacagaaaagggtgaagcaattgcatgcaaaataagtgagccaccaaaaaagtgacaaagggcacctgccctgacctgagtgggaagagaagtggggacactttagtttgtttttccagattttctgcaaaatgtctcttgtggctcatggtaatcataaacagtgggaaatcttgttaaccctagttaagctgacacattttgaagagtcaccatactcctctagtgaccatgtggtacaacagaaagagaaataactggccttcaagtcaaaagatctggaagtgtaaccttggccaaaatcacttaccctttctcacttgtgttcttgtgttcttagttttcttatgtataaaatgagggaggaaggtgggctttttcatccttaaggtcccttccagctcttagtctgtaattttgtcaccttactgcctactttcattaagtttcttgtgtctgccggtcttgcttacatatttcctgctattctgccccaagacagccagccaagccaaaatgagcgtaggcaagggaaagaagcctgagtgtttgcctaaacacttagggctgctgaagtcagatgctgagggcaaagggcaaccgtaagtgatggaattaaatgtttactgtgttaaccgttgaccactcatggatttcagagaaagctgaccatattgattggagttttcactcctgtttttctaatgatatgcaatcttaactaaatctgccagctctcagggggttgaacgctattcagcaacattaatttctttgcctacttccagttaccagcaattataatcttggcagttttactcaccttgaataagcacttgtatgctttattgatatctggcagagctggctccttccatgcaaagacccacttatgtttctgacactgctaactctacaaagcgctcaagctgcagatcaacatttgttggacattctgggggaagatgttatttctgaatatggcaggacagaaagttccaagaaagctcaaagaaattgtgtttatatgctcttagacacatttttttccatcccctcccctcaaaatcagtgaatgagccagtcctgaaagacacttggcacagtttcacagtctcttattgacaatttccttgctgggaattcacctagcctggagagagcgatcttgcctgtaatgactccttctttatagcatacaatcaattagtgcttatccaatatttaagacccagcccctcacgccaattcaggacagttctgttggtcagtctcaacccggagttcccatgagattggccgagacttctatggcaactgtaacacagccaaacttctgcttttaccccaactactcccttccatagttattaatcccagaactattctctaataaatgcctatatacaaacccctatctccgggtttacttttccaaggaatcagtgatataactgccatgacaatgaaagagatcaaaatttgggagacagaaagacgaggggtgggaagttgaatwtttttcctcatttataacatgatctggttgggaggattcaaggcagaccagttagtacagatccccagtcccttttggggatcataggactcttgttttatcccctcacggcatttatcaccttctctcataaaaaatttatttatttattatgttttatgttgtttgcctactttctgtctatacccaccccckgcccagataccctcaaacaagaaagtaaaacccaccaagatgaagttctttggtttgttcaccagtggatttcaaacacataatagatggcaataaatgctaagtgaatgaatgaatgaatgagtgaatgaatacagtcagggagaagagctgggaggccatgacagtaatgtaggtgagcagggatagaggctgaatgacatcaaagaatggggatgagaagtggatagagtctaaggttttgtggataatagaatgcataaaagtgctttagaaacacataaagttctcacacttgagggtacatcagattcccttggagggcctcttaaaacacagattactgggccctatccccagaatggatgattctggatgtctgtaatcaaagtcccgtttgggtcattatttattttagcaacatccaccatcatagattgtgagccccatggtaggaggggctgtgccactctgatcacacaggctgtctttcatcactagtggagtgtttggcacaagctagtactcagcaagatttgttgagtgagtaatttacacccccccatccccccracacacacacacaacaccatgcaaatctatgcaatcagggcacttgcaaatccttagtattatcaaaagaaaaatgcaaattctaaggcattcttatgccccagttttgaccagaattgacctgtgaagatgagctcaacatccaatccagattattcttagtgctgttcagagtgggaggatcaacagcctctgctggtgtatgctctcactaatcattatccttatttccagttaataaggtttttgtctattttattcattgtagaaataaagaaaagagttagtgttgaccttgtaaccataaagcttcatagttttaaagtcaattattaaataacccattcatctttcttcttttagtttgtttgaaactctctttttttaaaattattttctcctgggcactactggcaacatttatttttcttccattgagaattcattaagaattatttcttttcttttttttttttggaaatttatctaacatctcaacttctttattggaatacagagaccaacactgaacttggaattcataagtaaaatggcagttacaaccagatattatttctcttaagccttatctctgtgatgcatcctagtattcataactaggtcttaatcaaaaaattattttgtaaatttttagacagtgtatgatgttatatgacttctaggacttaaaagtcttttgacttttaaaagtcagagatatgtattttcctttttgaccttacagtctaccacattcattattaattcctaacctgattttctagtgggagaagggggaggaatgaaactttcaaataatgtaatgcacctgaattaagaccattttgactagtcaaatgcagatatgcagatattttaggccttctgaacctttcatttcatagaaatagaaattgccccccccctttttctttggtagtcatccagcttgtttctctgttgtacaaataaaacagaaattaggacagcgctgagattgttttattcatccctgagttctcagaggttagcacaataccttccacatagaagatgcacggaaaatgtttgttgaatgattaccaataatgaagttttattatcatttttatccaagggcactgtatttcattctgtctatacccactcctgtgtttattttttttgggttgtgtgacaatattatgttcctggaaaagcaamtaagaaaaaattgaaaaaataaatgttttcagtgggccaataagatggttacttttgtgcatatttttgtggtctgatgttcaaataatacaatagtcagagaataaaatccttaaaaataatgatttataatctattaagtgtcaaaagtgagagtagtcatcccttcttacttttataaaattgtcactcttttttgtttggtaaaagtgatatctttttaccagcccttccaacagctaattccttccactgccacttaaagtagtctgtgtttagctgtattacatttatacctactcaacttatcttttagtaatgtagtgtgtattatatataggcacccatacacatatgtttaattatgcaatgactgctttcttacagcttctaggacatgggtcttagagtcacaaaacctagtgttgaaatcttacttctattattgcatcagttatttactgccaaataatgttgcataactaattactcccaacctcagtggcttacgataataagcatttatttagctcatgtatctgtaggttggaaatttgagtggggatcacctgggcaattctggtcttctgggctggctcactcatatgtctggcgagtagctgacttctgtgatggggtgactgggtcatgtgtctctcatcatccagaaggctagcccaagattgttcacatggtcgctgggcagggctctgagagagagtggagagcatcaggccctttgagacctaggctcagcatgacacactgtcactctggtgcattcttggcaaagaaaaaaaaaaattgcaaagctagctagaatgaagactccactttttgaaggcaaatggtgttgagtacaagaaggagggggtgacttagggccatctatgtagtccaccagagctattcacaagctgacttggaacagtttattccaaccttggctagataaacaaggagagttcatgcttttctttttcttattgtgaccccatggagggtgcattactctagtgaaataaagattctccttatttaccaccaagacatgggagtgaaccagcatacataatgtcactatccaacactgggaggaaaggagaagcctcttggggtggggggaagggggagggatagcattaggagatatacctaatgctaaatgatgagttaatgggtgcagcacaccaacatggcacatgtatacataagtaacaaaactgcacgttgtacacatgcaccctaaaacttaaagtataataataataaaattttttaaaaaaagaaagaaagtgtttagcacgaggttttgggtgaakaagatgagacatgtgaggtccgggggcatggcattttggctgcctagatatcccaggatttaggggaatgcataactttctcactaagtatatgatgaatgagtaaatatgcttctctatatgttgttattgtgttgttgttaataaagtgtgtttttcacactgtaatctttcagagtaacacagactcatatacatatgaaattgaggactgtgggtatcaactacaaaacatccacgtaatagcagttaatactatttgttacatgccagactcagttctaggagctcccttctggtaacacagttaatttttaggaggtaagtattaggtaatataaacttccctattttggagatgaggaaattaggttcctagacattaattgtgtgtcccgaagtgacacagctaataaatggcaatggcaagatttgccctcaggcaggaaagctccaggctcagaaccctaaacccctattctacagctgtggcttcagttagggtttccatatgtggtcactgttgtaattctggctttcttcctttgaaccaactctcaggaaaaccaaaccatgacttgcatgttgttccatgggtgtttttcatccttctctggctttgtcttgacaaagtcatttggtacatatctaataagactttcctttgccatccattcacgtgtcatcaaggaatgcaaaacagttttaatgcaaaatacttgtaatattaggacagaaagaaagaagaaagaaagaaagaaagggagggagggagagagggagggagggagggagggaaagagagagaaagaaaagaaagaaaaaggaaagaaagaaagagagaagaagaaaagaagaagaggaagaagaggaagaagaagagaagaaaaggaaggaaggaaaagaaagaaagggaaaatagaaaaggaaggaaagaagaaagggaagtaaaacagggagggagatagagaaagaaagaaagagagagaggagaaaaaagtataatggattccaatatttttctgtcatcctcaatgttcggctcatactctgtacttctgtgttagcaaacataattgaaataaaccgtttaggtagtaagctaattctgcagcattcaaaaaagacagcgtgcaatactcacaatttgcaaaactgttctcctttttttgtttgcataggtttatacatgttccctttttatagcacaatgtaaacacatgtgagaaaaactgatttgaaatagattttaaaccaggcagcccttttgctgtttcctaattggtattcatcatacctcttattgttgtgttctaagcatttcgttcatttgtttttcagtcctcagtttcctcatataaacttccatgatctgctgcctaagaatttggtatctgttaatgaaaatcaacttttaaaataagcattcttcctgccctggcaattaggagaacctttgaagacattgggggagtgatatgggtcctgggatgggaacagtaggattctgataacaagccaaagagatcagaaattcctttaagtattttaccggtacccyatagtcctcaaaatcacatacacaaaatatcatgggtacagatcaacaacaaacttagactggctttataacagtgcaaggtctaaaactttgttaccaagtcaccaaaatattcccaaataagtaaaaatcccacattaaatgccaccatcctttgtctcctctctcccccgcattgggttctggaggactttggtcatcatagccgacatgtcagtgtcccctcgatagacattcccttggcatgcagtatatactgctagcatcttgttataagtacctgtggctttctaagagatttctctgggttccacaatgttttcagttacatgctgggcatgctgaaagtatcaaggaattaaagcttctggaagcagccgtccactagttactaagggatttgatagaaaaataccccaggtccatcaggttttagtaggggcggatctgaggcatgttctcctgatctagaattccccagcagaactgagcccccattgccaacaatggttgcctatttattaatattctttattttggcttctttctcttcattgtcttgtattcctgctcacctgtcattgcttcctggggttcctttccccagataatctccctccacttcagctctaattcagtgtgtttctgggaggactttatagaagacatctaccataatattacaaaaattaaattactgaagctattcaaattattttctgatattttcattctgtccttttcttacttctatcaacccatccccatgtgtcttttttccctgcagtccaagattatttagccccatcctacaaggtcaagtattttatacaccagctaaggagtaaagtgtaaaattttwaaaaaaaatcagtaggtagaatattacactggaatcttaatagttcttgctgatagtgcccttaaggttaaaaaaaaaaaactcattaaattccaagagagaagatggttataaaaactgaatgaaaagatagaagttattccacaagcatttcttaaattagtttgttaagagccttagatcatcagacatcaagtagaaaaacacttatccaaatctacagaaagcatttctcagaaagtgaaagaatgcagaaatttacttccaaagttttgaattaaacatgacagaagaaggcatcaatttggaaaactttctcagaactctcccttgcttggtagagtgggcagcttacttcatctgtcagaggaaaggaagtagctgttactgaccagacgacatgtgttgaattgtttgaggctgtaccgcatgtcaagctttgacasaactgacataaaaaatatacctcacattgtgttagaattgaagagaacagctcttgttcattagaaggtgaggctcttcaaagaagcttcctgatgcagcccgatctccagctcacagaatgaaaagggtttcctataaatctcagttaactgattgctttggagacacagtcccaagagggatttgaagccagcataaacttgattatatgcacagcttgcgggatttggtcattctctttctttcggatatgttttgtgttctttctaaaatatagtcagtgatattttaagttgtttataaggtatttataggaaaatttatttataaaatacacaatgttccaattatcaattgctgtataacataacatcccaaacttagtggtataaaacaataaccatcatttgttgttattatctattgtggttctgtgggtcaactagtccaggctagataataatctttccacgtccctcaggaatctgcattcagaggatgcctggggctagagcatctcaaaagcttccttccccactcacatatctgttgtcttgtctagggagacccaaacagctgggcattggtgtctattcctataaactctctccttatggcctctccagcaggatggattcaggatagtagggcttctcattcggaggttcaaggctccaaagattcatgtcctatgagggagcaccaggcaatagctgtgttgcccttcacaatctaggcttctctaggttagaagcaagtcactaaagcagcctatattcaaggaaggggcatcgattttacctcttgatggaagaattgtcaaggaatttgcagactttttttaaccattacatttaatgattacctttcatcatcatagggccttattggtatttgcaagcctagttcacttaacctaataccatgcttagtcattgccaaaaaaaaaaaaaatctggctaatttaatgtatcaacaattataatatagtgatgcttttactaatttttatgctctattcaactatcctttaaaatatacttatctagagggaagagttaagtgagaaaactgaagatttagaagtatgatgttgatttctaaatcaagaaaaacatatgtactattgctttttcactgaattaaactgatttttacagagtgactgctataatcataacactgggctagactactgtgattaatacaggtaagtaaagacggttttaaaattatgaacagaacttagtcctagttcacagtctctaaactggtaggggtgtgtgtgtgtgtgtgtgtgtgtgtgaaactacgtgacaaggattatttacacaccattatagaagtcacactaattaaatctaatgaaagacatgtattcagttttgatattttccgtaagagtcaggcaaaagttcccaacaaacttctaaatctataatcaatccaaaggaaattataaacaataggctttgtatagagagagtaggtgkatcatattaggcaataatcacatagttgatttcttactataaattatgatttatgtatcataaatagcatacaaatgtttgttaaatgaatgagatcttacaaactattactgggaaaatctttaattggcagctcttctctgatacggggactccaagggtccttggaacctggggactggggacttcctgattattttcaagtagaagtgtttgatttatagttgaaagagaataagaccattaatgttctctcattttttttaaataaaagtgtaagctctgccaaggggcattttctcattggctttcagtgttattttggtctcatgaattcataaacatcagcatctctacctatttccaaagaaaaaaaatttacttatgctcaaatccttgtcacagccactgcttctagggaaacataaactaaggcagggtgattgcagttctgggtatttgaaagaggttcttatggatttttccatgtgggaataacgtctaagtaattttccaagaatgaaaatactaaagtttttgataattaaagatactgacacagtacagacacaaacaggtttttcgggtgcttttcttgtgaagctttgcatttaaactgaagttttattcatgtaataatcatgcccctactattcgcaggagtaggaataatgggagttaacaggtgaggcagaaaagaaaggacatttcagagatgctctgcaataaagaagtgactgaaaactatagcactggtttttcttggttggatgaattaatgcacattctgaaaaacagtgttttagatttcaagttccaggtcttccagaaggagctatcatctgagctaagattgatgcattctagaccattattctggactcttctctgataagcccatgagataattttgttgaggtgtgatcatcccagcgttttagttatgtttcactggaaaatttaaaatattttaataagcaacatttgtttgggagagatacactgtccctgaacttggcctactatgatgggaatcctctgttctgttcaaaggcagttttctcaggcacctatggagtcagagactgatgtgacacttaagtggtacttactatgttccaggtactgagctgagaaatttatcatgtattaattcatttaatcctcacagccagccatttaatcatttcatctattttaaagacaagggtcaggaaggttaagtgacacgtgtaaggccacacacatatgatttgctggaacttggattcaaacctgtctgtccttagagtccatgcttttgtgagactccacctctggctgttcctgaggagttcctagttaagygggaatgggggtgggcaagccagtgatgacagggttaggtggatactggaatattcaggaagtgccagaaagtacagaggatgaaaggcttgacttcaccttggatatttaaaagctccagaggacaacaccttcatttgaattggaaaggacatagcccattggaaaacttgttgtttccagggaacaaaacattttagactattttgaaaatctgtatgaagctacaagtacttgtatttggttttataatctaggtaacagtaattaaaagttgattcttttaaaagagatttacccttcgaggttgtttaagtaaatattttgctctctgttaagtgttcctacttggaagtgtaaatatctgcaaatgtgtttatgtgagtcctctaacttcagaaagagtcctawcctattttcttcaagctcttcatactaaatattaattctctgggaaattatatagtgatatattgacctctacagaatagattcttcatataaattaaactatgtggtttaattttctgttgttactcatttctttagcttgtgagtgttcacccatgtcctgagtgtaagattgtggggctggaaggtttgcattccagcccagcgcttacagcacagcacaagctgaaggccaaagaataggcgattttcagttgtttttaagctttctaggaatgataggttatgatttcccttggcctgtgatttacctagtttcataaaaagtatattttccttttttatgactgacaaaattgttcctagtgtaagttacctgctttttccgaaaagtttgttggtgacttagtttaactattaacccatgaagtctctgaagcaacaaatgcctattattaatcatgtattttgtctgggaaacccccaatgtcttttacttttttaaaagaaatatgtataagtcaatgccagattgcatcctcactttaattttacttctatgaccctccagaattttctcaaaagtagacctgcttattgggtctgaaacaccacactgaaacagatgctgatacttgctagaatgttgacagggctgctttcacagcgtccaaataaaactgacttaaactagatggaggttttttgttttttgtttgagacagggtcttgctctgtcgctcaggctggagtgctgtggcacaatcatgattcactgtagccccaacttcctgggctcaagcaattatcccacctcagcctcctgagtagctgggactacaggcgtgcgccaccatgcttggctaagttttgtattttttggagagactgagtttcgccattttgcccagactggccttgaacttttgagctcaagttatccacccaccttggactctgaaagtgatgggattacaggtgtgagccactgtgcctagcctgtttgtttttcatattaagttctgaaccagagggcagtttaatgtgaccctactccatttggttgttgaggtgtccaggcttcttttatgttgttccgccatatgctaaagtacttgtatgtctgaacatgggttacagcaccatgtcctcattccagttgtggggagggagaagaaagtgggaggaaatttttcccttgaaggacataatgcagaactttcataaatcacagatgttcacattctattttggccagaactgagacagatgcccatgcttagctgcaagggaagttggaaaatgtagcttaatgcaagagttcaaccaacagactcagaagttgctcttgccaaaasgaagaaaggaaaacctgggtattggaaaacagcctctgccatagaaggcctctaccatagaagscttgttagcggcctcttccatagaaggcctgttcatcatagctcagttcagaatatcagggtcttcctaaatttatgtcatgataattctaatttctaatgtttaagttaacttttagttcacttgtgccttcaggtagttttctgagggttttctggctgtcaatttatttctcacattgttgaaaattatgttatcttctagttgccaccatagaaaattaattatcttgtagttcatttcactaactacaaatatatattatataatgtgtacatatgtatagttatatatatatatacacacacacaaattagtgttatatacatatrcagtaatacacatgcttatatacatatatgcacatatataaacacacacaaatcacacaaatgcaggttgagtattctttatctgaaatgcttggggccagaagtgttttaagattttggattgtttcagagttcagaatatttacattatactggttgagaatctgtaatccaaaaatctgaaatgctccaatgagcatttcttttgagcatcatattggcactcaaaaagtttaggattttagagcatattggattttggattttcagatgagagatgctcaacctgtacatgataacatgactaggggtgttttttttaatattttgttcaccaaatctttttttctctcatttgtcttgctgaatgcctttatcatagcttaaatttgaattttctgcttctgaacagtgcttaaaatggaaagaggaggcagatgctggagttgctggtatctgcagccagcttctcttgtcgctgtgttggcttttcttaatttttaagcatatgacatatgactagttgttttttgttttttggttcattgcctgattttggccctaactattccattttaattttagttatcctgcatcatttctgtaggtgtgttttatttgttatttctgggtgactaataaatatatacatttatatattattatatatgaattatataaactttacaaattaaatgagcatgtatatataaaaaataatagcctactgccactctaatatgcaactttgggtatatgaaagttgattctgttttgagtattcatatgctctgagacagatgcctcaaaataagatacctaacggagtacttgctgctctaggcttctagaggactccctggggtgaggattgttcagaaaggaaacacggaacataagcatgatattatgttatggccaactaattagacatctagtcaattgactaacaatgtgtgtgtgagaccctgtgctgggtacagagtcagggaaaagctatcaatcctgaatagccccagtatcttcagaatcaattactgatgctaacaatatcttccagtgtcaaatgagaatacaagatgcacatgactttcctaactaattactatgactcaattggttagtttgaggaggtcttaaatgacaaaatttaattctgtattcctgtatatatagccagtattttataaaagagaaatttggtgaaatggttctgtatgtgttgctatgaattgaaacaaattccagccacttgaaaagattttttaaagtcttatttgcttttctaccagatgtgcttggaagtgagtgaaagtctctcaactagaactgccaggtctttgagtataggtggcattttgtcttagcctaaaataaatactttttttttttttttttgagatggagtcttgctgtgtcacccagtctggagtgcactcctagcctccagtgatccacctgcctcggcctcccaaagtgttgggatgacaggcgtgagccaccaaacctggccaaagacttgtttttatccaccacatctacagctgtttggttttttctgtttgtttgtttgtttttttgttctcatccctgcattcagacaatcaaaatgttttctyctttcaatttccagaaaattacaatgatccaggttcttcgctgaagctaccatatctttgtttcttgtgcaatgataatgtcactgatggcataatgtcttcctctgctagtggagcctaaagcctgatttccaatgaagcttttcagcattgctctctttctaaaatcctcatctgacgtgggctgtggtttgcttttagagtttgcttcagagtccacctatgcaattctcagagcactgccacagcatgttctgaaatcagagttgggtctgtttagtctagcaacctcatgaggaccccgtcttatgattgcatgaactctcctacacagtagaaatgtgtatttctataggcgttacttaaatgtttgcaaaggagctgtgtttcagttttccctcttgtaattaaatgctgacatattttgcaattgaaaataggagaaaataggtaggtggcaagacggtgttcaagaataattctttcctcgggcaaaaaccactaagatcaagattccatccccctgattcttctgcaaaaaaatgtaggacaaaaccatggggccttaaaatgaatgagaacaataacatcgaatcaataataatagctatcatttataattgcttatcacgtgccgggccttgttcttagtactttacagtgtattaactcatcgtttcattatagacaatgtagagagcagatattactctcattttcctttttagattggaagctgaatcagagagaggttaagcaacttgcaccaagcctcacagctgtaactggtaaaggtgagggtttaacccaggcagtcagattgcatataaacactcaagaagctgcattttatagccgtagaagagccatgctgcattgataaaatgtgctccttagcaggygctcaaatgttacaccagctcactggcttgastaatcagtcctcctttcactggttcagttgcatcagacgagtgttcatttttcacacccagcaaccactctcagttcttaattctgatgaatgcatgtcaggctatggagctttcttgtttctgaagaagttgttggctcaggattcctattttcttgatagcattcaagggatcctgcaaagtcagcagagtgttctacaagtctgctttgaggacaaacttattgacatgtaacagattctgaagatggtgtctggacattttcatgccatttgttgctagttgagttgaaggaatgctgttggcacctacaacattagcrtctacatcctttgctgtgtcataaaggatagatgtaaaatacaatgaactatgaaggagggaggtaggaagtatgacatcatattctctcagggcataaagcagatttacagtgtacattgcacatttaatatgcacaaagcgcttctggtacatatgaggttaaactatataaaataccattttggtaagtcaaaaacagtggactagcagaaaattcatccacacacatgcacagatatacacagactcatgtgtacacactgcactgtgtaaaggtatttatgttgtcactttagttaataaaacaaatagacaaaggtcaaaattacccagtggaattgggcttaacctccaaagaacaataaaaccttgtatgactgaaattagaaagtggtctgaggacccattcttaaaattctatcagaaaagaatgttttacagacaaagacttgcttttggaatactatgcctgctaccatattctcaaggcaaaattcacacattgaaagaatgagattcaatacgtgtgaagtttttttttttttttctatgttcaaatcgggagaagggcattatccaaagctgacatattgaggtttctttgttttttgttttatgccagtctgctgaaggcaaagccttttctcttggcaggctgatgccttttgcaaggttttgtggttaggggcatgcctgtgctgcagtgatgtgagcagtttatcagcaccatttttctgacagaagttactgaagcatggtgtctgagtccaccaaaccattacatcttcagttacaaggcacttcactaaaagagtggctttggaatattttgatcctaaacaaagagcttgttgttaaagtggtgttattttgttttattaaagaaatgagggcaaatgctcatagaaggtggaaactcactttcagtttgggggaaatatcccttaaactagaagaggtatatggaagaacttgacaccttactaacaggtattctgtggattttttgtgtttgcttcatatggcttaatatcacttcactctgcagaattatggaatgtaaggtaatacacatcaaagcagcataggtaaracaattggatcgagaattagcaaatgtaggatttaggcttatgtgtcccatttaaccatggacttttctggacttttgtctcctcatctgtaaaacaagtgattcaagaccgtgaactggaagatgtgattgggtgccgggtgtctgttcttaagagactctagaatttctggtcgctgaactggcagaggaacacacaaagcatttgaccttgctcccatctttcataatgccttgtgctgcccttggtatttaaatgaacatgattctactgacttgctgtcagcgggacttgcactttgggctgctttccagcagtggggaaggatttgggatgattcatcgacacttgctttcccagatgcctctgcttctgcattctactgtcaaattgagcaaatttgccaaagtcaatgacagattttatttgttccttgcaaacaggctaaggtggaaaaacctaaatagatcccaaaatacatagaatttcaatgtgatgtatattaaccagaaaattctgtaaatgtatagattaagtattagttatcacttgtggcatattatcaataatcaaaatgtactggacactattttaagtgctttccatgttgcatctcatttaaacttcatgaccactctatagtgtggtaactatgattatccctagatgagaaaatggagatgcggaaagactaaatgacttgcctgagattacacgtagccactcagtggcaaagccaaggttagagtagtcagactctagtgacagtgcttataactgctacattgtccctctctttggctaatggtgctccctacctggcttttgaggcaggaactctcaactcatagccagagttatggagtctagccctaggatgtcaacccaagtcagaagaactatttgtgtgcaaactttaccatgtataagatgtgaaaatagcacatacatgattagaatcatacttgcttaacttttaggatcttatttgactaaaatatttatgtagctgctttggaaggtgcatagctgtggcacagatggctagctgatcactaaaaatacacgtgccttttcatggcatagggtaattgctggcaaaagtcttctcaacgagggactacgtgaccatttctcaccaataaaatgtgaggagaagtgatgtgtgtcacttccaggatgacatggttacagagatgcgctttcctcaccatcctttccccagtccctgattgaatggagggaattccagtcatgtgctgaagattatggagccaaagacattggagcctgagttcctcaataatcacctgcaggaaagccatctgaccatgaatacccacattggattttcacatgagtaaggataatcttgcagtgaattaaggcactgagttctgtgttatggcagctaactagtgccaaaagtaaaaagtgttgttgctttcatccaggtggggattccatgaatgtccagctttttacaatgctgagtaagtcattgaacttagcagtgtctcctgttatgttttgataacgaaaatttttatttcatggcctcagagcaatgttttccaactaggggcaatattgtccttatctccaaggaacatttggcaatgttgggagacatttttggtggtcacaacttatgagaggttgctactaacacctagtgggtagaggccagggatactactcagcttcctagaatgcacaggatgtactcttataacctaaaaagcatctggcccaaaatgttgatagtgctgaagatgagaaaccctgtcttaggagcatgtttgcagccacagatgtgagcatctttactgcattcttgtgacatgtagttcaattcaactggtagagaccctgtgtggcccctgctctgcactgggtcttacttactggatatatcattcagggcacatattctttacaacaagactgttttggttctcaattcgcattctgtggtggaataaacattgagtggaatagaaaacattagctttgggcctggcgcggtggctcacgcctataatcccagcactttgggaagcggaggcggacggatcacctgaggtcgggagtttgagaccagcatgaccaacataaagaaaccccatctctactaaaaatacaaaattggccgggygtggtggtgcatgcctgtaatcccagctacttgggaggctgaggcaggagaattgcttgaacccgggaggtggaggttgcgatgagccgcgatcgcgccattgcactccagcctgggcaacaggagtgaaactccacctcaaaaaaaaaaagaaagaaaagaaaagaaaacattagctttaaagctagatctttctgttaacaactatgattcgaggcaagttaataagcccctgcaagcttcacttccttcacctgtaactgagaataatatcatctgcctcatagatttataagcattaaattgaatggtatacataaaacatttactataatcactagcaaataacaggcattcattataaatattcttttccttccccggacttcataaatgtgacaaaaataacttgttaacaagatttgaaaccatacagtggaataaactagaaataatttactgagtgccataatgtactgatccatatttttatatattcttagtttattggtcaagtaaataactggtttccagagaaaaataaaacactcaagttaatattcaactctaattcatgccattccagttttaattccagtcrcttcttgacaaagaattggtgaaccttttgacagccgtgacttagagaaatgttgctatcctgaaacaggtccaaattctttcttctgtggtcattctggttctatgtggtcttttgttcttttatatcctaggctagtctatgacccagacctacctctgccccatgcttttccatgcatagctgcttatttccttgtagcaaggtcaacatgccattgcagaacattctcaggtgctcttggcaattagtcaaagttcagacatcgagtttcagactcttcataaaatttcctataaccatacctatttctgtaccaaattctattgacacagattaatgcaatgctaagtcttaatgaatgaagctctattcatcaatacttgaactacaaatgtcttttcctattgcctggggagtgtttgctttgctccaatgctataataaatgttttcaaagtggccctggaagttgatggaaaaaataatatttttataccagtgcttgtaattttttggtgacatagtatacatagtaaaaatatatatgcagaccatttggtgctggaggtgacaagctgggactttgtactcctgatgtctcacccagccagggcaaagggtcaatatctaggcagagctgtcacaaccattcacgacatgctgacttgttgaggaactctattctagactgccttggtgatgaaccataaaaatgacaattttaacacaaagtcctagacacctccctctaacccacaacctcctaaatagttcacattaaagtcttgtcctttatttttatgttttgtgttgttatatgaattgtcactttatctttaggaacttgattcatgtttcatgattttccctgttggctacacttgagggtctctgtgtatacatgagtagatctggtccccacccgtagttgctctcctcctgccttggagattgcttggtgctcctgcaatgtcttccttcaagcatgatgcacattataattattctgttctgcttcaggaatgcatatcaagttctatgcaattaatgccattacaagrcaaatacagagctcttcttggcatctccaggacatctgtaacgctgcagaagcaaagcattgtagtaatttatgtgacttaggaacttcttttttctatgactgttaaaatggcatttttaaatgaagaagttattagccaagaaaaaaggacttctggagaatagctgactgcctacaataacgctggtcagggaggatttgggttctggcgctgcttctagaggcacgttgatcacagcagggagggattcagaagggtgaggcaaggctggtagagcagcaggatccagtgggaacatttggagagtctttagcctggagaaaagtagtccaaggggatgcgggaagctatttttagctctctgaggaagaattcctaaaactgatcttgaattctgcggtcaacagaatgaagactaaagggtaaaaaggtagttacagaaagaaatgcaaacaacacatttaaaaattggttactagtgtcaacagttaggtgttatcctctcagaagattatctgtgtaaaccgaaacctacacctatatacgtacatgtttttaattatgcgtatatatttaagaatagttttacaaaaatgggattatggcccatgtattttccttaaactgggaatcamatttggatttcatataataaagacattctatgaattgggagtatctaggattctcagtgggatagtattaccagtggaacagactgcctcatgagtagcaggcttgccatgagtacaatagcataggccagcaggtctccacatttagtattcatgcacatctcctggggatcttgttaaaatgcaggttctgattcaggaggtctgggctggggtgtgagatttcaaacaagataccaggtgatcgtagtcctaggactacactttgaggaataggtgtctagcttaacatccctagggatgctagaaatagattcctgtcttgggatgggataaaataaccctaaatttccatataacttgaagtttttatttcatcttgattttaactttattattttctatggaaaagaatgttgattatataggtgtttcatttactgtctcaccattattcatcattttttttcttttctatttctctcttttctccagtatagcctacaacactgtgatgataactatgattataatctttccttttttaatgttcaaaacaaatattatagctcttctactggttgcttatatctttatttagaaaaacatgtatttacatattttaggatcatttctatatgtctaattcagttcccatagtaatatgaagattatatttaaattatgcccctagtaatgctaatagaaggaaccagaatgaaaaataaaaatagataataatgactaagaccaattaaacacaacttatgtgataaacattgctttaaggggtttgtttatatgcattaaattatttaatccaaagtgtagacttatggaataggcattatttttatcccattttattgataaagaatgtgaggtataggaaaattaaataattggtgaaagtcacccagtttgtgtggtagaattggaacttgaacccaggcagtctagcttccaagttgaggatctcactgttatagccatattggaacaattcattaggatgatgcaaaataagatgtcaccttatatcaaaatgtgagtttttatttttgtaccattatggtaccatctttgttgataatttagtcttttaaatagacatttagcctttgagagcatccatgctgcattttgtaatttctaacttatttattgaattgccttagacatatggaaaatgttggactatcctatttaaatttcatgaaataggccttaaaatcgcacttgtaagatacatctgaaacttttataaattcataatgataatttggtgacccttgctaaactagaggacactgggatttcaatgttggtttgaacaatttagaaacccttttgcaaagttacaccagggttttaagcattctctcttaaaagacaagtggaaataagtgatttcttttccaaagcggtttatcttcttggtaagttaactatgtttaagatttagtattcactccttaaaatgtttttctataaggaaaatgaaaaggattgattaaatgagtaagagtgaggtcctggcatctaaagttgtagagttgtccatggcaaggacatgtgctcatttcagcacattatgaccattgctggagacaaggatgaacagagagggatgaatgatgcccagaaaggtgcctgtaaccaagactgtggttctcaggaagccagagacgtccaggattcagagatgtgaaggcagtggcggtacttccggactgattcacagttctaggaattagcaggggctgtctgtttctatttcccaaataccttaatttattaaattttaataatatgtaatatattctcatacttccaaaaatataaagggcaggattttaacaatgagaggcatgttaattattcacggagttttgcacattcmtaaggaaagcttagaaagccctatttctctgtgggaatatattccgccagtggaacccagcattataattattttgttaacattaatgggaggaatgtcttttcatcgatacccttttcttgaagaaagcattaaagtgttctggtaccaagataattgttaaatagaaagggcacctctgatgggtattctctgtttcattgattctttttccatcttgtgatgttgatgatggtcaagtctaaggagcagagctagaacaaagatgaacttaaaagtcatcaataaagaggtattttttacccagctgtcagaacaagaaaagttttttgtacaatttttaatcttgtatattaacggttcttctttaagatataatttatatagagtagaatgcacaaatctcaaatataacactcagtgaattttgacaaatgtatacacctgtgtaaacacagcgtagattaagatagaacatttcatggtcccagaaaattctcttgtgccctcttccagtcaatacctctctctcctacccctgcacgcacataaaatacccagtgatgactattatcttatcatccagcttagtttactgataattacctttcatttaggtggaatcacatggtgtgtttttgtgtttggcttctttcgtgcaatgtaattttttttgagattcatccgtgttgttccatgttgcattcctcttttttattgctgtgaagtgtttctttgtatgactttaccacaatttgtttatctactgtccagttgatggacatttacattctttccagttgtaagctatgatgagtacagctgccataaacaattttgtacaggtcttctcatggacatacattttcatttctcttgggcaattaactaggaagggacttactgagtcatggagcaggtgtccattttgctttattagaaacctcagttttctgaagttctgtgtcactttatatctcaccaggagtgtgggagagaacaaagatggtcttgatcacagtggtatgctgtcacttgctcctcatgtgggcacttccacagtcttatatatcactgagctggaaagaggaggagagaatgataggctggggacaggaggcaatggaattatggagatagtgtattggagaggtaattgatcctgcccctgccagcaagaccagctcatttactcccagaactgctcctcagcccagcgatgcctgacaaccttccattaaaagttacaccatgcagactggctgtgttacagaattaattccgggactggctttcagcccacttgcaccttgacctcacctctgcctgttttctctcacgcccagttcatgtgtattcatacagcttcacaaaaactctcttctgttgttggtgatttttttggttgatcctcatcactgaaacttcatagtcatgagctgtctcttacaagatacataactttgggccagttacttaacaaccccaagtttctgttttcttgtctataaaatggggatcagaatgctatattaaaaagttaatggggccaggcactgtggctcatgcctgtaatctcagtgctttggggggccaagatgggaggatcgcttgaggtcgggagttcaaggctgcagtgatcacaccactgcacttcagcctgggcaacaaagtaagaccctgtctcttcacaaaaataaataaacaacttttaaaaagttaattcaatcattaatgcctataaagggctcagcacatagcatgtgctcagtaaacactactgtaactcccagcacaacccctcctgttgtacttcctacatatgattggttttccaactctctaattccccttaattgataattctagtgaaataccctcctgggaacggacctaggaattcctgccyaggcctctgcctttccaaggctcatcctcaaaccgttactctgagacaattgtaatgaaacaagcaccatttatacggcaaactttaaagctcctgctagcttgagctggggctctttggatttcctgtttcatattttccaggatgaggattcgattttaaggattacatgctaaaaatagacctctattatgcattttcaaggattttaatatattgttaaattctagtttttttttgtttttgtttttgtttttgagacggagtctcgctctgtcgcccaggctggagtgcagtggcgsgatctcggctcactgcaagctccgcctcccgggttcacgccattctcctgcctcagcctcccgcgtagctgggactacaggcgcccgccaccacgcccggctaatttttttgtgtkttttagtagagacggggtttcactgtgttagccaggatggtctcgatctcctgacctcgtgatccgcccgcctcggcctcccaaagtgctgggattacaggcgtgagccaccgcgcccggccaaattctagttttaacacatagagtacctcccctttaaaaatgaattgttaccaccggccgaatacctaaacactatcattctgtgctcctgatgttcctgtgatctcatggagtctagggtgcctttcccagtctcaacagagaggacttcatgagccctgggtacagaaaggtcattggttttattttaaacagtgtcagctacctgctgcccactttgttccaagctcttccttggccctgctattttcaggcaagatgcccatgaaccagtacagctcttcacactcatcccttctgcctcttgctccagaatcatgcttgggtatcacaagcctacatgtggaccaacctcctttcccttgttccaccatgcccccctcccatatacacatcacaaagcttctcttccccatgccttcactcacattacccctctctggttagtacttcctcatcaccaacatgaaatcaacaggtactactcattccatgactttgctgctctcctgtacagccaaactccttagaaagtcttcattaacttctctaaaggaagactttgtagagagtcttcactgtgcttcccctcctcccagtctcaccccaacacactccattataactgttgtccgctccactctgctgaaaagttgccaatgtccaacatcttgtcattccttttcatgaaacttgaccccttaggctcactttatatgcctgatgggcctacttcttttttgaaaggtgctcttctcctaacttctgggacaccggatttgctgttttttcttcctggattcttttctctcakatcttcatggggatgtttcttctcatcatggatataacccctttgcagaggccctcccagtcccaagcgatcctaatcaaagcagcttccttcaacctttggcctgactttctacctcctttatatttttaatagcactaattatatctgaccttctcatttatttatgtagatgttaacatttcatgtggaagtttgtaacaattgcacatttgtcaataatgatccctgacattcattaatgacctgctatgtgctaattctgtcctaaattagctcgtctaatattcaaaataatgttatgaagtaggaactactatcatcattttttgtatgtgtaaactgaggttcaaagaggctagataacttgccttgattccaaagctgtaagtaacataatgagaattcagacccatctattttgatgctaagatctgtgatataaatcattgacagaaaaaaaaaaacagtgaattaagctgtgtccccatgctttctaggggcacaaagagagatttggtgagacagaacatctttaaaggtaccacctggagagaactaacattttgtttgctctggagtgttgagaatttaaaggtttggctttgtgatggctcaagcagtaaatagatcacacacagtgaggaattcatctcattttgcatcgagtgtgcaaagcagtcataaatgatgaagaactgcattgtgggtcttgtgtaagtcttagagtaagactataaatttctaaaacttgaagtttgtaaacaaaatatacattagtttactcattaatgaatttataatctaagatgaactgaaactagatcctagttaaagcaaaataaggaagatgcactggtctatattttctttcctttgactttccacttaatcattaaagccatggccttcatggattattggcaagggaaagcagattgtaacacattttgcagatagagagagcaggtgtttcccacctgttcagttccatctccaggatgaactttgccttcattacatgaatccagagcatactctcccaacttggtagtgctcctgtgaactgttgatctgttactggcaagcctgaatagcccggcgcaagagccagtctgcctagaaaccctgaactgagtctaacctgttctcagcaaatcccatctctgcctctctggtgggtcctcacggcacccttgtctgctgcctattacttcccaaagaaagagacaaaaaaatccttggaagtgttacactaatgactttacatataaaacctctctcagaaatgtctgcatttttctggaagaggatgagtagaaaggtcaataggtagccccacagaatgaaaagtattattcagctacagtagatgctgggggccctcaaatcccaacagtccaataaatcccatccacatggatatccaaggaatagttttatacaattggattataagtcaagtatttgagggagaagctgttcactaatcgcccaaaacattcctccagtctgcacctccttctcattcccacagcgactctcccttttaggatattgttgttcatctcctagtccacttttcaaacttaatgtgtgtaccaagcatgtggggctctaggtaaaatacagatcctggctcagcaggtatgagatggggcctgagattctacatttctggccagcttccaggagatgccagtgccattggtccaccaaatcacactttgtatagcaagatcctagcccagaactttccaaggcagaggaggcctcaaaatcccctgtaggcatgtgaaaacacagatctctaggccctatggcaagatattctaattgagtaggtctaggatggtgccccagaatttgtatctttaacaagttatcaggtgatgctgctgctgatggtctgggaaccccactttgagatccaccatcctagattattgtagtagcccgtgacttctctctgtcacctgtacttcattgtttcactgtcaccagaattatcctttaaaattctaaaaataattactttgtacatgttttaaaaactgctaacgattctcartggatcatttagtatacttccaggcttcttggcatgctgtaacacacagttaggtataagcagccctaagaagtttttcagaggcctgcccctctggttatctcaatagctgctatgagatatagcccacccagttcacatgcctgtatttatcagtgatttagagaattctttatttcaggaacttgtgcagaccacaaaagcatttattgaaaatgaataaacatatactatagagtgatgtgtgcaaactttttagtaacctgtaataagacaataccaagtacaaagccatcatgctttgtaggatatcaggattggctgacgtactcgttgacatcaggattccactgtcaacctccatgtccaatgtcttgagaaagtggctagtgtccagccagagagaggctgttctgtcctgctctgacctaaccttcacattggtctgccctatttttgttaattgtcttctgtgggatctcatgccatttcttttccaggcagctagatgcaaggattatttgttgttgctgatgtttgttttgttgggggatcttagtcctaattctttttctttgaatctgtaaatacttcaagtgcagtccataaagaagcttgacttgcctccagaatgcactgccagatgctagcttccagctttactaaccaacccgagagatggattttgtgggtttgtttggtctcgcagtttgtgccaactgggcaccgtgtccttagtccaccctcttctttgcacacaagtacaaaagggaacattttattctgctgctttgggtgggaacagtcactttatttatggggtctgagctaaaatttgatttctctattgcatggtgcactggctttatccatgtacatccacatcctttattattttcccatttcatgcgcaagttctaggcttctcatggtgttccaccctttgtggcttcagccttcctttccagcttcacctcccagtactgcagcccayctgctccagcgattccctgaaaaagtcacgtcccctstagtatatctgctcccggtgctcaccccaacaggattaagcccacacttgtaggcctaaccagatcctaaactcaatcttgttgagcccaatgaaaatcaggtggtgtaactcacaaaggcaattgacttkaactcctctaggttttgcttttgtctggttttcaaaggaaagtgcatgagggagcagggaagtgtttgcygcaagcaaatgtttgaacgttcaggacagttaaaagaagaaaagatataagcattggtgaaagtgagcacaatwgatgcaratttggcacgctgaaaggaatttttgccccttaatgatctgtgttttctttatgcagcataacccgaggcaattaaaggcaggaaactactctaaccaactggcaattatgttttagtatatttggtacaatgcatactcgctctccatattttcagaatttttgaaaagtaaagaagcttcaaaactgtcaaagttggctcttctttcactcttcacgaagccttagtaggaaaaaggaaagagctgggctgtttgctctgggtccttttatgtgctgacatggatgcatttgaaggatttgaaatgtgctkcagtttgaaacttgggttccttttactgtttattcttttttgtgttttcacccattggtacccttgattgatagtgtttaagtcaggggacaagcygggggtttagaacattgatgtcctcagcgaatgaccctaagcttaaaagggagcccaaactcatcaggcctcgtgtttaaaaatagtttatttttgatgatgttcatgtgaatgagccatagtcctactcctcagggctgtggaatggaaagccttgagtagcaaatgatcgtagttgcctggccaaaccctctttctggtccaggcactgtcctccagcagtcacaggtgctgccctgggcattgtaggatgttcagcagcactcctgcacttgaccccttagatgccagcagcatcccaccagggtgacatccaaaatattcctagactttgccaaatgcccgggactggagaaagggcaaggtggaggcaatgggaggcaaaattgcccccagttgagaatgattgatctctagggatcctgaagatgtgctgggtgaaagccaattctcttcctaagctgatccaggcacaaaggagagcagaggcatctgcaaaatgaaaactacattcttttaatgatatcactctttcctcttgacccaattttggccagtttttagaaaatcacatcttcctcaagcatctaaactggcagaagagagaagatgccacagtttctgctttgaagggtccagtgaggtttggtatggtcctcacataaagtaaagaggccaaggatatttgtgttttacgttaggtcttggcaaggtaaaaattwtaagagaagttttatagtgtaccagatttctatcgtgtttttaaaaagaaaataacttattgaatataattgccagacaaggtgaagatagtaaaagtattcaggttgtcaccccaaactgcaaagctgactaaactaatttcaaccttttcctgctaacaaacttcacccttctgtgttttctctccctccatttttgcctgcctgtacaactcaatcctttgtatttactcatgatgaaaggcctacatgcaataaagaaaattaagcaaacctgattttcaaggcttgagtaatttaaaaactatgattttgacattttaagaatgttatgttgaccttgttcttgatcagtcatgagaattaaatgcaggagctttgcaccaaagcaaggcccctagcttaataaagatttaatttatactgcttcctaacattctctttctttttagtctacacagctcacattgtaccttttctcaaagtaatcatgagttataatttaaactgttaaatacacactgccttaatcttgtattttgttgttacattaatcaaggcagtgacaagcaaaattctgttcgaggactcttaacctgccttgcaagaaaagtaatgttcactttttaaatgagccattaaataaatccattgactttttgagtgaaaagcctctccctgtcccaagagctcaaattgcattcaacagttgcttttggaatcccaaagagagcagcaaatagtaggagttatgtctctggaaggcttcttgagttccaaaaggcgatttccttcctctccagaaggaaatcaaagaggaaataaacaggaatcatctgaaagataagaagtaaatgcataactcagtggaaagctagctagctagacagatagaaggaggatacaggctttctagagaaattgggattttaaagcatttatggagtggagaagaaatgactgcaaacaaagccaagtgctaaatatagaaactatggaaataaatagcccatattcccaggatagccttagctttgatgttaagcagcaaagcagatccagagggttcctgtataaagctataaacagaaaagaattaagaatatgctgattgagagaaacaaatgtggtttaccttgggaattacctctgtattgtgctatttatggaataaaagacaataatgtcatagcaagcactttgtataattaaagttctagagtttatagtggaaaaaatatgcagtccattgtcttgaaatgtttatttcatattttgttgtaagggagctttacaaaggtaagtgccttattctgacagtgctagctaactaataaagtaatcaagaacatgaactctgataagcagacctgaaaccaaaccagaaggcagaaaagggaaagaacagactccaattggagctaggtgatatgtctaaaataaatttcatgtgtgcctttcttttatatttccttggatccattttaatggaaatttccattagtggggcaacctatgtaagtaattgatagatatacttaatttatttgctgataagttgagaatatagccatattaatggaattggaattgtcaaaaaatattgttggagttgtccatgaaaatactcagtatttcttttagggctacttataatgttactataacaaccaatgaatggacttaggcctgaaagataaaatgaaacataaagatgatgaattttttaagttaaattttttattgaattccatgaagaaatagctctgaaatctcaggattgctctagtttcaagtggttagaagacaaaaagagcctgaggcaggagaatggcatgaacccgggaggtggagcttgcagtgagccgagatcgtgccactgcactccagcctgggtgacagagcgagactccatctcaaaaaaaagaaaaaaaagaaaaagagcctggcttcttaagaaaccaggtagtaagatggtaaatcatgtaactggagaaaatgattgggagtattttggggaaagatatggttgtgaacactgcaagtttctgttggggaagaggtgtttgtagtcatgactacaaagatgaccctctggaaaagtctaggaagcaggtcataggacaattccagaaagaaggagaattattcaatcagtgactccactgtctttcagcaaatgcttgcctgattactacagaacatgcaacttttgctgatacaaacatgcacgaaggaaggtacttcctctagatagagggaccttgtgagtaattgaccttgtggctattctccccttatacttcccaaagtcccttgcagctagatgtgcctctgagctaaattctggcaaagaggtgtcaacaaaaacctgtgggaatttggggatcttttcttaaaggtggggacatggggtgcttcttccttccctctttgctgcaggctgaaatgtagccaatatgaattgtgttggagcagccctctctatcatgagggagatgctgcatactggggattgagaggttgtcagagagaaaaagctgagacccaaacaattgtgtgatgcaggcctaatggcctggtctcctacctccaggcttctttcacatggaagaaataagtctgtatcctttctaagctgctgctgttttggcctttttagaaacttacagctgagcttaaacttaactcatacacatttactgtggttataagtagaactaaaaatatacttaactcatatttagcagttggttttatttcctcagttcatactgaaactagagcaatgtctttgcttaaaaacagaaatcaaaatcaatcaaacataattgattgaatacagattgcaaagaagtataaaatggaattttggccctcaagtggctttcttcaacatgaagaaacaagacttttaaaaaggtatatgcatatatttgtatatatatatgtatgtatatacacacatacatatatatacacacacacataaatatatacatatctacatatacacacccatgtactacacacatatacatataacaaaacaatattaaaaactccattgtgtaatagttcaatagaatcagtggtgcacagacaataaaatccttgggaattcagaggaaacaactgaaagagatgggagtttgggcagagaacctggttgtgaagattaaaaggaaagattagacaggtgacaagaagaggaaataggacacaatgaatgtattgtcagtaaaatgaaagagttttaggttgatatctcagtatgacatatttacagtcacaattcaatataaagggtcttttgctagcgttcatgtattttatctggtcttaatgaaatgtataagtgaccatgatagacctcactgttccacaggtagtgttttcaggaaaattgtgcaattagtgtctgaatttattctatgaagagtccttacagtttgtctccaacttgcagttctgtggtcaaaggagctgtctgaataattgcagtatagtaattgtgtctacagaggacataagcaaagcattttgcttaagcaaaaacattttgttttgttttggttttttgtttgtttgtttatttttgctggcagcattgctagtcaagactgaaaaattagggcatttaaaatagtggagtaagaatggtggttgttgcaggggagctgagtaagatagagcaatgtgacaagcaggtcttataagactaggtagaagatcaatactctgagaaggagatatggaggggtcagaayggtctgtggaaaaagtactgaatgtggtccagttgaagaggaagrgaatcaatatattaaaaaagacccaaatgaaaaaaagaaataaagctgtctttatttgcagatagcataattttctatggagggacaccaaagagtctattaaaaaaaactttctagaacaaataagtgagtaaagcaagatgcaatatcaatgtacaaacgtctattgtttttctatgttccagaaatgaacaattggaacttgaaatttcttttcttcaacttttattttatctggggttcatgcactggatgtgcaggtttgttacacaggtaaatgtgtgctatggtggtttgctgcacagatcaatccatcacctaggtattaagccaagcatccattagctattttttctgatgctctccctcgcctgacccccaccctggataggccccagagtgtggtgtttgccccacagtgtgtccatgtgtactcatcattcagcttccactcataagacagaacatgtggtgtttggttttctgttcctgggttagtttacggaggataaargctccatctccatccatgtccctgtaaaggacatgatcttgttcctttttatggctgcatagtattccattgtgtatatgtgccacattttcttcatctagcctatcattgatgggcatttgggttgattccatttctttgccattgtaaatagtgctgcagtgaatataggtgtgcatgtatctttgtaacagaatgatttatattcctttgggtgtatacccagtaatgggattgctgagtcaaatggtttttctgcctctagatctttgaggaatcaccacaatgtcttccacaatggttgaaataattgacattaccaccaacagtataaaaatgtggaacttgaaattttaaaaattactgttaaaaatatcaccaaaaaatgaaatacttaggggtaaatttgacaaaatatatcaaggagctgtatgtggaataccagaaaactctgataaaataagttgaagaaagtctaatgagattgggtgatatttcatgttcatggatggaaagatttaacattgtaaagatattaatttttttcacattgaaccacggattcaatgtaatcccagtcacaatcccagcaaactttttttatatgttggcataattgttgcaaaatttatatggtaatgcaaagaactgagattagctaatacaaaactaaaatggaagaataaagttagagaactcatatgatttaagacttactataaagctacaataatcaagaaagcatggtgttggcaaattagatacatagatcaatggaaaataatagcaagyccccatatagacccagataagtatagtaaactgacttttttatgaaagtgcaagaataattcaataaagaaaggatagtcttttcaaaaaatagtgctggagcaattgggtgtccatatgcaaaaatatgaacwtagagttcatactttacaaaaaaaattaactcaaaatgagtcatagacatatatgtaaaatgcaaaccaattaaacttctagtagaaaaatagaataaattttgtacaatcttggatttgtggatgagtttttagatacaacaccaaaagcataatccatgaaagaaaattttgataaactataatttgcttaaatttaaaacttttgctatgcagaagacagtattaaaagaatgaaaggaaaagacatagactgggagaaagtatatggaaatcacattgtgataaaagaatagtattctgaatatatagagaacccttaaaacccgacaagaagaaaataaataatgtaaattaatatttggcaaaacatatgaacagatatctcaccaaagaaaacatacaaacataacaaatacccatatgaaaagatgctcaacatcatttgtcataaaggaaatgcaattgaaaaccccaatgaaatatactacacactattaaaatagctaaaattataaaaattgatgatactaagtgttggcaaggatgcacagcaacagtatctcttattcattactaatggggttgcaaaatgggtataatgaaatataatacagtttagcagtttcttataaaactaaacatactcttaccacatgatctagcaattgtgctcctaggtatttacctaacagatttgaatatttatgtcccacaaaaacctgcatgcaaatatttatagaagccttattcttaataacccaaaactggaagccaccacgatatccttcaataggtggacagacaaactgtgatatatacaatggaatattattgagtgataaaaaggaattagctttcaaaccatgcaaagacatgtatgaaccttaaatgcataatgctaagtgatataagtcagtctgaaaaggctgcatcttgtataattccatttatataatattctaaaaaaggcaatgccatagagagggttttcagattagtggttactaggggctgtagaggagattgaaaaggtgaagcacagtgaatctttttaggatagggaaatttcttttgtatggtgctgtaatggtagttactatgcacgtatgaggtactatgcatttattaatatactgtgtactttgaaatgtacaaatgtactatgcatttataaaaatctatagaattttgcagcacaaaaataaactttaatatattcaaatattagaaaattatttaaaacatcaagagaatcccaggatggaaagcagattgtgacaaataatatctatattataaatatagacaacaaccttactgaaggcaataagggaggaagttgctaactgaagtaactggaaatgaatggaatctgtgaaactgaaagcaaaaagaatggttgttaacaactgttaacagttctgagaccagtattcttatatactggaattgaataattagttggatggctgacggtggaagcaaggtttctcactgttggagcaggtagttatagagcaaaggaaaggtgctagaatgatccatgtagacataggctagaattgtgacatcagtgtgaactcatttttagcttaatatacatgcagatggatgaatatagaaagttctgtgtgtatatacatgggtttgtatacatacctgtatttccaaactgggttcttgaagaggacctacaaacaataacactttggtatcaatgagcataaccagccccctgaacttggtttctagtgccgttcttcaataaaaggaactagggctcttggagaaatggctgattctagagctggrgaagggaatttacaagattaggctggagcatctaacaatgccaggaagcaagaaagtttctcaaaggaacrtatggaaccaactaaaagacttctcaatggtcaaagctggaacaatttaagcaacaaaataaagatgtgatattagattgcaactcaaagtataaaataagtatccataggccacattattataaatcagtcattgaatgaataaataattgggaagaatacacaattctcccatataggataccaaataatttatgtaggagcataactgccttctcttaagtgtgggattcacatagcaacttcctgcaaaaaaagcacaatatggaaagaggggataaagagtaattgtgatgcagaaactgacaaacactgcctcagtcagctgaccaaggataatctcatcagtattaagtcatgttgatagtaggtacctttgacatgatgtgatgaaaatggcattttacctctgtggtctctctcccgaaacccacaacttcagcctaatcatgagaaaaacatcctgtacccatattaagggatattctagaaaatacctgactagtactcctcaaaactgttaaggtcatcaaaagcaaggaatgccaaagagacaccctaagatgacaggtggactaaatgcagtatggtgtcgtgaatgggctcttggcacaggaaaaggacagtaggtcaaaactaaggaatatcaatgaagtatgggccttagttaatattaaagtatcaatattggtatattagttgtatcaaatgtatcatactaatgtaagatattaaccatagggagaactgcctgtgacatacatggaaattctctgtacaaattttctgtaaatctaaaattattctagaatagaaggctatttaaaaaaaaaaaaaagaccaaagctaaacatataatcgtggtggcctggggctggaagtgaaggttagagaatggagagttattgcttaacatgtacagaatttctatttgagaagatgtaaaaggttcctgagatttatggtggtgatggttacacaacaatgtgaatgtacctaatgccactgagttgtatacttaaaaatgattaaaattgtaatttgtatcgtgtattttatcaaagtaaaacaagtatttcaagaaaaaaactcaaagacacagaaaactagagaagagaaacatcagaaggactaaaaacaaaatctaaaagtggaccaacaacaaagcaatgggataggaaggaaaactgcgtaagattcacagggcaaaacacttccattactagaacaccaggaaagaaaacacctgtttagaaatcacagcaaataaattagtactcacggttttctctttacttcgtaatttttaaattgtacacaccctcttccaaaaaccttacaacacaaggcaagaaatacaaaacaaactttttgtttattagtaaattaaatactgtattgaatgtggaaaaacagaacaaaaagtggaggctctgatacactttggccccgaatactggccctctgagcggaggagagttggggaaatcagatgttatattaatggactggcatttagaagccaggcattgaactctgtttattttatatattattttaaccctcacaacagcattatatgctagtactattatttctcactacagagctaacatttgagatcatggttttctgtcaatgacttgaatttagtaacagtgaaaattccatacacataggaatatagcagaattttttcagtaaggctgtaacgtttaagtgaacttagctgatcctacatatattagagaacgcttgctataaattcatgggattctgtctaccaagtcagagaagtggtttaaatgtgttgatgtatctggcgtattagagtctacagtcatgaaatggaaccctagttgtacaactcattagctatgtgctgtcaaattacttaacatgtagagatctcagttttaccatctattaaatggggataaaacaggttctttgcttataacattctttttccttttctaatatcccatgtgcttgtgactttctatgatcagagatagtggtatttgtcttaaaaaaaaaaagaaagaaagaaaaggtcatttaagccccatattatttggagatcataggtacaataaaaaataaatgccagagtttcaatagcttaacacattaaaaagtattcctcatttacttagaagcctagtgtgggtgtttttgatataaggtgattttcttctacctggtgatttagggacttagactctgtccaatctaacagctccagtatctcctagggtctctctgtcctctttaaaaaggacacaggagaaagaaaaagacctgaaatgaccctcgtctcttccattaaccttccatttgtgagaactattcatatgaccctccttaaatgcaagcaaagggtgatgtgaaatgtggctgtattcaggcagcaatttccctgtaattctttgaactgtgtaaggcaaagtgcaaagtttggtggcgaatgagcaacctttgccttaagctctgtgcgagcccagtattgctgaactgtgctaacccactcacctgtatggagagaagagtagcaccattatagtaaggactcctgcagtaatcaccaagtataatgggggcacttaaccctcagcttttttgcaccttaaatggtttaataataattgcaacaaaaagtatttataaagcattcgggaatgcttataagggattaaagtaatattaaagaaatcactagagtctcagcattaaatgatttttaatgcaacaaaatctcatcatactgtattttttcttcttagctttaaaaatagacctgcagaatagatatggtataaagtgagactccatagtgtccagaattcttttctttgtatttgtactgawattctctctctcttttccagtgtatcaacttttagttatatattttgttcaaaaataacatctgatcatcataaacatcaattatttaaataggataacatgcttcttctgagtgctttaaagtaaacttgagtgtttataagtaagggaattattaagaagaaaccctggtatatccacaagataaatgttaccagtctctaagagtgcgtctcagtggttctcaaacttaaaagtatatcagaatcacctgtaggatttgttataatgcagattgctaggtcccaacctctggagttttcagttcagaaagtctgggatgtgggccaggaatttgtgtttctagcgagtaaccagatgatgtgatgctgctggtccagggaccatactttgaaaaccactgatttttctataaaatgatgctgaagaaggtaaggaggaaggtatcaaatctacgcggtttctctgaggttggactacttgatgtgtcccagcttttatgtttaaaaaaaaataatgccgaaagacatacagtgcttaagactcaggttaatttaattccataatcatacggcataatagcaccaattttggtacatagagtcttctgtacttaattttgactgacccacatagagcaaatgtgatttatctgacttgaaattgaaaacccaaataagctaggttgtgaaacacagtaggtttttacgatggggcctataaggagacctatgaattattagagggatagcagtggttaggctaaaggtatacagagaatacgttgcaaagatattaaggaaaataagaaaattatggaagactttaaggaaaagcactaaatatgagttcagggcctgagctaagtggattttcaaaaaaatttcctgggtatttactttcttaatacagaggaagtaatttggaggaagatttatttttaggttttactttcatctgagcaagaagaaatatattgtgcaataatgaaaaagcgatctatcttcttgggtgctcaaaacctatgttaaggatttatgaattatttattaagaaaaattatacacccagggatggtgaccctggtcaatatttaagcttcaaaaaagataatgaaattcagtttttctaaactgtagaggataaagtgttttatcataacattacaaattgtggaatgaatgaataaaagtcacagtgggttcttttttgaaagtctggggctacccggaatcagcatataggacccaacttcaaaaggtgaacaatgatattaaccaataatgtgtttctttgaggaaatgatctgaagcaaaaagatacctcacagaccagggaggtaatattcaagcaactaaagaagctaaggactatttcatatgactatcttgcccttggtgagaaatcctaatacagtgattttttttctccactatatttacaaaggaagcataaaaataagaatgttggctgggtgtggtggcttacacctgtaatcccagcactctgggggggccgagcgaggaggatcccttgagcccaggagttcaagatcagcctgagcaacatagtgagaccttgtctttacaaaataaaaaaggaaaaaaagaaagaaaaaagaaaaaaatgagaatgtctggatttgaaggaagaaaaggattcaaagaaattctgccctgcgttctgctgatggcagttttatttgagaactcttgcactgtcaaatgtttcttagttcatcgcccaatttaatatttcagaaaagtcatccaaggactgttttcttttgtggttttctttctggcagcattctatggcttctctgttcttggagtgttcttctgccttgacaaggwaaagttcatgcctaagcatgtgcagaaactcaaggtcaagtgcaccactgagcaccttcagagtgaatttttaggggataatgttgtcacaactgtcttcatcatcaaacagcaagccttcatgataggcctgccagggaggtggccctgccagcctgctgcctcttgtccctttcccagtttacactgttatttctccatcttgccctgacttttgcccaataacagcaagcctttgggttgaacctagcatacctgctttccttgtactccagggccataagcttgcagagctaccgtggtggcatggcccatggtttgtcctgccccaacttttttgtttttgagacagagtctcactctgtcgcccaggctggagtgcaatggcatgatctcggctcattgcaacctccgcctcccgggttcgagcgattcttccacgtcagcctcccgagtagctgggattccaggcaccctccaacatgcccggctaattatttttgtatttttgtacagatggggtttcaccatgttggccaggctagtcttgaactcctgacctcaggtgatccacccaccttggcctccccaagtgctgggattacaggcgtgagccaccgagcccggcgtgtcctaccctgccccatcttgcttccttcctcctctccctttattccttccttccgttctctttagaaatatttttgatatgtaacagaaaaatatagaacataataggaaaaagtccctcttaaatgttttcgcttttattttttgcattatcccaataacctgtttcatttatgtactttgtcttcagggtgcaattgtatgcaatatgtttggattctctgccacttgcactaacattctcttgccttaatgctgtctcttcttatctactcattttctgtttctcatcctttaacttttttaaagattctgtgcttctcaccaacatattgcaataaactgcactgtgcttccacctttcaggctttttaatgaagggagtaaatttaagaattaacttgtttctcatgaaggtcaagtcaaggatgtgttggaagaagacagatgtcttctattagttgttcttctgtattttgtttcaacctactgttctgaagcagcaatagtagtaaacataaggccttgtaaaagagtttttacacaattttttttttaaatctgtccccatcccacttttggtctgacagtgattgctttttacttactccctctctgttcataaagaggtagtaatactaaattaatagtgtttgtgaaaattcctagaaaaaatgttattcacataggatctttttaaaaattatccttattcatttttaagtgaggttttaatgaaatgataaaatgaattatgtttatcaactttggagtagagctttatatattctgttatggatagtttttttattattttaatgaaaggaaagtcagagtagggggtagaaaatagaataaacctttaccaagaagaaagtaaaataaagagaatatgaacatatttctttttagctatgggtatgacaaaaatgaactctgatttggagattaggtaaactgatgtttttcatagcttttatttatttatttttagtaaggaatatttcttttttaaaatcaggcactgtctctcacgtgatgatgagaaaaagcttttgggaaaaccatttgcacgttagattacagggtatttatgcatatgttttcccagtagtactcactatattttaaaacctgattaagatgacataagataaaatgtggcgtattgtgaytgagaacccctagtctcgaatgctcatatttagtgggtataatgatgaaaactattttcgaggacatttttgaaagattccaaaaacatacagaaatatatctaaagccaaaaaagtaagtaatataaaaatatgagtttaaaaatagtaatatgtgattcagaataatttcaagtttaacgttattttctaagttgattatttgcaaatgatagctatttggatcctgttctctgaacaaacccagatgcaaggggttgtatacaagtgatttattaaggaagctacttccaggagacatcagtaagagagtggaggaagcaagacatggatggagaagagttaagtaagggtgagctttcaggtgaagtcccaacctcaacctaagctactgaaagctgcagagcacaaattacacctcgagttgcttctcctgcatctgtcagacatgaactatcagctctctggggagatctagcatctcaggcacttcctgctctctacacatctgagtgaagtagctccaagaagccaaaggtagtcaaaggctgcaagtgtcacttgtttggaataaagctgatagacgctgggggatgggtgtctagccagtaagggagcctagcagggaaccaggctagtatcaatagaggttcctgcaggagctttaggcaaacttcctgagtaattggaaaatggctctacattgattttttttcaatcattcatagttcttaatatgaacagctagcttcgttttgtgtacatacattagtgttgagattgatcaacagtcgaatgaaaaggagagttcctttctggtaaaatttacgcacttaggcaaaacctttgggctgatttattgattgactcagtgaatgttcttctcaggaaaattcattaagcatgatgttcccttttagacatatccagctcctacccccacaaattagcatcggaaaagatttggttgaattccgtctgtcttgccagaaagccaaaagcaatgttaagaagcaaatcttctttgaaagggaggggaaaaaagaccacacttgtcaacttaaaatatctcattttggaaaatagattaactcattacatattcacaatgtcttatgagaggaaaaggtcatcaaaatgcaaacctttggcagaaaaaaaattgtgatacattttggaataaataactggagaaaatgagactatccagatggatataaccaatcagctactaaggtaaagcaaggataaatgccgtctatctatacttcagaaaatatggaagtcaccagatatgccatactgtgtgatgagagagaaaagaaaatacgttggttgagaaaatacgttggttactcactcaaatgtatcatgcacagggctgaatcaaaacatgtggaaatcagccgagcatttttagaacctctccttgacacagtctggcctctagggcccaatgtggaaattgctgctttaatctacagtgatattagagctactgataagcacagtagtctgaagaagacttctcagttttattagtagttttctcattgctcttagaattctgatgcagctactttataactggatgtaggaagcctgtccaagtgtcagaatgccctacccgttctagacctaattagccttctctgtgggcagccattgtcttcatttaatatctagggcagagattctcaaacttcagattgcatctgaatcactgggaggkgaatcacccagcacagattgtcgggccaccccagagtttctaatttagtaggcctagagttgaaccagagaatttgcatttttcacttgttcccaaatgatgatgatgccataggtcaaaggaccacacttggagaaccactggtgtggagaaatgaaggcatttaagtcctataagcagataagtgatggattcaaatattatattaaggtaagattgagggagtagtttgcactgccagttaaaaaaacttggctggctgttcagccacagtgaaataggtgtaaaccagagataacattttagatgattcaaaggggaaatctggctacatttatatcatctggagttttcaagtggaaacagcttgtttgcctgatgaatctatatcattccatatttcttatcaaaagaccttttatgaaaatcagattctatgctcacccaaaatattcaggaagatagtttttagcacttatgaaactatttgcaaaatgatggatgctgtttctagttaatctgattagtctgaaatgaggaatttagcttatcacaggcagtaatagaaaattgtaacaatgccatctttatcatcatagttgtgattttttttaactctgagttctgaatacatgcaacatcattcattcttcatccataaagatgtggagaattcctctgtgagaagcctgtaatatataagaactggaaaaataaaacacgtgctataaagagccaatatatttctgaaattattcatctttaaatatatatagattatccatggtgattatggaactttttctcaggtttttaatgtcaacctaataagttgacatctcgttaaaatgaaggcagttactagcatgttaaatctgacctgtttttcattcatcatttgaaagaaattacaaaaatatatctcttaatataatgtttcctagaatccagaagcaagtgtggcagtttcttccctcagagtcatagatgcatgcaactataccataaatactgttacaattaagttttattcattttacctcttaataaagccgtggtgctatacatataattttatgtttagctgcatttaactttcaactttggaagtgttttactcttagatgagcgtgtaggagtttctaaggttgctgaagaaggaagtaagaatgagaatatttggctattgcacaaccagccaccaaactatctcacctggcaatctgcaaggaataaattaactgcatatctgctgatatagttcacattgccttgtgcagacacagcctctgaaaactagtgttatatttatttatcatgattattttttcatatacgtgaaaaaagacttaagtggttttctttcatttatgttacacaatactcctgctaccttatcaatatccaaaatttttagaaaaaagtaagtttggggatatgtggattactttttctattatgtacatagggtcaatgatcctgggcaattaacatattttctctgggacttagtttcctcatctgtgttctctttcygttcccagttactatgattctattatagtaattgtttctgtttgggcacattcaataatggtgacagcattgcagtcatttttatgcagggtgggtggagtgccaagatacgtaaattcattttcattcctttttaattagttgcattagaacttggaaacaatggggttagtgtattagttatctattgcttcataacagactaccacaacttaatggcttaaaacaacaaacatttattatctcacagtttcagtgggtcagggtctcacctgcttagggtatcctaaggctgaaatcaagatgtctcctgggctgtgttctcatctggagctcaaattcctcttccaagctcatttaggttgttgccagaattcagttccttgtggtggtagaactgatgctcttatctcctggaggtcttcttctccatagtcagtacacagcacagccagcagattagtgtctctgctgcttcaagtctcttgcttctaaaccctcttttgaatggcctacccaagatatctctcttttggctaactttatgttgtctgattgggaaccttaattacacctcaaaattcactcactcttgctgtattacataacataatggtgggagtgatagcccagcacctttgccatattgtattggttagaagacagctgcaggtccctctcacactcagagggaggggattacacaaaggcatggaaaccaggagacccacatgagtgtggccatcttagagttctgcccaccaaaggtaggcaaaaatgcagagatttgtgaggaaattgtgcagttgaccaacagtagtcaatagtagtcataactatctctgttagttttctcatctgcaaaacagagaaatatgataattaggtgacagtattattgcaaagactaatgagataatacatgcaaattttgttttacaattcttggtatgctggttctccattataaatacatacgattattattgctgttattattaaggatattatttgactttgccacctttagtgtgggaacctttaatctcatcaataataatttctcagtttttattttatttgtaccgagcagactctttagattaaaaagtgcattaagagagattgtctgggtttttttggttcggtatcttcctgtatactgaccttggctcccggaagaatgcatgaactccagaccttggtggattccttatctccctaggacaggcaatgggacaatgaaggaagcaaggaaataaattaaaaatgaaaagttatcttccacattatctgccgcattcatatacttgccaataacattgggccaaatactttggaagtaggtccagggataacattcagactggagaatggaaccgataatatccgcaggcattggatcacccactttttccccaatttatgctatgatatttatgagagcatgagagcatggaaggtaattccaactgctgtattaatgaactttcagtgtccctaggttgcttgcaaaaataaggcatcttgttggttttctgggtaaagatgagtctgacttgtattttatgtactgtgttcctgttaggtccaaagtctgaaatacctaacatcttcagcagggtgtcattcattcataaaccaggatgaaatacagcctctgtgctgaactttatgtcaaacactatacaaatcaggataaaagtccaaggtctttttgtcgagggattcacaccaagtggtgaaaccccatgtcaattgacagttacaatacaacctgtaacacatgaacgttttcattgcttgtcccatttcaaaggttgatcctatttttcatttacctataacacataaaagtgaaaattagtttctctagaagttttctctattacttaggttttaagtttttatgaagtagctatagagttccaggttttcagatctttttctttttctttgtttatttacattccttgtgtttcttctagatgctttacctaacaacttttaacttttctgctaggatctttcccctttcacttagaatgggaaatcttgcaagcataagaatttctatatattcagtactcgctgcttgctaagtggagatcttaatttaatatttcagttggtttagcagcagccgaacgagggagatgttgctggcatctgcacctgtgtttgacagatgaggatacaaggcatgcatgagcatctgtagcaacttgtttaatgctacattgataacaagtgataatttgagggaagaacttacattttctgcctcctacttctatgaaatttgcactatattaaatctaagtgtgtttaaataaagaaagccagatgtgtcatctttctcttttctctgccttggttcttattgatgacctatacctctcatttccattggtgtttcttactgtgggtctccactgaaagttgtggaaataaagatgaaaatcatgcctaggaaacaaaggaaaagagagaccaggtggcagacggtgcagagatttctttgagaggtacattgcacagatttttcaccccctcagaagtggaataaagttaaggaacaaagaattgagtctaagtccatctgcttcttgttaaatgaaaactatttgttaaaatactctaaaatcatttttttaaaaaaattgtgcattttaaggaggtttggcagtcagtaaaatatattaatgtattctacttttggtaaatcaaaatagaccaacttaatgactataccacacatgtatgtggagatatacataatcacaatgcacacacccagccattaatatcttctctgtgaaatgtttatgactgtaattgctgttctgattatatactgtgtgaacctgaaacacattattatattgggtgactaatggaattcaataacaatgcacagaaattgggattctggaaagagttgagttttaaactgtatttcctcctcagtttgaagtggatttcatgtctcatctaccacacagtatgcttatggctgatggattgaaatctctctgctaaatagtaaacaaccaagacaattcagtcttctcttagcttgcctgctttctcgtcactcattcaaaatatttttgttaaatacccaaaacccattaattagtaataatgggttttgagtattttgttaaatacccaatacctcagtttgtttaagagtttaagagtttctgttttccagctttgtggaattcattatttctttacgactttctttgaaagagagatcacagggtatatatgtggaaaacttgggtttgagtgaagaccctaaaattaattattcatgtattcagtcaataactttaccacactaacaatgcacagaaattgggattctggaaagagctgagttttaaattgtatttcttcctgagtttgataattaacatcttcagcagggtgtcgttcattcacaaaccaggatgaaatacagcctgtgtgctgaactttatgttaaacactgtacaaacagagataaaagtccaaggtcttttgtcgagggattcacaccaagtggtgaaaccccatgtcaatagacagttacaatattattgtaatattactgttaattcacttttatccatgctgttaattcatttttatccatactgacaaaaagagagggcatatccatcaatgcatcagtggatgcatctgaggtcctaagagtgtgatctccaagctttgcagggtgtcattaatggccttggaaataaagggttcttttagtacatgcctcstttaatgattccggtaggttcttttagtacatgcctcctttaatgattccggtaggttatgtgactttaggcacttcaattcctttctcattgttggatggacttcaaggttagagagaacaaattttaatttctttattccacttttctaaagatgtatctaatgttatgaagtataatgcaaaggttctatgggagaacatctgtgacaaacaaaacgatttcaattgttgcttgagtttctgaacacctaggacatttgcttggatagaatatgatttaatcctaaagagaaattattaaaatagcagtcgatggcatttgtcattcaatagttttttcttcagctaactctcaccactaggcacacttttacattcagtaagtgtaatatttttatttgaaagttcccaatataaagaaatgatagttatagattcttcatattaacaaaagtaatgtattgctttatcaatgatattcacatgaaaggccttataacaacatgagtgagtatataattagtgcttctcaaagtgtggtcattggaccagcaacgtcagcatcacctggaggtttatttgagatgcagattctcaggcctgcctcagactcacggaatcagaaagtctgacaggtgacacggagcaaatctgtattttactaagcttttcaggtgactgtaatgcaggctacagttggagagccactgatacggaaggtatgatcatacccatttaatagatgaaaaaattgatgctcagtgtggtaaagttattgactaaatacatgaataattaattttaaggtcctcactcaaacccaagttttctgcaatatacactctgtagtctctctctcaaagaaaggagtaaagaaataatgaattccacaaagctggaaaacagaaactcttaaactgaggaagggcagaaagggaccatttcactgctttattgtaatgagttgttaaaactattgtcacgagaaaattaacctagaaaaagttttaatgatacaagaaacacttttgtggtcatgcattgggttcctcattttctttttagtggcagagagaaagggatgcagttaaactccagaggggtggctgtggtatgttaatagaagtgggagacactatttgaatcatcgctttgtagccaaatgagttcatggacggcatttccacccaggtcttccccacgccacattacccttgatgacagtgccctgcggtggttttcatgcacacagttggcgttaactacccttccgtggcttggggaatgaatcctggaagtggaatacagagttcattatctgtaatgcaaaagtctatataatgatgcctgctaagatctagttctttgttaattcaatttgggctttgcgtatataatcaaacaagttatgtttaagtctattgtttcttcaattgggaggaatttccttaaatagaaaatattacgggccgggcacggtggctcatgcctgcaatcccagcactttgggagcccgaggcgagtggatcacttgaggtctggagtttgagaccagcctggccaacatagcaaaatgccgtatgtactaaaaatacaaaaattagcagagcattgtggtgtgtgcctgtaatttcagctactcgagggctgaggcacgagaatcacttgaacccgggaggtagaagttgcagtgagttgagattgcaccactgcactttagcctgggtgatggagtgagactctgtctctcaaaaaaaaaaaaaaaaaaaaaagaaaaagaaaaaataaaagaaaatattactattgattaggtaaaaatactgtgtgtgagagatatatttttatcctatatagatgtaaaacatcatgcaacatatatggaaaattacatcaaatgtaaatgttagtgttttataaataattataaagagaacacccatgtaatgaccactaaatcccaaagtgattgttgctaatgctccatatacctctgtgacatatcctaagtgggttgtagttttctgcacacaattcctgcttctgtgagtttctacccgcaatttcctctctctgaaaccaccacccaccctcccaccccgatcacacagttataaggctggcaaactctgtctcatccttgtgtactggctgaaatcatgccatagctctctgtagccaatgtctgtagggcactttgaaatatttcctttagcatataatatttgacttgcttgtgaactcatcgaaactgggatcttatctttgtatgttttagtttctcagtactagtgtatacctgatacattgtaggcattcaataaataatgctccagtgaattaattactggcattttcacttggataaacccctcaaaccaacatctccagaatgcactatcattttgcccaaacttctgagtctcagtgtaggaaaggtggaaactgcagcgtgttttatgacttccctctttccttcagtcagttcctccattgccatctctctcctctttcttccaattacttaccttcattttgtctctcatctttcacctctcagatctccacttatttcccatcttctagattaaacttcttcaagcttgattcccttactgtttctcctcttccagcaaatattttggttgtcattgctgtagagatgaagaaacctggacatatgcttgacttactcatgtctggtttttccaccgtttcttcacagagggttctataatgtgcattttctgaagtgaagcattgaacatggttgagaccattgttttctaacactcataaggtaacctccaatattgtggatggtgtggccttcggggaactgtggcaccagtcactctgtattgcaaattccttgctgggttgccacctgtcacaccccaggggtttgggagaatttccacagggtcagacacagcatgaaatgggctaaggaaccctctaaaatggggaaaatgaaacttacaaggtcagagtgagcaagagcagagacccactgtttcctgtccacccttcatctcacagagaggtgtgtcaggagttctgttggaccttctgtgtgggtttgcattcgaggagtgagacttcacctttaatttggcctttactacaaggcaatcttaggtgcagaaaaataatcagaccagtttgcaccagacatttggaactggcagcagctgtttgaagaagttgactaagagcaaaaggtgctggttcttagggagcttggcctttaagaagttacagccactcctatccagaggttctattggcagctgaattaggatgcagtgcctccttccgggagaaggggattcgatgctccatccaacttgctcattgcccaggaatcatagttaggacatctggagtcactttaagacaactgctcactgcaccacagtcctacctggctggtggtagagtccactgtctaatgcagcaacctgtgtgtgtcacaaacctcatggctcagtctccttagccagacatttagggtttccattctttggccatattcctttctgatgtcatctctcatgacttcttgtcacatgttctgtggcctagccaatggaatattgaatgtcctcccacgtgaatccgcttccatccttctacaataccactgtacctgcacctttgcagttcttccctcctggatgcttctctatccttctccctacctcctttccccgcaatgttctctgtctctaagtgtctaaaggccacgaacacctcaaggttcagccaaaacctctggccctttctcatctaggcatttgctcatattttcccctccaactgggaggaacccctccccaacttctttttttccaagcttaatgatttctcataaacttttctctgagcccctaggaaaaaaactgtgttttctttgctgccccccaaccatagtagtcaactttaaaattggcattaacacattcccccttgtcttacacatatacatttctttacactcctatttgatgacaggtccatccaggaaagcaatcatatcttctatgccttattccctagagtaacttgtgtattacaggtgttcaatgatgggtaatgattaagtgaaaagatcagggcatgaggtatgtgtgcaaaaggctgggggctgtcagaggcagattcgtatctctgccttggccagataagctgggtatgtatgtgagccgatgggagcatcccactccgtcctcctccctaatctttctctctaccgacataccctcataccctcacctacgctcagtgactcccaggattatattcaaaagtaagaacaagaagacctgattcatcatgatttaggaatggcttgtaggatagactggggacataaccacacactttttgctttcaaaatgtataactgagcagttagcagttagctgtcttttgtttccaacctaattcaattgagaagtgatataagaggaaagaaatatcccaactgcagagaagtcttcagtcaagtctcaagataatttttttaagtgatgtcaatgacataaaacaaagaggaaaggtctgtgtcgttgcttaacgatttcacrtttttgccttccaggagacagagctactggatctcagccttgtcaaagatgccagatgtgggagacacgccaaagctcccaaggtaggaggttgagtgttgtgcatgcaccagatgctgccttgattgtttggctgtgtcacaatatcaattaattgccccaattaaaagtttctatgttatagatgttgtaaaacacaatagccagtatgccctaaacactttcacttttattaaaagacggaaacaatgaacaaatatgtgggctcttggacagaggggcttgctttatgtcctctaattttgcctttgtttgaaaaaaaaagacaacgacaacaatgcccaagttactgggtaattctaaatgattaaaaagtacttgaaattatttgaaaaaatctttgaacctcgtaaacatatgggaactaaccgttagacatgatgaatagaactcccatatagctgaaatgctctgcaattgaaatgattccatccacaatgccaaaaggtgtatagtcttaattctgcaaatgttactagtaaagatcagcatactttgggatgaattgtgtgcagtgtcatttgttttggtttgaaaaacttactgaagaaatattcaaagaagtgtttgcagtctgtttattttttgaagataatttttaaatattggatgaagaacrtaattttttaagcttagatgatctggtaggatatagtagcaggatatgttgtcttgccatcaaagttaaaagctattcttcattttatttaaaatttagtactttacatacttcatttctggcagagagggtattggcaaacatagaagtacagttgccatttaggagctcaatgcgtctttccatacttgatataaaactagctattttctatttgagtgtcttcccacaacttttgttttatcttttaaaagtcaaaattctttctctgacattaaaatgatctgttgctttggagatgcaagaaaaaaaaatcacctggaataattattcttcagaggcgtaaaaaggcagtaggtgccagcatattctatgacacagcaaacacacggctgctgggttttttaattttttaatttttattttatttgctgaaagggttaaaatgatctatggtaaaatgtaaaaacaaagatttttgaaagaaaaattagaactgtattcaagaaggcttctataagtgtttcatatgaaactaatctgttatttacatttatctccttagtaacatggaatttcaatagtttagcctctcagttttgtatcagacttactataattaatgctttgttgatgattcaaaattgctcacagtttttagtataggaaagaatattttttcttcttcccccaacaacatttcagccaaatttcatataagcctgttagttccaagaactatattgataatgcagctatgaaatttatctttgaacctaagtttattggcctaacttgcaatttcaatatcgatattagttttaaagacagttgccgacactgcatcagagcccygtttgtccccaggcattgggagtcaaagtgaattctgctgccacatggagggtttctttcaggcttgaatctgtctcttttattgcggtacacagcttgcttatcagttaagtgtttcgtttatggatgtggtttgataaatgtctactgaacagtgacaaatgaacagcagtagggcctgtaytgtgctcagctgataaaccactgttagatcctcaaatgcttctcgtgaggatggatttttaacacttagaatactctgactttgtcagcttttctccatcagctctttcttggagggactgattacttcctctttgaattatctatgctcctggcttcctttttttccctcctatttattgctgatgttcaagaacctcactctcctctaatattttcaaagcctggttctattaaacattacctgtgtggctttcctgagactccagcttcttccttgttggctaaakggtgaagataatgataataataagtacttgaaatggttgctataaggattaaatgaaataattcattaggaaacctttagcacaggagttctcaaatttaattgctcatggaattacctgggaaactttcaaaaatgctgatgtgtgttttccgcctccagaaatgctggtaccataagaatcaaattgatacaggtgtggtgtgggcatgatggatttgaaaaacaaatttgcagcaaaatttgagcaccactgccttaacttactcttggtgtacaataagtacttactaaatattagccaatattgttggtagtaacattgttgcttttgttatcactaaaaaattcaagtcagaattgtagaaagccacttttcatttcactcacttaatttggaaatgtttatgtcagcaaaagggatcagaggaggggcttatctcaaagggggttgtggattgacaggcaagaaagaagttgctattactatcagtttaaaatcttcaaatttccagagaaaacctcagctcaaattggacaaataaaaatataatttattgaaaatgactggaatgtattgaaaatttcagcggaattgccaggttcaggtgaagtttcattccactgctcagttaatgtcaccaaggactaggtgcctctttttttcatcagtatgccatgcaaggttctggtaggggttctgatatggcttggctgtgtccccacccaaaatctcatcttgaattgtaattcccatcatccccatgtgtcgagggagagaccaggtggaggtaattgaatcatgggggcagttcccatgctgttctcgtgaaagtgagtgagttctcacgagatctgatggttttataagtgtttggtagttcctcctgagttcactctctcctgcttccttgtgaagaagatgcctgcctccccgtcgtcttccagcatgattgtaagtttcctgaggcctccccagccatgcaaaactgtgagtcagttaaacctctttgttttrtaaactaccatcttgggaagttctttatagcagtgtgagaacrgactawtaccgggtccttttccatcttcaggttccccttggatgctaccctctgcacaccacccttggcagctcctggcctccccacctaacagtgtcatatggggtggcccaaaagagagactagctgcctatcagagaattgtatcaggattacagtataactaccttgtagaagaaggtgtagggcctgcaagaggaaaactagaccattgagttggttagaacaaaagcagcaacaggacttagagtagattaaaagtataaagataccaggataaagtgaagaaagcttggaaactggggacagaaaggcaatgtaacaaaaggacagattgagtgcaagactttctgcrggggcttatagaccataaaggaaggaagaacatttgtgaagcagatatttatcaaaatacccaggcaccccacaaatatttatctctatattcatattatttttgttttttacagcatctcattacataaaaattcaagatctggttgaaaatgarctgttttttgtgcctgctgtgatttgaaataacatttacaggaaatggaaaagcttccatgtgttaccctgtttatgaatttaaatgtcaacccccaacacaatacatgaaattccagatcttcttttctgtatataacctttgttcaagttgccagttttaaaatttcacattagagagaacttgggagatctttatccaaatgtaataaccaaaagaaaaacactgtatcctttgaaatctaaaaggtgcttactttttttcttgctctctctctccctccttccggccctcccaggtttgtagagcacacgtaagggcaagatgctgtggtatatatatcttgtctgtgctatgtacatgtactttctgggtcgtcacttcaaaaagatctttgcttttaaaaaaagtgtttatcactgcggcctctgatctattagtagttcctgacccatcagatccattcagtggctcatgtgcagctttcataaaataaaataaacttgataagagtggaaaataatcttgtcttgtacagaaaaagttgttttttgaaacttttttcatgtatgtgactgtatgttctgagtcacagcataaagtgtaatttttactgtgggcaatacatatcggagaagttttaaaaaggatgctgaacaagatcatttcttcagcctcatgattctcagcatgtattgagtgcttaggggtatggaaaagtggggaaagtggagatgtgggttcaagtgccagctttgccattaacaggcgtaaggaagttgtgctgtctgctggcatctctacttcctcatctatgaaatggggcatgggatacatggttttaggtatgtaagttccgttagcccttgattccagcttttaaattgagaagttaaacacccatgactttccaccttacagattgtaaaactgatgttgaataagtttacataacctgaaacttcttacctccttcatcatgcaaaccaagtgaaccaaaaaaaaaaaaaaaaaaaaaggtcacactctagccaaggtaaggtactatgccaacaaaaaggattaaagacttgtgtcaagcttctttatgtgtggcttctcaaaagcattctaggattgcttttggacaccacagggagcgacctcagggtcacagaggctctcccaactttagtacatgaaaactgtgtgctgccaacttccagctctcaagaatgcacgcagcaatgtcattgaaaaatatttttatagttacacaaaataaactgcttgtcatgctgatctgacaactagtttattctattggtaaagggcagttatttcagatatgtagtattaattttaatgtagattctttgtaaatatctaggccgcaattaaattctaggttgtatgtagtatcaccagaatcacataaggtagattagagtaaaatcaaattttaaaaattgattaggcttttctttcctaatctctacataaacatgatagcttttttacttcattctttattgattcattgattgattgatattcaatgacagaagtcattgagtgactctttctgccaggtactgttacaggtgctggaaaacagcaatgaacaaaaagacaaacagctatgctgtcatatagcattttatttaagagtgagaaagtggtggtagttttaaactgggtcttaaaaaagaaaagaaatcagccgggcgcagtggctcacgcctgtaatcccagcactttgggtggctgaggcgggcggatcacgaggtcaggagatcgagaccatcctggctaacacagtgaaaccccgtctctactaaaaatacaaaaaattagctgggcatggtggcaggcgcctgtagtcccagctactcaggaggctgaggcaggagaatggcatgaacctgggaggcagagattgcagtgagccaagatcacaccactgccctccagcctgggcgacagagcgagactccatctcaaaaaaaaaaaagaaaaagaaagagaaagagaaatccctgatttgctgtgttggctgacttcctttgggcaactatttccatggaggcaaatttcaagctaccaacctgatgtcattgaatgaagagttggaaggcaatacacaccatgtccagtagacctatcagcaggttccagcacctcatggggtaggggaaacagataacagataagtcccactgagaagcataaagcgggatcggagacctgagaaaatgagtgctgggaaggggtctgctgctttacagagccatagtggggaaaggtgtcttgataggaggcagttatatgagtagagacatgaacttagtgagggagagcattcctctttgccggggatacagcaagagcaaagcatatttcaggaatagaggaaggccaatgtggctacygtagagttcagaccttttaggccatgaaaatgacttgggcttttcttctgatggaagagggaaggcttctgaaagttctgagcacagaagtgatgggatctgagcttttgaaagttccactggtggctgttgggagtaaactacaaaagagagaagcaagcagaccaactaaatggctgctgcagatatcctggggtgatgatgataactttgcctgaggtggtagctagagaggtggtgaacaaagtgacataatctgaatatgttttaagatagagacacagggtttgataatgtattggatgtgaagtatgagcaaaagaaaagattctagaacaactattagtgttttggcccagaaaattgggagaattgggttgccatgtcctcagataagaaggaaggaagagcatatttaaacagaaaaaaatccagaatttggttctggatatttaaatgttgagatgcctgctagacttttacctgataatgtcaggacagttagacacaagtctggggtttagggaagatgttggccctggagatacaaatgtgggcatttgaggctcaaatcctgggtgaggtctcttaaggaatgtaggtgtaaaagaaagaggtttgagatctgagacatgggattgccagcatttagactttgaggagacttggaggaaacagcaaaagagactgagaatggtatatacgtaaaagaatagaaggcaggaacttgaacagacacttgtgtaccaacgtccatcgatggatgagtrgatatacaaaatgtcgcatacacttacaatggaatattgtttagccctaaaacagaatgaaattttgacacatgctacaacctgagggaaccttgaagacattatgctgagtgaaataagccagacataaaaggacaaatatagtatgactctgttcttatatgaggtacaggcataccgcagcagcattgcagatttggttccggaacaacacaatacagtgaatattgaaaaaacataagtaatacacattttttggtttcccactgcatgtaaaagttatgattacactatactgtagtccattacatgtacaatagctttatgtcttaaaaatcagttatttttagacataattttacaattaaattaaataaaaaatattttattggtaaaacatgctaatgatcatctgagtcttcagcaagtcacagagggtcttgcctcgatatcaaaggctgctggccattcagggtagtgattgctgaagattagggtagtggtgacaatttcttaaaataagacaacagtgaagtttgcaacatcagttgactcttcattgcatgaaagatttttctgtaacatgaaatcctgtttgatattttacccacagtagaacagtagaactactttcaaaattggaatccatcctctcaaaccctgcttctgttttagcaactaagtttatataatattctaaatcttttgttgtcgtttcaacactgttcagtgtatcttcaccaggagtagattccatttcaagaaacgactttctttgctcattcataaaagtaaccccttgtctgttcaagttttatttatttatttttacttcttattttgttttatgtttttaattttactttaatttctcggatacatgtgcagaacatgcaggtttgttacataggtatacgcatgccatggtggtttgctatgtctattgactcgtcctgtaagttccctcctctcacctcccccaccccccaacaggccctggtttgtgacattcccctccctgtgtccacatgttctcattgttcaactcccacttatgagtgagaacatgcagtgtttgattttctgttcctgtgttagtttgctgaggataatggcttccaacttcatccatgtccctgcaaaagacattatctcattactttttatggctgcatagtattccatggtttatatgtaccacattttctttatccagtctatcattgatgggtgtttgggttggttccctaactttgctattgtaagtagtgctgcaataaacatatgtgtgcatgcgtctttataatagaatgacttatattcctctggctgtatacccagtaatggaattgctgggtcaaatggtgtttctggttctagatccatgaggaatcaccatactgtcttccacaatggttgatccaatttacattcccaccaacagtataaaagcattcctatttctccacagcctcaccagcatctattgtttcttcactttttaataatcacgattctgactggcatgagatggaatcttactgtggttttgatttgcatttctctaatgatcagtgatgttgagctttttttcatatgtttcttggctgcataaatgtcttcttttgggaagtgtctgttcatatcctttgcccactttttgatggtggtatttgttttgttttgttttttttcttgtaaatttgtttaagttccttgtaaattctggatattagacctttgtcagatcggttgattgcaaacattttctcccattctgtaggttgcctgttcactctgatgatagtttcttttgctgtacagaagctctttagtttagttagatcccatttgtcaagcttggcttttgttgcaattgcttttggcatatttgtcatgaagtctttgcacatacctatgtcctgaatggcattgcctagattttcttccagggatttttatggttttgggttttacatttaagtctttaatccatcttgagttaatttttgtataaggtaggaggaagggatcaagtttcagtttcctgcacatggctagccagttttcccagcaccatttatttaataggagatcctttccccattgtttgtttttgtcaggtttgttgaagatcagatggttgtaggtgtgtggtgttctattccattggttctgtatgtctgttttggtaccagtaccacctgtttcggttactgtagtattgtagtatagtttgaagtcagctagtgtgatgcctccagctttgttctttttgctcaggattgtcttggctatacaaggtcttctttgatcccatatgaaatttaaagtagttttttctaattctgtgaagaatgtcaatggtagtttcatgggtatagtattgaatctataaattattttgggcagtacggacattttcatgatattgattcttcctatccatgatgatggaatctttttccatttgtttgggtcttctcttatttccttgagcagtggtttgtagttcttgacaagatccttcacatccctcgttagctgtattcctaggtattttatgctctttgtagcagttgtgaatgggagttcattcatgatttggctctctgcttgtctattgttggtgtaaaggaatgcttgtgatatttgcacattggttttgtatcctgagacttggctaaagttgcttatcagcttaaggaatattggggttgagatgatgtggttttctaaatatagaatcatgttgctgcagacagagacragttgacttctctcttcctatttgaataccctttatttctttctcttgcctgattgccctggtcagaacttccaatactaggttgaataggagtggtgagagaggccatccttgtcttgtattggttttcacagagaatgcttccagttttttcccattcaatataatrttggctatggctttgtcataaatagctcttattattttgagatatgctctatcaatgcctagtttattgagagtttttagcatgaagtgatgttgaattttatcaaaggscttttctgcatctattgagataatcacatggtttttatcttggttctgtttatgtgatggattacatatattgatttgcatatgttgaaccagccttgcataccagggatgaagctgtcttgatcgtagtggataagttttttgatgtgctgctggatttagtttgcagtattttatcgaggatttttgcatcgatgttcatcagggatattggcctgaagttttttttgttgttgttgtgtctctgccaggttttggtaacaggatgatgctggcttcatgaaatgagttagggaggagtccccccttttcatttgtttggaatagtttcagaaggaatggtaccagctcctctttgtacctctggtagaattcagctatgaatccatctcatgctgtgctttttttggttggtaggctattaattactgcctcaatttcagaacttgttattggtctattcatggatttgacttcttcctggtttagtcttgggaggttgtatgtgtccaggaatttattcatttcttctagattttctagtttattcgcatagaggtgtttatagtattctctgatggtagtttgtatttctatggggtcagtggtgatatcccctttatcattttttagtgtgtccatttgattcttctctcttttcttctttattagtctagccagcagtctatctattttgttaattttttcgggaaaaaaagaagaagctcctggattcattgattttttttggagggtttttcatgtctctatctccttcaggtctgccctgatcttagttatgtcttgtcttctgctagcttttggattagtttggccttgcttctataactcttttaattgtgatgttagggtatcagtttgagatctttctagctttctgatgtgggtacttagtgctataaagttccctcttaacactgctctagctgtgtcccagagattctgatacacgttgtctctttgttctcattggtttcaaagaacttcttgatttctgccttaatttcattatttacccaggagtcattcaggagcaggttgttcaatttccatgtaattgtgtggttttgagtgagtttctttttctttttttttttttttttgagatggagtcttgctctgtcgcccaggctgaagtgcagtggtgtgatctcggctctctgcaagctccgcctcccgggttcacgccattctcctccctcagcctcctgagtagctgggactacaggtgcccaccaccacacctggctaatttttttgtatttttagtagagacggggtttcaccatgttagccaggatggtctcgatctcctgacctcgtaatccacccatcttggcctctcaaagtgtctttttttttttttgagacacagtctcactctgccacccaggctggagtacagtggggcacaatctcagttcactcttgtgctccacctcccgggttcacaccattctcctgcctcagcctcctgagtagctgtgactacaggcacctgccaccatgcctggctaatttttgtatttttagtagagacggggtttcaccatgttagccaggatggtctcgatctcctgacctcatgaccagcccacctcggcctcccaaagtgctgggattacaggcatgagccaccacaccctggccttgagtgagtttcttaatcctgagttctaatttgattgcactgtggtctgacagactgttatgatttcagtacttttgcatttgctgaggagtgttttacttccaattatgtagttgattttagagtaaatgccatgtgatactgagaagaatgtatattctgttgatttgggttggwgagttctgtagatatctgttaggtcccgttgatccagagctgagttcaagtcctgaatatacttgtaaattttctgtctcattgatctgtctaatattgacagtgggatgttaaagtctccaacaagtattgtatgggaatctctgcgtctctttgtaggtctctaagaacatgttttatgaacctggatgctcctgtattgggtgcatatatatttaggatatttagctcttcttgttgaattgatccctttaccattatgtaatgccctttttttgtctttgttggtttaaagtctgttttgtcagagactaggaatgcaacccctgcttttcttttttcttttggcttccatttgcttggtaaattttcctccatcactttattttgagcctatatgtgtctttgcatgtgagatgggtctcctgaatacggcataccgatgggtcttgactctatccaatttgccagtctgtgtcttttaattgtaacatttatcccatttatatttaaggttagtatggttacatgggaatttgatcctgtcatcattatgctatctggttattttgcacactagttgatgcagtttcttcatagtgtcattcgtctttatattttggtgtgtttttgcaatggctggttttcctttccatatttagtgcttccttcaggagctcttgcaagtcargcctggactaaatccctcagcatttgcttgtctggaaaggcttttatttctccttcgcttatgaagcttagtttggctggatatgaaattctgggttgaaaagtgttttctttaagaatgttgaatattggcccccaatctcttctggcttatrgggtttctactgagaggtctgctgttggtctgatgcgcttccctttgtaggtgacctggcctttctctctggctgctcttaacattttttcctacattttgaccttgaagaatctgaaaattatgtgtcttggggttgatcttcttgtggggtatcttagcggtgttctctgtatttcctgaatttgcatgttggcctatcttgctaggttggggaagttctcctggatgatatcctgaagtgtgttttccagcttcttttcattctccttgtccctgtcacktactccattcaatcgtaggttcagtctttctrcatagtcccatatctcttggaggctttgtttgttccttttcattattttttctctaatcttgtctgcatgccttatttcagcaaggtggtcttcaaactctgatatcctttcttctgcttgattgatttggctattgatacttgtgcatgcttcacaaagttcttgtgctgtatttttcagctccatcaggtcatttatgttcctctctaaactggttttctagttagcagctcctctaaccttttatcaaggttcttagcttctttgcattggattagaacatgctcctttagctcagtggagttttttattatccatcttctgaagcctacttctgtcagttcrtccatctcatcctctgtccagttctgcacccttgctggagaggcattgaggtcctttggaggagaagaggcactctgcattttgggttttcagtgtttttttgttgattctttctcgwctttatgagtttgtctagttttgatctttgaggctgctgacccttggatggagtatttgtggggattttttgttgttgatactgttgttgttgctttctgtttgtttgtttttctttcagtggtcaggtccctcttctatagggctgctgcagtttgctgggggttcacttcaggccctattcatctggtttgctctcgcaccaggagatgtcactcaaggaggctgtaggacagcaaagatgggtgcctgctccttcttctggcatctctgacctcaaggggcaccaacctgatgcgagtaggatcgctcctgtatagggtgtctgacaaccacgttggagggtcttacccagctgggtggcacagggaacaggacccatttaatgaagcactttgactgtcacttggtggaggggatgtgcttcgctggggagaaacccactcttctgggctgcctggattcctcagaactaccaggatgaaaggctaagtctactggtccacagaaactgcggccactcctctccctggggctcaggcccaggaagatcagggttctttccctgagcctctggctggagttggagttcctgcaaggagtccccaccaagtgagaaaggatgagtcagggtcaggcctgaagaggcactctggctgcagtctgccacagctggtgtgttgggctgtgggggaacctcttgggaccaagctgcccagcctycctggccccaggagaggaaaagcatggcctggagctgtagagatggatgctgtccttccccacccagggagcttagcgtgacaggcagttacaagtcccagtgctggctgctgcccctcctccaaggagttcaaatggcttagacagcaggcagccacagctgtggtgctggtggcccctccccctgggaacttggcaggcttaagcagattcgagctgagaggctgttgagaatctgcacagctctggggttgggaccctaggccccagtggcgtgggttcacgagtgggatcttccgatccatgggttgcacagttctgtggaaaaagcatggtttccccggctgggtagcacgctcactcgctgcctcccttggctggggggtgagggctcccctctcccatgtggctctcaggtggaccaccacaccacactgctcttccttcctctccatggatcatgccagctgcctcgtcagttcygatgagagaacctggatatcttgattgctggtggaggattcacacactattatgattctttttgatggagcctctctgatggctgctgctcctagttggccatcttggccctgcctccccgttcaagttttattataagattgcagcaaagcagtcacacctttaggttctaataataattattgtcctctagcaatttctaccacaactacagtgactttctccactgaagtcaaagtcgtccatgaggattggaatcagcttcttccaaactcctcttaatgttgatattttgaccttctcccatgaatcttgaatgttcttaatggcatctagaatggtgaattaaggttttaaatttacttagcccacatccatctgaaaaatccctatctatagcagtgtagccctacctaaagtatttcttgaataataagatttgaaagtcaaatttattgatccatgggctacagaatggatgcgttagctggtataaaacaacattaatctccttgtatatcaccatcagagctcttttgtggccaggtgcattgtcaatgagcattaatattttgaaaggaatcctttctcagcattaggtctcaacagtaagcttaaggtatttagtacaccatgctgtaaacagatatgctgttatcagattttgttgtgctgtttatagagctcacgtgaaataggtttagcataattcttcagggccctaggatttccagaacagtcaatgagcattggcttccacttaaagttaccaactgccttaatgcctaacaagagagtcagcctgtcctttgaagctttgaagtcaggcattgacttctctcaagatatgaaggtactagatggcatcatcttccaacagaaggctgttttgtctacatggaaaatctgttgtttggtgtagccaccttcatcaatgatctcagctagatcttctgggtaatttgctgtagcttctccatcagcacttcctgcttcaccttgcacttgtatgttatggagaaggcttctttctttaaacctcatgaaccaaccactgctagcttcatacttttcttttgcagctttctagcctctctcagttgtcacaggactgaagagagttagggccttgctgtgggttagattttggcttaagggaacattggggctggtttgatcttctatccagatggctcaaactttctccctatcagcaatacgtttgctttgctttcttatcatttgtgtgttcactggagtagcaattttaatttccttcaaggacttttcctttgcattcacaactgggcggctgactgcttggcacaagtggtctagcttttggcctatcttggsttttgacacgccttcctcactcagcttaatcttttctagcttttgacttaaagtgaaaggtgcatgattcttcctttcacttgtacacttagaggccattgtaaggttattaactggcctaatttcaatattgttgtgtctcagagaaaagggtggccccaggagagggagaaagataagggaacagctggccaatggagcagtcagtacccacacaacatttattcattaaattcaacatcttayataggtgcagttcctgatgctccaaaacaattacaatggtaatatcaaagatcactgatcacagatcaccataacagatatattaattattcaaatgttgtgaaaattaccaaaatgtgacacagatacatgaagcatacacatgctttgtaaaaatggmaccaacagacttgctggactcaggaatgccacaaaccttcaatttgtaaaaacaaacaacaaaaaacccccacaatatctgcaaagcacaatgaagcaaagtgcaataaratgaggtgtgcttgtagctattgtagtcaaatccttagagatagaaagttgcrtggtggttgctgggcctgggggaggagaaaatggggagttattgtttagtgggtacagagttttagtttgagaagatgagaaagttctagagatggatggtggtgatggttgcacaacagtgtgaatctacttaatgccactgaactgtacacttaaaaatggtaaattatatattatgtatgttttaccactttttttaaaaaaaaaaaaaaaaaaaagaagaaactgagaaggagcaaccagtgaggagggagaagaaccagaacagtgtatttcctggatgcctaaaaaatatttcatggaggaaatcaaatggtgaattcaggtcaaatgatgaatttccttctagcttttctttttttatggagacttcactttggcacacttgtaactttactgacaatacccttttrtatatgcttttttttcccttatatcatgaccgtttcctgctaatattcaaattaggccgtttatttaagggttgtcaaatctcaaatagctcatcatagaatctggatgccaatatataaatctcataatgagctgttatttggatgttatacaacagtggtttcaatgaatcatccatgaggcctggagttgaaatgaatgctttatttattgtctcccattgctgattataagctgtttccctgactttgtacagatttcaccattatgtgaagccacagtcataaaatttggtatagatatttgaggtttaggaaagaagaagaaaactctttacacaacaaagtaaaggtttctccttttttctcctgattgctaaggagatcaacctttgacccttattcttggttccaactatttcttaatttacctaacatgcttcagtagtttttttggtttgttttttggtttgttttgtcattttgttactataaatgtgtttttatttacatctttactaaatggagcaaaatagggctaacaacttattgaatgatctgtgtgtgtgcgtgcatgtgtgtgtgtgatggttttgacagctattcacatttatctttagatgtaaattatatggcatagttccttttttatgttcattaaattccatagatgtcagtggtttccttggaaacaaaaacctttatataactagtcagagatttggtagcagaaatatcaggatgctggcaggggttcaggggtggttaaggaatggttcccttggcagatgtttgcatttaaaactcttctgacttttctccctgccccttaccatcatggccattcaatagtgcacaagataagatttttaaagctactattaaaatgtagaatattttctttaatggctaaaagctttttactttaaaaaaaaatcgcagatatgttaagtcttttctggggtggtataatttcccaaatttgagaagaggttggtgtatctcctatcaacagttaaatctgcatgtttaggcaatgcctacatttttcagtatatatggtgtccatttgtaaaatacagtgaactgcatatgtgtgtggttgaatcaagattctatgtcatttataatggccagcatctgtcctattaccttattgccaaagggttctaaaggacctggagaggttgtagagaaggtaagggaaaggtcacggttctgctcaagggtaatagtaggtgaaaggcctggcagccaagaacattctcacggaggcccagagtggacctgttgttgaagacagaattagtaccatgagttaatgaaacccaggtcttttcagaagattgtgactcatttttatcattgcccctgtctggtgtaatttcaaygtaaatccaatttgttctacatgcaatggtacatagttgcatttgggaaacatttctcaattttaattcttttaaacgcaataatgcgccatcttgtggacatatccgatattaaattcttaaattaattctacatagygaactgctctctaagccagggttttcaatcatgggttctaatatagagatatgagaagcacttggggagcttttaaaatcctgatgtgcaggccacaccccaatcaattaaattgaaatgtctgctgtggggctccaacactgatattttctttaaagttcccaagagattccagtgttcaaccaagtttcaaaaccattcgtctaagtaaaaagagtaccagcttaaatggatgatttctcttttgaaaatagagattttacacagaaaagcattgagaattttcctacaaaatatgcttgtcaaaaggaccacttttcagtcaagttttccttaaacttgaccactatacttaatgtagagaagtacaccacggtacttgtatcagtcttctctggttaccacagcaaagtaccacaggctaagtggcttaaagcttaaacaacagaagtttattctctcacaattctgggagcgggaagtctgagacaaaagtgccagcagggttattttctttggaggcctttctcctcggcttacagatggctgccttccccgcatcttcacgtggtcctccctctgtttctattcctaatttcctcttctaataaggaacaagttgtattgcattagggcccaccctcatgaatgcatttaacttaattacctctttaargcactattgctaratactattaccttctaaattactgggggttaatacttcaacatataaatgttgaggggacacaagtcagcccttaacagtgttccctcattacattacaaagcctagcttaggatttgcttctttataaggagtagcagtgtatgattattttgctgttggtttaatatagaaaagtagatttttttctttataatcaatacaatggtcaatgtggataaaactgcatagtcagaatcatttcagaaatacacaattgcttttgcagagtggctttagtacagaatatgttgatttggcattatcagcactaatttctgcatgccccagggcacccagtatgtgtctttgtgtattrcaagtgcctataagagtatagttattaaggtcacaagctcttgggtcagaaagccaagccacaacaccaataacaagctgtataatcctgcaagttatatcatgtctctgagacttagtttcttcatctgaattacaggaataatcgccatgtttatatcatctagttgcggtaaggactaaatgacaaaatgcacgtaaggcacctaacacaattgtcacatccattgtttgtctaaatgcattttgccatcattattaagtaaataaaatatataacttacatgtatgtgatgtagtgggaaaaagcaagttaaataggcataatttacctatttaccatagaattccatgcactaatatagattgtcactataatctatatttatatatatagattgtcactataatctatgtataagagatttatacttttgtagctgtggcatttaaacctactgattaaaatctaacttctatgtattagctatagaaaaatgaacttgaggcatatttmtctttgcagccaaacacctacccccagagaactatcacagcaatattgttgtactaagacttacagttcttatttagaaaactgtctagatttgccaacagttaaatagattttccaaccatcaaaataattttagagcaatttactttcagttaagaacatgcgggtatctttttctgcactatgaagtcattgaagcaaaatccaaagcactgttttgaaatggaataacaaggttaggggtcagagagacccagattcaaactccagtgcacttattagctgagagaacccaggaaggtttattggtttccctgtgaatgataatacttgctgtattgatttgtcttgctagttggattttaactggtaacaagacataaatcataatgtttgatactacttacttccctatgggccttaagttcacttttcagtgtattcttcttaatgttctgtgagactggtaaataatgaagtatatatatatatatgtgtgtgtatatatatatatatatatatatatatatatatatatatacacacacatatatatatattacttgaacttcctcaattttggagattaggtcataaactaatgtggcatgtaatttgatacatgttccagcaggggaaaatactgggatgtaatttaacgaaagaaacattttgaaatgggaatattctctgaaaatatggagtatatcattacaattccttttcagctttaggactcataataaactgggcactgtccagtttatgagcagcgagttcctatagtttgaaagtttgcgtcccctccaatattcatgttgaaacttaatcgccgatgcaatagtatttaaagttgtggccttttgaaggtgattaggcaatgagaactcctccctcatgaatgtgattaaggtccttataaaagagatttcactcaaggttcagtcttttttgcccttcctccttggcccatctgaggacacagcattcgaaatgccaccttgaaacagagagcatccctcaccagacacggaacctgtctacgccttgattttgagcctcccagccttcacatctgtggaaaataaatttctgtaaatatttcccacctgacagatctttgcttataaattggccggtctgtttgttatagtagcacacatagactaagatactagtttttaatttgggtactgcagctgatggaataacctgggtagagtcataccatcttttaggaatctcaccttcctcataaaaaatgaaagagacaagcaggatgatccctggggactaaaggtaatatttgtatccatcatggagctattgggagaactaaatgatatacatctctcaaatggatttgccagccataatgtgtgatatagtaatatcaatttgtgagtaagttgggtagagtggaaggaacttaggaatgtataccagtttattctgagaaatttgtgttttgtcttctttgaatgggaaatggctgaaaattcttaaattccttcaatgtaccataaaaaagtgaaatcctatatcactgcctttggatgtgatacatgacccatagtaggtattttcgtagatgaaagaattcctatctatggcatttatcttatgtgaaaagtggcaattaagatagtaacatatttgccacttaacagatatttgttaatgatgaaataaagttttccggaactcctgaaattaatgtccatagagatttcaagaagatggaataacctaactaattagacagtatgtttgttggtgtttaaaggtgagacaagaccactgagattaaaagatcagaaaattctcctcacacacctaatacattttctctatgccacctggtacttctgtactcaaatgctgcttgatttttatatttatacccaagaattactgatttcaggtaagaacagagggcttgagagaagaatttgctcatcactgcctgccatgaatgggcatagctctgtgaacagttattgtatttttttttcctcaggtatatagaatactttatcaaaaccaaaactcactgtttctccaagtgagttccttggaatactaatagatgctataaaaatgtcatctaggtgtggtggctcacatctgtaataccagcactttggaaggccgaagcaggaggattgcttgaggccaggagtttgagacccaaagccctatctcttaaaaaaaatataggtggatgcagtggtgcatgcctgcctatactcccagctactcagtataggctgaggcgggaggatttcttgagtccagagttcaaggctgcagtgaactgtgattgcaccactgcactccggcctgggtgactggtcaaataagtttgggaaatgctaagggttcctttattgcaggatttctcacagcttttgatgtgttggacatgggttagtgtcacttctttcttttttctttaactatgggtctcttggtcacaagcatctcataggattaatataaatgttctaaaagccatttattatgaagttaaccacacttaataaactagaacaccagtttatgagtgatgcttgtcttcacagtagtgcagatcctattaaagatgtttagagaacaggttcttaggtgatctaaaccagaaaggcctttttcatatatcttgataatattaatataatgttgaattttgtcttgtattatattatgatgttttgaattttaaagtttactatttgcattcttcccacctaattaatttttttaatttgagaccttatgacagaaaaccatcagcattgcccacatattactcaaaacacaagaatttcatttattcccatagcacctggaatctatgctggcatttagwcaagcctaatgcctagtgtaccactagagtgagattctctgtccactcttaactatttctagagcctatttttctatggtttcacatcttatgacttatataaaattggtactacttggcctttgtggaaggattttaagtcaaggtaaaccttgaattgaggttagattaaaagtggtagaacttacttagggagcaataacttttaatagtcatagtttcttttcggttcctggtgtgtgtgtgcagaaagaaagaagtctgatgattctctggttcatgggagttgacttttatgccctgaaagtgaggctttgcttctgtatcctcacactggggaacagcagtggttaagaggctccaccagtattactcatgtggtcacaatcaagttgcttaacttcatgtcttgctttcttcatccataaaatgaagttaatagtactatttctcagggttattgtgaggactaaaggccataacatatatttcataataggggatctgtaagttgtagttactgttatccttaaaactataggccattagtgcatatgtttaataggcttgaagctgtgccattatttgacaagttaaactcttggttgcatcatccatattctcaatgtttttctttaggtatttgcatttgccatctatagtatataggcttctatctggcaaagttttcacttttaatggtatctttaacaatatttttcaaaagctttgagcatcactcatatttcaaaaatagtaaggtcatgttaaacttttaaattaaatcgtttcttcctagactatttcaagatttgtaatacctggttaaaattgtttagcaaacacaatttttctttctatgaatgttaattaaaaattaaatttgactctctttagttgaaattagtcattttgtatctgtgcatgaattacattttccttgattcttatagtaccttagtataaataaatttagtaagagtttaaaaagaagtttccttggttgaggtacatacaaacaatatgggaaattgaacacctattgactttattatttttgccatagataaatctctactgtcgaaagcagtagttaatgagacatttattttattttatgggtctctgaaacatgcttctctattaatcaatttgcttgcaattttgtttgaagattaaagattctttagaaggcattgtctacatattattacttatggataccagatgaaaatctaaataaaattaatttaagatctcttatattagttctgtcctacacatataccaaagaatgtggaatggctgaataaggaaaattaaattttaagtttacacaattttaaagtcaataatgctttcaaataaattatctatacataatattgaaaaggaatagctcttagaatatctaaaataaaaatagatgattgagtgggatatttcacatgagttggtggtttataaaactttgagaaagtatgttaaagaataaattgtgtaagtaatagcgaactagactcagtatttaattttatgcttagctgctcaaaatttcatggtttgagttgagaattcttaagtcaaataatttatttgaaggatactgtagagcatttgaaatactgtgaaggtgtgactagaaatctgtttttcccattttaaaaaaaaaacaaattgttattctagactataaaatatagaaagtcataatagatggatactcttctctgtaaatatattttcccctgatacttaactgtaccatgttattctaaattattcctggtaaatgcttacaactcttccaagtgtctggaaactcatcaagcttcttttaatcatgtccctcaaatattcggcttgtaatttactaatattcatgccctgtttagattgtaaacagagaaactacaaagttgtaacagaaaagtaatatattgagctgaatcatgccttacttttgtaagttgagcttgtttctctggcaacaagatgttagataataaatcatatatctaaaaccatataactacagaagtggggagctgaaagttcagaagtatcatctgactgtgttgatggcatctttacctcaattaataaggtgtggcaaygttcactcaaggacagaaattcaatctgtggtggatccaaggggattcaaaatatttcttttaatccaaccaaaacatattgctttaatggcattagttggtattagttgcatgtggcaaaaatttcatgcactattaatcctagcactacactgcaacactagaattatgtgtccttggccttaaataaattattcggttgtatgattgagaagagaaaaaccaattattttagaggccagtcctgaattattgccttaataaaggttcaatttcaaaaaaatgggaagttgctcagtccagttgaaaaacaaggtgggaagagtaacagcaagtgagtctttaattttgtcaacatctgatgctactgttaacacaaaaagttgctttgaaaaaaattcaactaaataagttgccttcgtggtttagtaattccagatatacacaatcgtctgtttattttcccaaagatcaaactgtgttcatctatatatttgcatacgtaacatattaaagttttctcatctaacatgacactgtaagcatggccatgattctaaatatttttaatatttatcagttgtatagctgaataataatgcattgattggaaatcatattaactacttactatttacttttgagtagacaatttctgttttatttttgctattataggtaaatctgaagcagatatctcttcttcatttggcgtttttattctttggtaatgcctcaaattgtaatcctagcagtgagattacagatccaaatagatctaattcaatccattatcacaggtttcttcctcatttcctcttctttcatgtatatctgtttttgtatagtggcaattttgattccttactgcattaatgtattcacttctttgtcatagtctacacaaaataattctagaataaaaatactgttgctactaatacaagtccactagagaaaatccaacgtttctttgcaattatctttattccttattgtatgcttcactaagaatatatactccaagattattaaaattattttctatagagttatattattaatttgctatacacttagatttatatatttatagttacgttcagttttagagattaaaatgctctattgcttttatcaattttacatttggaaagtataaaatattcctttgcctcarcattcaaaattatataaagaagaatgctcagggaagtcactctcatccatatccttccaccctattcctacccaccttctggttttccttaccatgtttctgtttacaaaaataaggaaacacacacacaaacccatacctagctacccagtcctctcatctcatttaataaaaagtccatctttccccagtgaattgagacaccagttttttcaaaatatatrtaaattgcctcagtctttcttacacaaaatgtaacattctatctatgtgcttttataggttgcctgttttacttaatataacgtcaatacctcttcatatgggtcatgggaatctttttcattcttttgtacagctgcatattgctccactatatggaggttctgtagttttttcagtcttctgtgaatgagcatttaggttgtttccattattttttattatgcataaggctacaattttttttttaaatgccttcctttacatatgcaaaagttcagtttcaggataaattcctagatttgtttgttttgctaacatcttcatagactttttctttgtttagattttaccattttctaccccccttgcagtgtattacagaatctttattcacacagtctcaccacaaagtgtattgttaagcttgttatttttgccactttgacaggaaatgtgattaatacattttaacttacctttttcttacctatgcatgaaactaagcctcctttcacatgtttaaggaccatgcatgtatatacatacatatatttctaaaacatatataaatatgtatttatacacacatatatgtcttaataaatatatgtcatatgttttaatatgtcataatatatgtcttaatatacataaatatgtcttagtcactttggacttctataacaaattataaatatgtcttagtcactttgggcttctgtaacaaattaccatagactggtggctgaaataaaaacattacccamagttctggaggctgggtagtccaagggcaaggtgccagcaaatctcatgtctgctgagggcccacttcttggtttgcagttggctgcattctcattgagtcctcacataggggaaagcagagagagggagagttgactctctagtctctttttccaaagacactaatcccattttgagggctccaccctcatggcctaatcacttcccaaagtccctacctccaacgccctatcacgttggggtttaagcgtccatatatgaattttgaagggagacaaacattcacttaatagcacaatgctcatttgcataatttgcactttttttttttcatctggtatttcgtcctttttttctccccttggtttttttgagctctttatatatcaggagaattagctctctatcgtaccctagaggtgcaaaaatgttctcccggtttattttttcccttttgattttgcttttggtgtttttttgttgctgttgttgatgttgtttctgccttgtaagtttttgtttttatttttatctagtcaatttatcaatattttatcttattgcttttggcatttgagtcacagttagtaagtctttattcatgcctagtttataaagaaaattcacctatagcttytttttttttttctagtatgacttcgtgattttccatttagatcttggagcatcttggaggttttttttgtttgtttgtcatgaggtatgaacccaattttatttttctaacttaccgttcttttgtcccaacactatttttttcagaccatcttttgccctatcctggtatctaggtgttccaataacatttatttaaaagtccaattgtatatctctttttatttgcaatccagttgtgccaacaccacttatttaaaagtctatcttttgtactacttatcaaaaagtccaacttttgtctaggtgagttaaaatacttacctttttcatatataatgtttccttccatgtgtacctggatctatttctggaatattttttactatttcattgttcagtgtgtctattaatgcttactgaaatactttaaattcaagttctataagggaaaagtggattcttattctagaataacaaaacaattagaaattggcattttttaccaacycattatatcaaatattactctcaatactattctctgctttccaacaaccacctcccaagaaaaaactatttttccctaagacaatttttgtttgtttcatatattttatgtaggtagagaatgccattttctagttttcaaaactttattttttttactttattttttcaaattcctagaaaatgacaaaatcattactagttaaacaattagcaatatcttgtagatttacccacaaagtcccgaaaataaaaataagaaaaaaaaccttttggttattctgccttataaactttcatttttagaaatccatgccatcatataagttgtttgttctataatttctgagctcattttatgtaaaaataactcctgtgcattattcatgttgacaggccctttaaatagccataaagcctgtgggaacrgattaatgctgcatctgccctgtgctttttaagtctatcatttttatggaatggaaatcttgcataatgtcagaagttttctgacattgtcaactgcttgtggtggcatagggaagtaccttagctgcactatgtgggtgacaatgtcatatttcctgattggatttttatctgaggagggtgagaactgtcagtttcacttcctcttagaaagatattttaagttgaataagttttcctttaagtgacttgtcacaggtggcaactgtctgagcctgtgtattctattctttgtgccagaattttcttaccactgattaccaggcacataatcactcttgccatttatgacctttgggaaatgaaaattaaaatgttattagtccatgtgggtagcagtggaattggtctgatgtaatgtttttaaattgtttttattttttgaaataaatgatttttacatctactaaaaagtaaattacaactattaaaggttatcttattaaaaagtatttccccttctccatttcttctgttcccttcccctgaggcaaggattcatagtactgcagtttcttgttttcgtttcccagaaaacctgtaaatgatgacatgctatcaaatgctatttaaacttagcaatttgttgcagaaattatgccgtgtcagcacaaatacaagtcctcattctttttctagaggttgtagagtattatttcattttatagatgtgccataatttatgtacttagtcatttgttaataggcattttattgtttycggttttttgctgcctcraacaatgctttgatgtgtatatatatgtatatataaaatatcatctttgggcacaatacaggtatattcgaatttcctrttggtgaaattgctaagtccaaatatatgtgcatttttaattatgaaatgcattgccaaatggctcagcgaagagattatataaattaatcaattacacttccaccaacaacaatcaagattacctgtttcttcatactcttgccaacaccatgtttgattgaatttttttgatctttgaaatgttatagatgaaaaattgggagctctttattacttaaatttgaatttcttctactgtgagtggagaggaaacttttcatattgtgttgtttgtatttctaaccatatcctttgcccattttccaatatatagttcttctcactgtttcgtaagatattttgatatattaagagctatcatatactggaaatatgatctccagcttttaattttaatttgaccttgtagaattattgccttccagaattatgttttgtagtcaaatttattagtccctttttaaaaactgtacttccaaacagagcaccgcttggaataactattctaaaataataaagattattttgtgatttcttccagtgtttttatgattttaatttttatggttgtatctttgagctatctggaccttattttatgacagtgacaaaggaatctttattagtcaggattaaagtagtccatgataacaaacaactcccaaatgtcagtggaataacacatcaaaaatacatctcttgctcaaaccatctgctgaaggtctgcaaaaacattccaagatagctatcctcagtgatctagggatgtttctgtcttgagctcaaccatctcagcaagaggccttgcatttgctgtggcaggagaaaacagctagagaatcaaagaggattcctcaatgcctcagcctagaagtgacatgcatcccttctgcttattgaccatgtccaagtcacatggcccagcccaattcaaggaggctgggacatacagattccagtatgcccaggggtgaaaggagaaccagtgattagtgagctcataatgtttaccataatatctattttatgttactctagatggctgccaggtcatctaacattacttattgcataacctatttttttctcattgatttggaatgctatcttggttatacactgaaagcttctgtatctttccattttcccctgagatcattgacttttctatatatttttagactagtaataaaatgttttaattattgtggctttacaatatatattacttggtatagtcctgctttatcaagttttatttacatttatattaattttcatttgaatttcagaatcaatttatattgttctcctaaaaaccatgtgtattttttattggtatttctttaagtgatgagattaatgttataacactttatgtctttagcatactacttttatgcaagcagaaaatatgtcttcatttatattcaggttgtcttttgtattccttagtaatgttttaaggtctttatcatatagatcttacagttaaagttaagcttccgctgagtgttacatcactttgatgttttaagtggagctttyatttacatttctaaccaccttttattaaataaaaggaaactaatttttgacataatattatgtatccatgtacttcaccgaatcttttaaaaaatagtttycaggccgggcgtggtggctcatgtctgtaatcccagcactttgggaggccgaggcaggcggatcacaaggtcgggagatggagaccakcctggctaacatggtgaaatcccgtccctactaaaaatacaaaaaaaaaaaaaaaaattagccaggcgtggtggtgggcgcctgtagtcctagctactcgggaggctgaggcaggagaatggagtgaacctgggaggcggagcttgcagtcagccgagatcgtgccactgcactccagcctgggcaacagagcaagactccatctcaaaaaaataaaaaaaaaatttaaaaaaagttttcatttgatttttttcattttaactcatactctctgtaacaattacagtgtcacctccttatttctaaattttatatctatttttgtctttgaatttaagtttatgtattttgatgacttggtaaaattctcatccctttgcagttgggcaaaaattaatcagtgttgtatatgatatcattttattagattctaaactctttgtgagttagaactatttaattaaataaaaatagttgacatctcttataggaaaatcamtgtgtgaagtcccaaatgatataaaaaaagaaataaaacatagttcttatgctcatgattcttacctttgaaaccctccctcctcagccccacaaagccaggcacagtggctcatgactgtaatcctaaggctttgaggggctgaggatgggaggattacttgagcccaggagttcaaggcttccatgagctatgatcgcaccacagcactcctgtctgggtcaatgaagcaagactgtgtctcaaaaaccaaccaaacaaaaaacaacagggagtgtccaaaggctgtaatacaaggtcaaatgtagtaaatgatgtaattgggaatcrtaagaagtgtttggaaatattagattttaatttgcccagtggtgccgtaggttggaatggagggaatgcaggaagatgggcaaggcttcacagagaaggaagcatttaagtgatatgttgatgttcagaaacaagatagcatgtgagcagggtgtagtgacacgtacctgtagtcccagctacttggaagcctgaagcaggaggatcacttgagcccaggaagttgaggcttcagtgagctctgatagtgccactgcaagacagattgtggattgcagaaatggccattgcattcctcaggggaaaatctatactcatttttaaagcttaatttttttcagcatctagaataggtgcacccatgaacattcagtatcttcaggagactaaccatatgggaatggtttactagtaactcatttgtacttgagtatccattatattggaaactaggaccatttctttctcattaattgagagtcatgatttgtctataatgtcctttatgatgcagaatttatctgatactttgagttaaatcaggcttgctttttggctcataagtatttatgtatagacagaaattgtggcttttatctatttttattaagtaaaattgtgactgattttatagcaattaagatgaatttttctttgcagacaaattttattgaaggaatattgacaatcaactttcattgaaagcartgggttttgtgatttcatggaataaatgctctgttctaagagttaactgacctatgtttttgtttcagggttttggctaaatagctgcacatctgtagcacaaagccatttttcctcagtttcctattgtgtagaaaaaacatttgggatcacaaaattcctaggttccttccattctgaaaatttttacactaattccaactttgccttgaatgtctaatgatttgcatttctctatgtaaagcacatctcctggcaccgaactgaaaatgagattagaaaacacctagtagagaggataaaaggtacaagtcctaagcttattttgcattccccttcttccttttttctcccctgagaagcaggatgtcaagctccttggaaaactaatatttcaaaggaaatatcaatttgcaactgaagtatgggattgaatgatttcattgtctcaaaatgatatggtggtgagggtaacattctataatttaaatattcaaagttttgaaaatgtacagattcttttagtaattcttccccagaaatactagtatttactagtagtattttttaaaagcaagtcttctttgcaagatataatcagtattgaatccataaaacagaatattttggaagtatggctttaacaccatggcataattatagctgattatgaccagagttttgaattcaagtaacattaacacaccacaattattgaagttgtatgtatccagattagcaaaatgagcaatatttttctctcaacccttaattcctacatgttagtcctatttcctctgatattttcaggagtcctctttgctttcagtaggtattcaaatgatgactctttcagttctccatatagaagacagaaattagtcttattctcaagctctaacaaaccttcccaaaacccagtgacataaaacaataaacatttgttattgctaatgagtttgcaggtcagctgagtggttctgggttcatgtatgtgtctgtggtcagctgtgggttgatgaagtggctctgctgatttgggctggggtctctcacatgtttcgaggtcatctggctctagactagtctagagttgtccctactcatctccgcgtgttttgttcagctctcccttaaaatcagcactcttctggtttctccaccctggggatatcctcacagtgaaagcagaacagtaagagacagagtggaaacacacaaggcctcttgaggcctagacttggaacaggcactccatcaattaygccacatgctttcgcccaaagcaagtctcaaggtcaagccagttttcccccgatttagcagtagggaaatagaaggagctacagtcatgttgcaaaaggatgtggatacagggaaggtgaagaattgtggccacttttgcaatcaatctaccccactttccttctgagaagctggttgtttccagtgaaatcaaagccagctgaaacctggacaatcaagtagccaaaaaccttccctgttagacttcagcatattgaatttggcttgtaccaatttacagagccagttgttaaacacagctattaaactacataaacttcaatctaaatacattatattgaaaaaagatgatcatgttaatactgtcacttcctactttttattattatccatgttctcaaagttatttataatcattatatccaaatggtaggaatgctatataatgatgctactgacatctctgcccaaatctgtgctcagtgacaccatgttgatagattgaaattggccatgagagtatttacacaagataaattgacaaacactactaattagggctttttttcttcctttttttttttgatagctgcttgttaacatttaccagcccatcattgcctgtatgtgtgatggaggatttgaaggcccaagtcaagtcattcctgcattttatagcatgagttacagatttactttattgacttttatgtgttctatggctttgatggaagaaggaaaatatgtgsatagagtaattgaagaaacgaaattgcttaaagctacattttaaaatcagtaatgaccatagtgataaaagctgtttctctctttctttagtaaactttactggatgtaatgaaaacaaatttattcaacttactagtgtcagtgtacaagaataaccttaaggaaaaatggaagaacatgcaggtaatgttttaaattacagcttcagtcattaaaatatggcatatgcattcaggcaaaaattgtcttgtgttaagtgttttcaacacataataatttcaagatgaaattattgtgaattgaaaagcaacaaaaggaaagtgaggtycactatcttctatctccttgctaatggaggccagaacttatttagttttgtgagtcagatgagttgaaatttgccttccagtattccaaggcagcaaaaggtcattccatctacataagagcctgtcgagcagagagcccttttcataaagaaaattcattgaagaagcactagaaaatgaatataatgcaaagagtaaggctgttcaaattctattattcagttttaccagtattacagtaaattcccagaaaaaacaagaattatagtgattttatgtgagggatcaacttacctgggctctttctggctttttaaaatccgtttattgggggtattttaatgaattgttagaatgtggtattggacagtgggaacttataatgaatatttgagatgtggtgtttcagagtaggaaaaatgagactgctaagtaagtaaagaatcaggattctatttataagcccctgacaatccaaagaagattgttttaactttcagtgtaacttctgaggctacacagcccattgcctcctgatattttaactgttacacataaccaagggaggaaagctagaatgaatcatgtgatactaaaatgagacatgcatagcttaatttaacaaatggataaatttgaaaataaaattttttttaatgtgagcaaataagaaatctttcatacagaatagtcccaagtaacttatgtggttaatgcacccttgataggctggaaaaaaactccccagcctttaaatcacagataacgagtatcttccaaagagtacaatatggaaaaagggaaaaagagtaactttctcagtggagaaacctgacaaacactctgtattagtccattttcacattgctgataaagacacacccaaaacttggaacaaaaagaggtttaattggacttacagttctacatggctggggaggcctcagaattatgcaggaggcaaaaggaacttcttacatggtggcggcaagagaaaaatgaggaagaagcaaaagcggaaacccctgataaactcgtcagatctcttaagacttattcgctatcacgagaatagcatgggaaagacaggcccccatgattcagtgatcttcccttgggtcccttccacaatatgtgggaattctgagagatacaaatcaggttgagatttgggtggggacacagccaaaccaaatcacactccctcagccggtgatcaggtcaacattttcagtattaagtcatgttgctggtttgtaaccttggtgtgatgtaataatgacattatctgctggtcttcttccccagaaccgaaaattccagtctaatcatgagaaaatcatcagacaaatccagattaagggatattttgcaaaayacctgagcaggattccttaaaacagtcaaggttttcaaaaacaaggaaagtctgagaaaactcgtggtataggggaacgtaagaaggcatgatgagtaaatgcaatgtggtatcctaaatgggatcctggaacaaggaaaggacactaggtcaaaactaaggaaatatgaatagaatatggacattagttttttaaaaatatcaatattggttgattgactgtgacaaatatatcatactaatgtaagatattaacaacagcagaaacagtttcccctgttgtagaaggtatagataggagtattctgtctatwctctttgcaacttttctgtaaatctatttatagacatctaaaatagttgctgtagtagggcatggtggtgtgaacctatagtcccagctaatcatgaagctgaggtgggaagattaccgggggccaggagttcaaggctgcagtacatgaggatcacacctgtgaatagccactgcaccactccagcagcctgggcaagaccccttcttaaaaaaaggaaaaaagaaagaaaaggaaagaaagaaagaaaaaggaaaaatgaaataggtactgtaaaactgttctgaattggaagttttttttaaaaaaaaaaatcagattatggcgacataaatattagacatcccttagcaaattctctgatattttaaatcagatgcatgggacatactgtaaatttgtagatagctgaatgcaacacatatttaatacaatgattcttaactctggatagctttacacctttaagcatattagcatttttgtctgagtagctgaaatcacactgtaaaaaaagtcaactgtgttagggtctatttctagctgtgccactgcccagctgtggcatctgaaacaaattacttcatctcacattcggcagcctttctgcccacgccacaaatatagtgctgtgtgttcaggacacttaagaagtcatgtaacagtaataatttttttttattgctaatagctatgtaatcttatcaaggtctatttgaataaagggctctacaatccaaaatatagttgatttactatcaaataaatttaattttcagtattttacatggtattcaacattgtaatttaaacatttcgtttagaaacaagtagcatttctgtgggttagagactgatttggagagaccacatccacattcacttaccatgtgttcccaactaaattagctgaagatgcaaaaacccagtggacataaagtcagggctaagggagagaaagtgtgtattatctaggctttacctgggtaaggaaagggcttttctgtgatggcatgcaactgcctatgacattctttctacaagtagggtcktgatggaattaaagaccataactcgaacttgctatgctacaagccttttctatgggggactatattcccattccacataaacaacattagcaatcaggggtctgcagatattttcttgaatgaaatttgacatctctgaggaccgacaaggatactgctcatatggaatgtatattattwttattattattattattatwgktattattaattttgagatggagtttcgctcttgtggctcaggctgaagtgcaatggcatggtcttggctcactgcaacctctgcctcccaggttcaagtaattctccttcctcagcctcccaactaactgggattacaggcgcccaccaccacgcctggctaatttttgtatttttagtagagatcgggtttcaccatgttggccaggctggtcccaaactcctgacctcaggtgatccacccacctcagcctcccaaagtgctgagattacaggcatgagccactgcacccagctggattgtatattctgttaagagtggggatcaataataggagacaataaacaagcaaataaataatattatttaagaaattgatatgaactatgaagaaaactaaagcagagtcacaggaaagaagatgctgggggatgaggtccccccattgaatctgatttaatacacttttatttgggtggtgcagataatgagttgagtctgaggaaaatgatcataaatccattttcctgatagctaaaaaaaaattagaactaataaaaactgtaattttttataaataaattcacactgtgtatgctttttttctctctgggttggwtcactcaacattatatgcatatattgttgggtgttactgtagattgtccattttctttgctgtgtagagttttattgtatgaatataccaaatgtatttatccattatacaattgacagtcttttgtatagttctcggtttggtgctatgacaaagagtgttgctttcaacatcctaacacatgagtctgacacaaacacctatgggtggaattgctgagtcctagagtgtgcttatattcaatagagcaaagtattttctcaaagtagttgccctaatctacattcctattaagagtacaagagagatcttgttctccacatcctcaccaaaagttgattagtgatccttttattcatttatgtctttctagtgagtgttccatggtaacacctaataaacgatccttttattattaaattaaatttatataatttatttttattgaatttgatgtgcgtattatgcccagttataagtcctgatgcatgaaccacacttgacaygtgagcctctactcataggcccatgcaacctgcttttttttatttttaagttaatttgtaatttttaattgtaatgggttgaatagcagtccccaaaaagatatgtccatgtcctaattctcagaacctatgaatgacaccttatttggaaaaaggctccttgcagatataattaagtatyttgagaggaaaagatcatcctgaattacccaggtgtgtcctaaatccagtgacaagtgtccttgtaagagacatactaggaagatttgacacagacagaggaggaggaggcaatgtgaagatggaggcagaggttagagcaatgccaaggaatgcctggaaccaccagaggctgaaagaggcagggacctgaatctcccgtagcagcgtgacactgatgacactttaattktggacttttgatctccaaaactttgagagtcaatgtctgttcttttaaaccaccaagtatgtggcaatttgttatggcagcctcaggaatctaatacattgaaagagacaatttatcacatcatctaaaactgcaccagtgtgctaaccagcagccaaatttaaaatgtagctggtccacactggatgtactgtaagtgcaaaatacacagtgaattttgaagtcttagtatgaaaaaagggatgcaaaatatatcatgaatacctttgcatgttattaataggttgaaatgataatatattggaaatattgagttaaatacatcttagtgttaaaattaatttcacccatgcctctttacctttttaaaaaatgtgactactggaacattttaaaatatatgtataactcacatattctattagatagtgctacctaaacaagagtgggaacatttagaggtctgtctataagaattacagcctaactgttgtcagtacatcataaattcattcttttagtctttgttcacccaatgaaagagtagacttttattgggcttctgttttcaagttctgttgcacagattggggtataaatatagagatcctkcattccatttgtgtaaactattggggtctatacagagaccccaatagcagaagagcatgtggatctgctacctgacaaacagaggcattttcctgcataaccctttcaaataggagacaatttcctggccgggcacggtggctcactcctgaagtcccagcgctttgggaggccaaggccagtggatcacctgtggtcaggagtttgagaccagcctgaccaacatgatgaaaccccatctctactaaatacaaaaaattagccaggtgtggtggcgcatgcctgtaattccagcttcttgagagactgaggcaggagaatcgcttgagcccaggaggcagaggttgcagtgagctgagattgcaccattgcactccaacctgggcaacaacagcaaagactccgtctcaraaaaaagaaaaaaaaagaagacaatttcctcagtaaagaaattgacgcttataaataataaaattatggatcagcttaccctagttattgcatgtggaggaatacattgtaaggtattattagttattgctacagtaaagctgcataacaaaacccatcaagcacaatagtttacaacaacatgcatttattttattgttcaggtacatatatgctggtgagttatgctgtgtgctggctgagtttggatccagatagccaggatccagttagccaaaaccagtcacatggtctaaccccaaatcagtgggcagagatgtacacaacyccctacttgaccccactgtggggttccagagggtgggactgaggatttgagaacaattatcacatccactacacaagaaaacatcattttcctcttctatctgactgtcatttcaatagcaggttcacattcattgattatctaagatgtgatcaaattatgcagtaagagaagcaggaagtcagagatgagtaactagctaggccctgtcttagaggattttatggtctaatagaggacacaggtccattatttgacctccttgtgcttcctcatccataaagcagatagcactactgcttgctttacatggttatcctgaagattcatatgaagggcaactcatcaagattataagattataaagatatagctgttgtctgtatctgtctatctagttgtccatctagttatttgrtttggccttgatttttaaaaactagctgcagctatattgatatgtgctttggaaataaaacaacatggaggaaacacagcatgttaacgatgcctatatttgggttttggcataatgaagaatttgtttttctttttatatgtttcagtatttcctaaaatttctttcatgatcatctgtgaccaaaaaaaaaaaaaaaccaatatacattttaaaagataatttacccagcgaattggtttaactggggaattctagctccaaaatttgttttatttgctaaagactttgaccaaattgtgtagataattatgcaaacattaatgtttactttgttttcatagctaccaccttggaattttctagaaaatgttttatttttaatatacatttatggatttgatttctaataatttgcattatttttattttaatattacatatgtttaaactataaacaaggaagtcagacatgtttttcttgcctcagccttactgttatttagaattgtcaagtattaatgtttccctttcgttgacaaagatggggtgtgctgccacaggaaacccttgttatatggaggctcttccagstttatttaaattgtgaacatttgtacttaataacacgaacaatgagcagtctggatttttctttttcaagttgtcagtgcaagtaaaggcattttaaaatccgaatctgcttccaccagcagttttgataattaaagtacacaaaatgtatcaaacatttgagataggccaagtattccgttgaatttgttacagatcttgaagtggactcratcactacttgctacttttcagagaacctttccaggtatactagctaggtatgaatatcagaaggctattaccactgtttgaccacaaaggtaaagaacatccaatagacaactaaattctagatctttctttatttgcggtatgggaaattttttaacatattctgaatcttttattttttgcaactttcactgtctcagattagactttaaaactcaagagctagaataattggtctagcaccatctctggtgtcttctatggatgcgttgcctacagtatattctgtcatcatctgtggttttctaaactgaattgcatttaatttcaatcaagcaattcatgctgtatttgaacttcaggcatatctttattttccagaaagcctgtttatcatatggccactcctgacttcctgaaactctaacagattaactgagaagaaaacaagtattatatttctaaggcattttcagctagtggaaaagataaatgactatatgagtcaataaaaaagtataattttcattgaaaggtagattggaagagcactatcaagacaaaaaaaaaagaatctgtttttaatgaaaatgaagagatctgttttctcaatcgtcatactaaaaaatgagtggtgtctgcacatatttttatttgggataataaaattgaacaagattattgctaagccagcatactaaggaaagaggacatataagccatatcaaatttaatgtaattgccccacactatcttctacaagaaacaaaaacaaaaaacaaacaaacaaaaacttggaaataagatttgtgaagtgcacattgtcttgatgacccatggaatttcaaccagctcttttaaaagaagtttacctataagatgccttagacacaccctccctttctgaatcctgtatgaatgcgtaagagaagaaaaaatgccacaaacagcatgggatgttggaaagaattggggaatgtgagaaatagaaaggaaagattaaaacaatcaaaaatcaaagaaatgtaaagtattacttgagaacatttctctgatgtttaatctaatattctatccaaagctttctgcactgctagaaatgttctgtatctgtgttgtctgtatagtagccattagccacatgtagctgtggagcattggaaatgtgacttttgtaactgaggaaatgaatttctagttttatttcattttaagtgtaaatagccacatgtggctagtggctgccttatgggaaagcacatgttcacagctctacctctcaaagtatgtttgggagtttattagaaatatagcatcttggctcccacccagacctactgactcagaatatgcattttaacaagatctccaggcaagtggtttgctcctgaaagttccagaggccctgccctagagcaatgttcacttgctaattaaccacccattcagaaacactgagaattctttattgttatcatgggtgagtgaatattagcagtgtgttcattttatccacagaggagtccttgatgcaatagggtgagtcataatagtgcttgaactgcttactttaaatcttttcccaaatgtgaacaaaacttaccctgctgattgatctgttgattttcccattcatgaaacaaacagagtccttacatggcaggtggaagggcattaaggtttactcagcatctctagttgcagctggatrtgtaccttatttctctgtagtaaaagaagtcttgacacctgaattaaaaaattatcattaaaaagtttaaaggaaggaaacattataagtgttcgaactagaaaatgatgttgacaatttattgcatttggcccctttccataggtcttaatttggaatcctgcaaaagctgactctgagaaaagcacttgtatacaggtggattatttgaaagtgatcccaggtaccatagtgagtggagtagggggagtgaagcagagaaaggagaaaggtcattaaagtgtacttggatgagtgggccactgatacgaacaactggggttcaacccctcttggggccatctgagaggctgggcatgtaagggaggaagacatcagcatgtgtgggaactgtgcacctaagctgcaggagtcaccttagatggtggacrtggtgtaggacaccaacagggtcttgtacaccataataggaattgcttatgtaatgggatcctacccttcatgtggggcagaaaaatatcaatgtctgctggggaatgaaaaccaagatccagggcaacaccatgaatctggtaaaagtctgctagtggtcagtttgccttaggtaggttgttgctcttggccacagggtgtaaaggaggctttggacttagtgatcccagaggttattccctgctctcatgccagtattcttctgcagctttcctcatcaatgtttatatatttctttcttttttctgaaacttgctctttcactctgtctctcccctagggaacactaaaaatagcctgtaggttraggaatctccaaaacacaggtgtgatttgtttgaaattctgtttgactcatgtgtgttgagttacttctaaattcaaggtattgtgactacttgaatgatattttttagaaacaaaataatgagaaaacttggtctgacaagggagatttttctgatctttgtatgcatttatttatgattatctgaagcgtgatgtaaaataacttatgtatatacatagcacagtgagttctggatggagagaagactaattatttatagaaaaagtctttttaatgtaaaaatattacattgaattagatttagttacatatgatcaaattgtcatttctaaataaaacaaaattctgaaggctgtccttgaaaatcaaagagatgtgtcacactagctgcggggggtgcaaaggtatgctcactaacattaagtaatttactgtccctttggaaggtaatatatattcccctaaacaggaaaagtaagtttrcaagggagcatggtttatgtacagtcacaggagtagggcttgtaaaagattctgtagatattgaggaggaggtatgtgtgagacagagcatgggatttaacatgtatagtaatgacctgcttggagatggaaggatttgagccaagttttgaaatgtgagggttttgtttagagactctttcaggaaaatgaagcaaacagagctgagcatcatcctggtagcctgactgaagagtacttggcaaattagagaagatatagttgcaaatggcagggaagaatgtgaatgctacgcatagtgcttttgggaaatagtccttgatggtgtctcttttacagttgaagagacagaatacacacacacacacacacacacacacacacacacacacacagagtcgcttcagctgtaaacacatatatatgtagttttaaatacatatatgtgtatacacacacacacacacacacacacaymyatatatatatatatatatwttttttttttttttttttttttttttttgagatggagtctcactctgtcgcccaggctggagtgcagtggcgcaatctcggctcaccacaagctccgcctcccaggttcacgccattcttctgcttcagcctcctgagtagctgggactacaggcgcccaccaccatgcccagctaattttttgtatttttagtggagacagggtttcaccatgatacacttatatattttttgtctctggtgtgtgtatatattatgtatacacacacatatataacatacgcacccacatttataacacacacatatatatgtatataacaaatcaaatttgatcttagcactaggactctgttgtaccaataattcagggttttttttttttagttctaggtaaaaacagtgtcattgatttactatcagtgaattcatgcaaattcatatatttgcattggtcgagtgccttgtactacaactacaatgttgaatagaacatgttctctcttttaggggagctcaagatacaggcaaacaaatgactacacttcagagccatgtcataataaaagtgcccatgaaatgatatacaatctaattctaatcagattctccaattgacttgctattttattcctgttctcaatggactcccatgtactttgtaaggagacagaatgtctgagcagagaatctttagagagaaaatcgtcaaataccatcttggataccaaatgtccatcttgtacttgtgaataataattcagtctagcaggatgtcctcttgcaaactgaaatgagcctacagtcccatctgtgggaaaacaagaggactcctaagtgttacacacaggatgttgctgatcttgggtcacctggctagcacagggcagctgtctgcagtcctttacctctggctggatttcctccttcaacttctaaaagtccaaggcttgaggacagttccctggtgaagatcaccagcatcttctgtgggccaactgaattgctgaggtgggaagtagtaaaagtcagagttagggtctagtttgtcctccctctctctcattttgtgtccagctttctttcccaactgccaaccttgatttacagttcagttaagtcccaaaagtagatgcaacagcaacaatcttcagtggacttcaacagttccctcagttttgtaagagtgaattgctctgaaaatccccgattctgtgtcactctaagtggctctgcctccctgatcatgtgtcagctgcattcaatcctagcaccagcccaaccttcaggccacctccaccatcactcactgggcgatgtgttctgtgcttgaatatcttcagaacatgcagatttgtcctaaacaggcctaggaaatgaatatacaattatacataaatttttattttatcgaaatttgttgtgagtaaaatggcagtcccttatctactgatggagtaccttctaaaagctttccttcttattctttatcaaattattcatttaatataaattacttatatatttttatgtattttatgtattttttcagagatgatcatttgggttttgaaaaattatattgtaataaaaaatcaaaatatttacatttatatgaggataattcctttgtccatgaatttatggacttatttaatggtagtctaattttcttaaagcactaaactctagaggcatgggttggctgaaacacacagatgactttgttgactctaacccaactatcctagagtaagattggttctactgggtgaaatgatccctcttctccaatgcttctgataccccatttcattgtctgcctacacagaggggagagggcaacagctgaggtttcttacagtcycaagagaaccatttttaaaactcagtctatataaaatatttcctggatgttttcaccaaagctcattaatgtaattttcacatcattattgcagctaatgatcatgtaagcgttcctgatcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatacttttataggggatttacatttgttatgggaatagtctttttactgactctgcttatattttcagaaatgtgtctttagccactagccgaggacagaccaataaacagcatccaaaaatgttaatgattatakatggttccagaayttacaatggtttgtgttaygattttttttaattttacmgtggctggaaagtgawacacattcaataaaaactgtatttcaaatacccatacaatgattctacttttcactttcagcacagtattcaataagttgcgagagatattcacatttcactataaaataggctttgtgttagataattctccccaactgtaggctaatgtaagtgttctgagcatgtttaaggtgggccagactaagatacgatgctcagaagattaggtataataaatgcattttgatttataatattttcaacttacaatgggtttatcggaacatagccccaacataagtagagaagcatttttattatagtgattttacatggaggcaatggcaggaaatggaaccagctgttcaaaagcatactttgtttgtaacttaaatgtttatacatccaatcttcttayaaagtttgaatttttttaagmtaactatactagacttaatgttgtggtrggtttgtgactgtccttgattttagtcctcaaatatctatagcagcagcagtttgtatctgaaattattacaaggggatttgcctattagaaatatgcctaagttccattattcawtaaggtcacagcagcaattctgattaatggagctgattcttgatagctgtgaggatacttccaatacatattataacttttacaacagagaaagcccttaatttccttacctgtaaaatctgagtaataattcctgccctatgaattgtaatgaaaatgagagaagctcccaaaatgatctagatgagacaatcaggtggagataagaccaagatgctaggaagtcagctagccactttctcacatctagcaaactgctcctacctactatccttgcaagaggcagaactcagatttgtcatttttaaatattcartgaaccactgggcttattcaggattatttgaaactataaatacatatattttttaaaattcttggattcaaggggtacgtgtacaggtttgttacatggatgtgttgcatgatggtgacgtttaggtttctaataatcccatggcccagatagtgaacacagagcccaatagataatttgcctaccttaactccccaccctcttttggaatccccagtatttactgttgccatctttgtgttcatctttacccaatgtttagctcccactcataagagagaacacgtagtgtttagttttctgtgaaaccataaatattaaatgtaagagtaacaagagtctactgaatagctacagcagcattccttaatgttatctttttgaataaatacaattttgaaagcttcagccctgcacatcaggtcaatgcacttaagtagctaaacaagaatgtcataatttggtgcaagactgcacttcaggtattccaagtatatctgtgagagtagcagaaaggtccaaatcagaagagaaaatttgccatcttcattcagaatttcttaatcttactggaagtacataaaatctgtttttgttttaaataccctgatggaatagaccaatttggcagtctgaaaaagaactaaaaaagcccagctgtccaacaaagtcatgtctctaggaagagacacactgagggaaggatgtaactgagagaaataagacataggcytcagatttcctagttgggccaatgagaagagtgaacagcatcattatgtggagaaagtgaattatagaacctgatcgttatttgtgagctcattgatgtaatgaatttgcttacacagtttatatgtgacaaagttttgtatgtacccacttctccttgtccttaggcaataaattgccaagagtgtacagacttggccttcttgccgagaaaatttgtggaaactgccttttcagaaagaagcaaaaattagtacaaaacattgggactattttttttgttttgccttgtttaatttctttttttaagacagtcaaacccctgagggtgcacccttggaataacagaagtttaggataggaaagagtctctatggtcagcttgccctattgaaggagcacccaagaccatcagatggtctgcagagaaagtgtttatgatgtaatatcaatacatttgtgaaacctcatatgtcataatgctctcttgaagagtgacaattcatattatcatgttaaagactttaagtcctacattaaagaaaacactttaagtttaacccagtggttcccaaacttttttggccaaagatccctttaatccctaaaacctttgcatacttgtaaatgtttatttaatccaagcctgaatttgtctttagtaacttcctgcttaacatatggtccttagacgaacggcatcagcatcaccaagggcttattagaaatgccagttctcaggtccagtcttatatctatcaaatcagaatctgcattttaacaagattctcaggtaaaatgaatatgcatgctgaagtttgagaagcacaggctcagtattccttctgactcaccatcttcacttcgttgaagttaaagacctgctgaggaaatgtcttatgcacagcatttaagcaatattacaactacaggcaagttgtacctgcaaatagtatttgcacatgctgcctctctagtttctgtgatgctgggagatgtctttcagaggcctgagtgagtctttacaacctgctcaatttgttttgtgaattatgagtgatgaaattctagattacaaattgcagacaaagaagtctgtgccttttcccaggcatagcgtcagctggtgaagtttatagagccrgatgtatttagtagaaatcagagcgtgactaacacttcaagaagaagatttgcagatgcacaaaaaagagcagagaagtccagaattgcagcttggctttcaaatatgattattggttttttctgacaggtgaaacatttataaggaatcaaaatgctactcattatgcaaaatgcctgcagaaatatctctatcagaagcaactaaaacgtatacagttgacccagacggagaacaagggccccttctcaggtattagaaatggtctatatattgataggggttacatgggtctatgcatctgtcaaactcagcaaattatttaaggtctgtatgtgatttcactgtctatgaattatacctcaataaaaacgtataacgtttatcttatgaaatttgagtgcagctgatattagatacagcaatgtgggctgtcaagaatactttaatggagatgtgcatttggaaataaatgcccttcacctggtatatggagatatttttatgggagggaatagccattgagtaggctgggttccagtgacttcatggtcatgccagtcagcgttaccagcaatccagatggcagagggggctgtagcatagactctgaattattgattctgggttcaaatctgagcctagttcccagtgacccagcacatgtgatttgacctttctgtgccttagyttccctatttataaatggcaatgataaaaatatttccttcacaggaacgtttggaagaccaaatgatttaatatttgtgaagaacttagtatagttctggcacasagcaaacactatatacatatttatcagataaacaaagtgactccaataagctagctgcaaccaccgcaactgtcatctacaacttaaccagttttatttttttacagcacttatccytctttaagatgatcttattttgaataatttatttgcatgtcattgtcagttgcccacccacctacttcataagccccaagacataagggactgatctgttttgttcttccctgtactcctagaacagtgcctgacacacaatagatcataacacactgaatgaatgaataaaggaatgatgtttaaagcaaaacaggttcttaaagaagtgagtcctatgatattaatgttccaccaaaatcatttccttaattactggttaaattgttatgtgcctatcctgtgtgctgagtggtacgtaaacagcttactggggatgaggtatctggattgatatgaccaaggaaatttcttgagtgagaaggagccaataattggaaaacccctgattacctaatgcttgtagcatgtcccaggatctgaagaattttttatatatcaataktttgaataaaattcgtatttgtcctcagagagacaaaaacttctgcttttaagaatactcagaagctaaactaagacattcattataccatctaattgtgctagattgacattttttccttcaggataataaatcaagtaagattaagcaatttatactatgactgggaggaaactcaaattaacaacagactagttctgccccttaaatttggcagatgctctatttccattaatctctgcacctggcttcaaatttcatgaggcagggtcctaatcacactcatctatgcatcgctcagagcttcctagagtgtcttgtatttaatacacacaataaatagatgagcaagctaaatgaattgaatttgaaagtgtaaatacatgcacaagagcttgagaccaaggatttaaagtaaggctttgtgttttaccaagactgccctctggaagaacagaggggtcacccacacaatctggaaattaggctcactccttccattttacaattccttattggccttggtaggcctacaggttattctcaaaaacctgacacacacacagaaacactcccacacccctcctcccccaccacacacagtgtagtgatggatttacttcaaggaccatgagttacgagataagccacacagagcagagcaagagtgtacaatactgaaaaatatgttgtggtgaagattcatgtttgagtcataggacgggaatccagatgtttatttttaggggtctcagataacatatctttacatttgaaaggcaacagggtatttgtttggttacactataagyatgtattattttgttgagactaaattacttttttttatttctatgatgcagcactcttttagtatggagaggctcatttggcaattccctcacctttttagtagaaatgaattttgatacaagaccaaatgagtgtctctttcttttcactaactcccatgacctgcattctgagttgttgttgttttttaacttgagatacatgagtcctctgtgctgcattctgtcatccccaatatcatttctacagaatgaattgagcaaagatggcctagcattcgtatttagcaagcaaatactatgtgtttagcaagtcttccaccaaaatacttagaaagatcatgttaacagtagagggtggtgactgcaagttgtccaggttcttggcgttttgcacaaagaattggacaaaacgtctagcagagcaaagaaagaatgaaggaacaaagaaggaaagcagggatttattgaaaacaaaagtacactccacagtgtgggaatggactcgagccacaagcagcagctcaggggcccaaatacagaatcttcttgggttcaaataccccctagaagtttcccattggccacttcgtgctcacctcatgtaactgaagcagtagcctgcaatcggtctgattggttgcagaaaacagccaaccagaggctgaagtgragttacaaaggtcacactcccgtgcaaacatctgattggttgctttttgcaaccaatgacctgcattctgaggtgttttttttttttttttaacttaagatacatgaatcctctgggctgcgttctgtccttggctgctttttgcaaccaatcagaggctagggtgaagttacaaagttgccaaggaagactggacctgcaatcagtctgatttattgcagacagccaacttcccatctgccgcatagaaaaggtcaacttaggcgtggaaagttagggttttcctttcaatttagttctaggaaattggcatgaaacagtcttaggttccctgcctccaggccctattctcctgcctcaatcatgttatctatggcagtgcttctaaaactataaagtgcatccacatccctgtatgtgccagtgtggattcaccaggtctagggggcacctgagattctgtatctcaaactgggccctgggtgttgctatagaccacactctgagtagcaaagttctaaagggaaatatatttatcacccttccacaaacggattctatttaaaaaaagaaaaaagaaagaaaagaaaaaaatcatgttatcttccttaaaacatagtttcatattctttgcctctaaattaggtgactgtaaactccctaggcaatgaggagattcccagctatggtggtctaagtgcaaaacaattttttccacaccatcagcagcaatgtccacgctcattaaggctgtatttctggattttcctttgcaatgggcttccatgttagatcttcactacatccaatttcagaaaaaaaaaaaagttttgagaaaagttctccatgtgagagcacttctgtgctgtttttgaaacttccttctcatttttctggtatcttccagcaggcaatggggaaacctgcttaagctcacccctctttcactttgagctttatggtgacacttttctggcacatatgtcagcagagcccactttttagctgagttgaaaggaacatgggaagcactgcttcatttctgcctggaaaagccagggacacgatgaaatgtgattttgtttcctgaaacgtggaaggatggttggcgaaaaatgaaacatagcacagccatcgctcttcactaagggccaactccttgagaaatgtgctactttaactctcagtagtttctggacaaggcctaaaatcaatcataatcctaaaagaaaaaaaagttctatttcttttccagtggtatttcagagaataggaactctgttacaatttgatttgcactctgttcgcagaaaaccgaccacgcgcactggttttgcttattggtatgtttggatacacacgtgcgtgcacctgctcagaccacaaaattgaagctcagaatggaaaacagaggtttccattgaggtttcagctaaaataaatttaaatttaagcctttctttgccagtttgtgcttcaaaacttcagaaagtgaggagatgcaggtcaaagggcacagagcagcagatatgtaggatgagcaagtctagaaatctcatttacaacatgaggactgtagttagtaaaactgtatggtattggggttctttgttaaataagtaggttttagctgctcttgtcacagactcacaaagtaaccatgtgagatgatagatatgttaatttgctttaaagtagcaatgattttactgtctgtgtatctcataacatcgtgtcgtaaacctcaaatatatacaataaaatatatttaaaaatacatataggctgagtttttcaggacatagaaaagaaatatgaactggatgagaatgagaaactcacataaaatggaagaagattaccattattattattactttgagacagagtctcgttgtgtcacccaggctggagtgcagtgtcgtgatctcagctcactgcagcctcctgagctcaagggattctctgacctcagcctctcaagtaactgggattacagrcacctgctaccacatctgggtaatcttgtatttttggtagagatggggtttcaccatgttggacgggctggtctcgaactgctgacctcaggtgatctgcccgtctcagcctcccaaagtgctgagattacacgcatgagccactgtgcccagccagaaaaagattattatatcaagatggttttataataatgaagaatagaaatctggacatactcagatttgtagcatagactgatggacagtcctgtttgctctcccaagcagaaaatctaaaaggaaacctggcttctaagggtttggagattcaaaccttgaattctgattctctaattacaagtggacttcagtgagttaaaaatacagacatcagctggaacttgaatggagggtaggggctttgctgggagttgcctggtgagggaaatattttaaaaagactttgagtaaaactgttgtaagaccaacaggttcgtatgcccatttgcacagtaacaaaccatttgcagcagagaaagagtttaatcattgcaagtgcagatcagggagataagaggaaaccctcaaatccatctccctgaaggagttctgggctgggatttttaaagggattatgaagagtgaggggctggaaatttgggattcttgattggttggagtaaggaggataaaatcatcaggttttggaaaatgaattatttggtaagtcagcttctcttggagccctatagaccagctggcgtcagtagttttactggtatgcaggacctgaaagaatatcttaaaggaaaaactgaatgtttcataatgttcaagttgttatctgtacagcagttgaggggaactatatcttgtgtaacagggtctatgtgattctagaacaatacacaaacatctatgaggaagcaggtcagaggaagctgacctaataatttgtgctgaatgtgtggcaagtttggtttattttcttcccccacaaccttcttccctgattaattttataaagtttatagggatggtttcaaaacaaaggaaaacagatacaaccaggttgggtccaaatgattcaggacattctcagcaacaacagcccccatgacttgagtctctctaataaaaaaagaaaagaaaaaatctgaggacaactgtaagggtagtcagggttttcattttttttttttctgtgacagagtctcactctgttgcccaggctggaatccagtggtgcaatctcggctcactgcaacctctgtctcccgggttcaagcgattcycctgcctcagcctctcgagtagctgggactacaggtgtgtgccaccacactcagctaatttttgaatttttagtagagatgtggttttgccatgttggccaggctggtctccaactcctgacctcaggtgatccacccaccttggcctcccaaagtgttgggattataggcatgagccaccatgcccagccaactgtaagggtttttatagatgtgtttacataaaagaaaatagcacagggaaaaagtgtgcagtgtcaataaatgggacaggattattcactcctggtttgtattccccatcccaagagaacgacsatttcactgcaaaggcattttaagagccatgtagaggaattgtggccgattgaataggaagttctacctggttcaaatgagytcacatctctcggggaagctggtgactgtggacccaggtagtccaggtcatctttgagaaatgatggagaacgtagtgtcagaggtgaggggattctgtggcctccatctagcattctgcttggcatctcctacaaaaacttctcagaaatatgagaaatacaggggaaaatgtttgaatgctatcccatggcagttaatatggaatctgttgtggtttgtggattagttgtgtgattcaggtgccattggaggtttctggaagagaagggccttttaaaagcctctgagaggccagtattatccccagaaagaatgagaggaggtttatkgtatgcacgcaagcaatatctatgaatccctttacttgcttgtatcttaccctcttctgccctaggaacaggctcgtgggagaagtgacccaactacaccttcctgccagtctcgagcattttaggtgttaaccaccaaagtggctgacacatgtacttactcacttggttttaatttgcagagtaggaacaatggacttagatttttttaaacttctctaactctttaatcactgaatgaaataactcatgttggaaagacaaagaatttcctggtagaccttttgaacaagagctcatagatttcagtgccattggtagccaatgtgataccatggcattgttgtctattgtgttttttaggttgtgacctatttgtgggttatgaattcaattttgtggattgggacctgcaatttaaaaaaaagatgaaggaaatagaacataatagagtcaagcgccatgcaatacaaaatgtcagaggtatcccaactaacaagggtgaatgatggtttgtaaaacttcagttacgtatgtatacgtgcatgtatgagtgttctgagtgataatataaaatgcattttttactgaggagcatgatcagaacaatatcaaaccattgaccaacatcaacatatttctattagraagatatttaaatgaagtttgtatagtaaaaggaagaaagaacactaaaatatttgcaaatctaccctgcacagtcactttaatcttttcagcttctaattgagatagatgctctatattaccctgtttattaataaaccctcaaagatctaaaaaggtgaattaactctcaggggctttaacagataaattaacttgaacctgcctagttgtctgtttcagagccagaattcgaacatggattcattttagccgcagtaagcacctgtgttagtcagaattcagkgtgggtaacagaagggcaggccagattggagagagctggaaacatattccaggtagagacaatggtgcctgatgaagcctragggtctgaatgctggagtaaagccaggggttatttacactgtgactgggtgtgaatctacagatagatctgaaactagaagataagcccatgaaggaaatgggaaaatgtgccctgattttgagttacattagcaaaaaaaatcaaagctgagtccaagatggaagaacatctacataattagagaggacagaagtgatcacgaagacctaggggacagggagaggcctcaggtaatgcaaaatctgtacataatgattgaggtcaggagaacagatgctcttcccgggtcagttttaaggctgaaatgtttcaggaaaactgggaacaaagcatggttggaaatagcaggctaagctgatgcatcaggagactgcagatctcagtgttaccttgcctgggaacaggatgggccccaagtatggctgagaatgcaagtctcatgggtatatgtttaatgaacctagttgggagatgttaggaggaagactggttctgatgtgaaagtttccttccaaagaataggccaacctaactgcagcagtgctgattatgatggaaatttcctattttgattcttcatcaaaagaaagaagagccggtaccatggttcttgcctgtaatcccagcactttgggaggccaaggtgggaggatcacttgaggccaggagtttgataccagcccctataggaaacataacaagaccccatctctactaaaaattaaaaaattagcctggcatggtggctatgtgtctttagtcctagctactcaggaggctgaggcaggaggctctcttgagcccagaagtaggagacagcagtgagctatgatcacaccacttgcgctctagcctgggtgacagagcaagaccatgtctcaaaaaaaagaagaaaaaggagaaattaaaaagtttttccttatggtttatctttagtagtttgacgtattaaagaggtttatattttattattatatatgcattaatatataatcagatattaattaaatatgtattagtatattatacattaacaaacttacattgtcatcttcttcaactaattctaagcctcaaacgaagtgtaaaagaaaactgaagcatcaaaaaattagtcagcttcaggcactatcccaaatgttgaagttttccatgtaaataaataaaacctctaaaattaacaagaggctattttcactgttgcctgttggacacaagccttaattatgacagtgatctgaatagccaagttacactgtaaggctgtttccctgaatggaaacaccaaccttttttgcttttttgaaaaagaagcagaaacagaagcagaaggagagggagagggaaaagaattctttcggacaaaatgtatcaaatgtttgacttcactccagaggcaatttttaaataccaaaaattgtttcacatctattcccaataaggtttgccaccaaaggagtttgctctaaatttgtgactggatgtttggttttcagaggtttcaggatttcagaatcatggtaagggattrtagacatgtatttggtatgtgcaatattgggggacttgaatattaagtctgattgggaacatctctgggtttctgtatgtgtacacattctacacaatagtgtaaagttttctagaaaatttagtgtcagcaaaaattacgctggggtctgagtttttatgtgagaatcttataaagatcaaaatattagctaaaatttaaaatttgagttgaaagggcttgaatgctgtattagtctgcttgggctgccataataaaatgctgtagattaggtggcttaaacaacaaacatttcagtttggaaggctgggaagtccactatctgggtgctggcaaggtaggtttcagaacattccttcttttggcttgtcggcaaccaccatgtcactgtgtgctcagatgacctcttctttgtatgtggtggtgggggtgggagctgggaggtctctctaatatctctgttgtgggatttttccttagttcagctgaagacaggggtccttatcacatggccacgaaaaatctggcttgcagacaatctgaagcgtgaggagggccgggtttattgggtgaaagagggaaacagggacgctccgcaaggccagaatccctgctacagcgcttcctgcctgaagattgratcccaggttccacccaggaataggaggggccaggcttcccccgctgcaaacagcaccaactcccgtggctccatgccagtgcgcaatcctcccagtgtgcaggctggttggagtttttccaaggacctcttcccacctggctgtctcatctcattttgtaaggacataaatccaatcctatcctatcctattctatccgagccccacccttatgaccttatttaaccttaattacttctttctagaccctatctccaactactactgctttaacatgtgaatctgggagtgggggagaaaattctatccttagcagatgctaaaactcaggacttgaaactgctttaccaaatgattatgtgctgtggtctgaagcagtattattttttaacccagtgtttttcattcccatgtttttttcttttctaagaaattattttcttcaggatcaaagcgacagaaacttagaagtggcatttgaagttgccaacattaaacctttgatcagtccggcctagtcaccagccaaacaaggaggagagagattgttgctcatccatctaaattcacagctcaaaggtgcagaaatccagctggagtagaaaacatttcctgtactgagttaaatttaactgaactccatgcctggatgatttctgccagtggcgcccgtgggattgtgtgaccccctctggctttgctatctgcaggtttcttgatcacacgtggtatccatttatcagtcctggctggagccagtttcccagagcaaacagatgcaggatgatccgcactatcagcagaggttcaccaaagttctaattagaccaggaaggtttattaatacaattagctttagggaggacagttacaacaggaagcaaattccttgcagcatccggtcctctcttagccatgttagttgattaagaggaaagcctcagacttcaaaatcaagagcaaaattgaaaatgtctgggaatttaactttccagtaactgtaaagttttaaccgtgaactttctattaactgtaaagtataatttaactttctaataactgtagaacaagaaaggattctagaaaaatcttgggaaaaattattaatgaggggcctgagggcttaagtttggggagartgggcttsttttgatttgcaatgtggaagctgcttttgctcatgctttctgaagrtcttccataaagaggggaactgcgaattgcaaagtaaagcccctgctgwggagtgaatttgcttatgtcacactctatctgagtgacccttaggaagttccctaatctcccatgcctgttttctgggttgtaaatgcaagtaataaaagtaactgcctcataggtttgttgcaagtattaaataagaaaatttataacggacataaaagggagttggcatagagttaatgttcagtaaatgacgagtgtatccttctcctcttcctcctcctcctcctcatcctcctcctcctcctcctcatggacaattggtttcatccatctgataatgaaacactgtgaattgcccccaggagtgctttaaatgatgtctacttgtacatagatgctcaaaatttttgaattctatcagtatgacatctagaagagtcatgggtagcaccaagggataagctctttctctggaagaatagtacatttctttctattaaaaaaacatgaattagtcaacccattatgtgtttgtttttgcccttattaccagaaaactacaagatgattttcaatcacagtgaggattagtttctgtgactaacatgtttctttctttctcattcttatgagtttgatttcccattcttaagcaaaaaagcacaataggtgtgattgtgtgtaccatttttttgaatgaggcaggaagatagttgacagttggttaattcatgtattcattctagttagttttgtgtctgcacttccttctggaatttaaacatttttgaanatacggtctctgttctattttttatttttcattcctataaagttttattgaatgcctatatgtgtccaacataccagatcctaaggtatgtttcacataagtcagattggtctctgtccttaatggtgttatcatatagcagaggacaaaatcataaaataataataatatatgaaagatatgtaagcatgtaaggtcaagagggtggaaatttcttctgtcttattcactgctttattgctactcctaagggagtgcctaaaacagattagatgtccaattagtatttattctatcaattactgtcccaggcattttacacatattagaaatatgagaactaatgtttattgagcaattcatatctgtataccaaacattctactggtatttcaacaccgtgaactagaaacaattmctaaggttatgaaataggagttaacactgaagtctagagaggttatgcaatttgcttatggtcacacagctaataagagctagatagaggtctcctctagagctcatgmgcttaaccagtacctccatccatgacactgtcttaccctaatactggaggagttgaggaataggcttccccacatcgtggataataaagctaaaattttctaaggcagggcctggttaatggagggcacatgcaagctgacactctcaggactccaaagtgtacacacttttcactataccacacagcctctcatgcacgtagacaatcacacacatacaaacwttctaacaaaagtttgtaggaattgtgctgggaccatgctgtatagctgtagtccatggtgtataacatgcctgcagtagaatatctattgaaatgaatagagctacaaggttaatccattggagaaggaatttggtgtgatacttacaagctccccagtggcatgaatgtgtcactcttcacaacactgcctagttcttgtgtagatacactataagcattaagacaatttatccttactgtacaagactatggagtgtagatgtggtagacctaattctgagatggccttcagaatcccatccgttggtgtccatgccctgcccattaagtgtgggcaaaacctaaggtttgcttctacccrgtagaatatgacaaaggtgaagggattttgcagctataattaaagtgtcatgtcagttgattttgagtaaatcaaaagggagattatcctgggtgagcctgacttaattaggtgaaagcccttaaaaaaggaactgggcccttctggaggcaatagactgttcttgaagacttgctgaagttagtggctcttttggagaagcctacatatcaaggaaatatgacarcctccggaactgcaagcagcctctggtatccaaggccccaacaaaaagccagagccctcagtcacagagctcaagaaattgaattctaccgtcaacctgaatgagcttggaagtggattattccccaatcaagcctccagactttaacccaatctggctgatcccttagttacagtcttatgagacattgacaggagagtgggtttagacgttaatatcccatttccgttaccagatatactgcaaagacagagatcattttttcaaggaagttgtgactaagcaccatttgaaatatcactattgtggttttgactgaccccagatgaaaagatgaactctcctaagatttcaggcatctttaaggatagattgtaatgatgccaggtgattcctagatgagatacactaaaattcctctccacacaaggaaaataacagtgtgttctctacttctcttggaagttccatcattaaggatattgaatatgaccaggcacagtggctcacgcctgtaatcccagcactttgggaggctgaggcaggtggatcagttgaggccaggagttcgagaccagcctggccatgacgaaacctgtctctactaaaaacacaaaaaagttagccaggcatggttaattagccctgctacttgagaggctgaggcacaagaatcaagaatcactttaacctggaaggcagaggttgcactgagatcgcgccacygaactccagtctgggtgacagagtgagaccctgtcaaaaaaaaaaaaaaaaagaatattgarcatatgtttacataaattaattattttgagcaatgactatttctgcttcagaaaatctggacttcttaagttgtgttcaagaaaaaaaaaacaagacaacaaacacttcaggtttatccttttatgttgtgactatgtgggaagagattgttaatttaaaaaatctgttaacaccaaactctcttttttctcttttcctcttttttttctctcttctctgtctctcctcattttataggttttggtgtctatttattttttctccatgtattgccaccctttgctctaggcttacatacttttaactacaaatccaggaaggatccctgattccacctgttccagtgaaaaccctgatgtagctttcattagaccaacatagaatatgtgccaacacttgacctagccaccgtagccatggaattttatttatttatttatttattattttctgaaacagagtctcactctgttgcccaggctggagtgcaggggtaygatctttgctcactgcaacctccacctcccggtttcaagtgattctcctgcttcagcctcccaagtagctgagatcacaggcgtgtgccaccacacccagctaatttttgtatttttagtagagatgagctttcaccatattggccaggctggtctcaaactcctaacctcaagtgatccacccaccttggcctcctaaagtgccgggattacaggcatgagccaccgagcctggtccgtaaccatggattttaatgatctgttcagccaggcctggaatgcacgccttcccctgtagccaggagtaaaataagcctatcagaaccatgcaggctggagttacattttcaaagaggaaaatggataaaaacgttccattactgagacaacctcagatattttcctcagagtggaaatcaggaaaccaacttagagtcatctcaagattagagggaatttgggctagaaggagaatattctaaagctactatttactaaaatattacctaatagtacaggaatagacaactgtatcaatggagtagaagagattagaaagtgttcaaacaagcataactcatttagaatggatgcatgaaatgctatttcattgtagcactattgttttagaaatggttttattaaactatacacaaatatatgaacacaaatccattacagtactgagtagtggaatcactatttctcaaataactagtcatccagtacagtagactgacatcttactgtttttaccatctatttgttctctctggtatggtgtttatttctaccattatttgtacttatatgaacatttttgggctgagatggctatcaaaaatgtgcaccagagtggcaaagaaaaattccctattcaatataaaaataccacttttactggggctctgggaaccttcaagacagtgagcaaggaagtattaggtaaaattaccaattatgtagctaattagatatgaggggaaatccttgaaaacttagtaggccacatacatatcactgcagcctctaaagattgacaagtagagggaaataaattgccaataaatgatactgagaatatatgtccaaacagactatgccattataaggtaatcactccctgaaacataaaaaaagtctattttatgaattttatatacttatagtttattttattatttgtagaacttttaaaatttatatcttcatatatgartttcatttttattttgtgtgttctatcttatatatttgtagataatttcataaatgtttatttttgctagttaagcatctgatataaatgacatttccaattaatagtgaaatggtgtttccaggaaagatattggaacaatgaatatccgtatataaaagtaattttggcaacctacttcacaccatataagcaaataatttccatattatatacatacctaaatattgagggaaaaccaaaattgctagaatatacataatatactttttataactgtagagtgggagaaaacatttttagacatagcgcaaaacccagaagcaaagtaaaacactggtaggttatctgcttaacactgttaaacttctaatgggcaaaagacaaagcagacaaaggtaaagacaagttacaggctgggagaaaacagttacaagatatatcagaaaaagggaaacatataccatctctaacatactcttacatggctcttacaacccaataagaaagtgaagttctcaggtatctgtgaatgcaagccacagttgtctcttagccacaatgtctagggtgcgtcaggattcagacgactgcagttcctggccaagtaccccctagctttgctgaatgacatgcctctttatggcttatggacagcaaccattgggttcaggtcttcgccccatttcctgacccaaggggccacaaaatcctttgtcctcaccccaggccacaagaagagcatctcctcagaaagtggccactggttatttcacctggccccaagacgatgcaaggcacccactctgctttttttgtgatgagatggagcatgactggccttgcacatgaccttcagtcactgcctctttgctctttggttgttgactttgtcggcagggaattcagagggaaggagagtcagcgacgtgctctcgtaaggtcatcttagaagaccactctctccaattattttaagcagctctttagagctttctacattgtraagttctttatcctacctgtgtatccctagggctttacagagtggagattcagtaaatattttgacaagagtgagcaaatgatttaacagtcgatggagtgcaaattgccaacaacttactgtagcgtttccatccacagcattcagggtcagtggctaaaatacttgtcgtaaaggtgccaagcctccaggcatctagcagggcattagcacaccgaagcatttattagactcaggaatatactctttattggctcatttcaaacaatacctaaaaaagaaacctctttttttaaagccttcaaaagatggcaggatgtattttttcctaagacccataaaacaggtaacataaactgttactatttcataagaaaaacttaggtacagaaatactcaaacacttatccaagggagctggaatttgtgtcaaattttcttgaggaattacatggctcgtactatttagaccatgttctaaacaagcatttatcgctctttgaagttgtgtcgtatttagaaatttagattcatagtaattagatatttagatagattatactggaatatttgggyggcatatggacagcaggtctgtaaataaaatttaaatcttcattactatattttctacattctgccttatgcttgatttaagcttttttcccttcttttcactggttagatttttttttcatttattttttcttctargtcgttgacctttttataggcatagaaaatgccttgtaccgtgcaccaaagttcttaaaattttaaaagctttctttgactaagtcatcccttgccctcttttgaagctattctgacctctattttctattttattttaattaatcatatcttaggatttgtaggcttatatgtggatgcatgtatattatcttgttaagggtacataaggcagttatacaaaagattatgttggcttcaaagaatgttaaacaaaaggaatgagaagattcctgaataatatagttatgcatactcagagcttctttcataagggcatttgaaatgtatgctgatyacctcaaggtcgccatgaaatgggaagatttaaactagtggtgtttggacagaaacaacttttaccttgaaagccagcaatcaatgactgaaaaatgtatatctaaggctggaaaatcatttcagtattattaagtattctgatgacaaaaaaggttcaaacatttgtgactcccatagctagtattgatatgggtgatgggaaataaggatgtatttattttatttggactttagtcatgtttttattgtctgtaaaaatgacttgactgttacagctagaacattgaagaaagaagggaagcaggtcaaatgggtccccagtgattccctgtggcacctggactttctccaggaattgattgttacatattattccatcaaacaccttttaaccagtccagttcttgtctatggatccagacaattcagtcttcccagggcttacccatgtttccatatatccagaaagtttgtatattatggctagaaaagcaattaaaccactttggaagggttgggggaagggagggttagggagagacttgttaaaggatacaaaattatagctagataggaggaataaattctagtattgtatagctttgcaggaagactaaagttaacaatcatatggtatatagtatcagatagctagaaggaggatatttaatgttccccacacaaagaaatgataaatgtttttgattttatatatatatatatatgrtaattaccgtgatctgatcactatatgttatatggatcgaaacatcactatgtactccatgaatatatacaattattatgtgtcaatttaagaaattaaattaaaaagagaaattaacccagcctcaccattttacagcagagggacttgaggtggaaaaaattcaagaaactttactctcgtcattcaacggagtgatcttttgaaaaaggtagcattacaagaaatccagtatatacccacaaatacgtggccacatttcttgacaatgttccaattattattgatatctacaattagaattaaatcgttgtttctaaccagtaatattccaagtaaagtagtaayattgtttattcattggcattaggcatctatggttagctctacagaattatagttgaaatctatgtgaaaatatcaatttttacacttaccgaccataataggatacttacagaagagcttgataccagactgtcagccaaagattttctgaatttggtatgaattttctaaaggtggagtgatttgcttcaagagaaaattgctttgagtgcattttgcagtcaagaactttgacaccttgcaatttactagttgcaaagataatctgatcacaaagtaagaaatctgatcgttgtaattccaatttatatcaataagaaataataaataatctttattttggaggtttgctaagtgactgaaagtttatctaaatacagacggttttgcatgaacgctagggactgaatgaaacactgtttgcctaccaattaaccaggcaggtgtgaaacataagcagtgaccgaccataacagacgatctctcagatattgatcactcttttaacagaaaaattcctatgggcagatagaggagggggagagggcagcattctcttgagattgtcttagggaaggatgatcatgaaactctttatatctgaaaaaaattttaaatccttttaaatatcaatccaggaggattagctaagcagcaataaagcaccttataactgttacatagttaattcaaagaagcattgtatcaagataaataaatatagaaaacaaggaatccattttcaagaaacatactttgttctagtyctgacttcagatttaaaacacacacacatacgcagaagacacactgaatatgattgaatctagaatatagaaataaaataattgaatatattccatttgttaatgtgtgcatgtgttttcaagacatggctcaatgattctgtagttttttccttatttttattttgagaattttctagaaaaaatatgtcttaaatacttaatttttacttcttggttatcttagtccatttgtactgctacagcagaatacatgagatgataatttctaaagaacaggaatttattttctcacagttctgaatactgagatgttcaaggggccggcaggtttcgttgtctgtgagggtggctctctgcttccaagatggttcctctagaggagggaacactttgtcctggcatggtgggatgtgggctcaaaccctgtatgaagcctcttttataaaggccttaatctcatctttgagagaggagccctcataacctaatcagctcttaaaggttctacctcttaatactatcacaatggccattaagtttcagcatctgaattttagaggggacatactgaggcaataacaaacattatgtttttgagaaggtcccattttttyttaatttaaagctcagtccaatgaatatctgtaacaaagggttagtgaaatcccagtccaaaattatcatcttttgaaggtaattcagatggacatttcttgagttatcaaaatgtataatattatctattcaaatcttttctgttttattaattaaactcaggagattaaagtaccttgccatgacattgaaactagtaaaacagccaaatatgaaaaccaagcatgctgggaaaatcctaataatgatggaatggctaccaagtctttgttattcccttggatagtagcacaccttggaaagacttagcaaagcccagatttcaggaaagtagaaaaattgcatttaatgctttgattataaaattatcttgtgagtttcttgtttttttttttgtttttttttttgagatggagtctcgtcctgttgcccaggctggagtgcagtggcacgatctcagctcactgcaatatctgcatcctgggttcaagcgattctcctgcctcaccttctcgagtagctgggaccacaggtgtgcgtcaccacacccagctaatatttttgtatttttagtagagatggggtttcaccatattggtcagactggtcttgaactcctgacctcgtgatctgcccgccttggcctcctgaagtgctgggattacaggcgtgagccacagcacctggccatctcgtgagttttaatgcaactggcagttgactgtgggtcctaaccatgggctctgtttttctcaaatgtaaaattattggccgatgtggaagaccatccatcctgtagggtgaggccctgctttttataaggtaatggaagagtatgctattcaatatcaagttaaaaataacttttaccagtgtggaaaagaaatgagcagggaaacctattgaccattaggcttagttttctgtttggtgccccaacttcactccatctgctatcttttggatctccagggttttctttcctactccttaccccagaaagctgcattattctggctccctgagcaactgacttcagtctgagtttcaccagtgggaggtgctgtcacgctattggagggcagaagaagagcagcatgaaatggttatttggttattccctattcccttctgcttctgcatcacatttctggcaatggctgaatatctccctaactacagctcccaacaggcaacctctctttcatggttccagctcttaccagttacaataattctatttctatcacaaccccttcttccacccctaccccaattcttccagtccaggggtcacaatagcaccccacagtggctatttcctgggtttaccaacttcttttgttggttcttccagcctgcttacacctccgacttttttcctcattaaagtctcttcacttaatttatctgatttgaatttgtctctttactgagatcttgaccaatacctgattttttttttgtactttaagttctagggtacatgtgcacaatgtgcaggtttgttacatatgtatacatgtgccatgttggtgtgctgcacccattaactcgtcatttacattaggtatatcccctaatgctatccctcccacctccccccaccacatgacaggccgcggtgtgtgatgttccccaccctgtctccaagttttctcattgttcaattcccacctatgagtgagaacatgcagtgtttggttttttgtccttgcgatagtttgctgacaatgatggtttctagaaaccatagcttcatccatgtccctacaaaggacatgaactcatccttttttatggctgcatagtattccatggtgtatatgtgccacattttcttaatccagtctatcattgttggacatttgggttggttccaagtctttgcaattgtgaatagtgccgcaataaacatacgtgtgcatgtgtctttatagcagcatgatttatagtcctttgggtatatacccagtaatgggatgcctgggtcaaatggtatttctagttctagatccttgaggaatagccacactgtcttccacaatggttgaactagtttacagtcccaccaacaatgtaaaagtgttcctgtttctccacatcctctccagtacctgttgtttcctgactttttaatgatcaccattctaactagtgtgagatggtatctcattgtggttttgatttgcatttctctgatggccagtgatgatgagcattttttcatgtgtctgttggctgcataaatgtcttcttttgagaagtgtctgtttatatcctttgcctactttttgatgaggtttttttttttcttgtaaatttgtttgagttctttgtagattctggatattagccctttgtcagataagtagattgcaaaaattttctcccattctgtaggttgtctgttcactctgatgatagtttctgttgctgtgcagaagttctttagtttaattagatcccatttgtcaattttggcttttgttgccattgcttttggtgttttagacatgaagtccttgcccatgcctatgtcctaaatggtattgcctaggttttcttctagggtttttatggttttaggtctgacatttaagtctttgatccatcttgaattgatttttgtataagttgtaaggaagggatccagtttcagctgtctacatatggctagcaggttttcccagcaccgtttattaaatagggaatcttttccccatttcttgtttttgtcaggtttgtcaaagatcagatggttgtaaatgtgtggtattatttctgagggctctgttctgttccattggtctatatctctgttttggtaccagtaccatgctgttttggttactgtagccttgtagtatagtttgaagtcaggtagcatgatgcctccagctttgttcttttgrcttaggattgacttggcaatgcgggctcttttttggttccatatgaactttaaagtagttttttccaattctgtgaagaaagtcattggtagctttatggggatggcattgaatctataaattaccttgagcagtatggccattttcatggtattgattcttcctatccatgagcatggaatgttcttccatttgtttgtgtcctcttttatttcgttgagcagtggtttstagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgattttgtatcctgagactttgctgaagttgcttaccgaaaaaagtccaggaccagacggattcacagccgaattctaccagaggtacaaggaggagctggtcccattccttctgaaattattccaatcaacagaaaaagagggaatcctccctaactcattttatgaggccagcatcatcctgataccaaagcctggcagagacacagcaaaaaaaagagaattttagaccactatccctgatgaacatcgatgcaaaaatcctcaataaaatgctggcaaaccgaatccagcagcacatcaaaaagcttatacaccatgatcaagtgggcttcatccctgggatgcaaggctggttcaacatatgcaaatcaataaacgtaatccagcatataaacagaaccaaagacaaaaaccacatgaytatctcaatagatgcagaaaagccctttgacacaattcaacarccctttgttttaaaaactctcaataaattaggtattgatgggaygtatctcaaaataataagagctatttatgacaaacccacagccaatatcatactgaatgggcaaaaactgaaagcattccctttgaaaactggcacaagacagggatgccctctctcaccactcctattcaacatagtgttggaagttctggccagggctatcaggcaggagaaagaaataaagggtattcaattaggaaaagagggagtcaaatcgtccctgtttgcagatgacaattgtatatttcgaaaacccaatcgtctcagaccaatacctgatttttaagcctaaggttaggaacacataggaaaaatcaaggtgagtattaaaaattagtagaaggagaccgtttagtgtactactcagattagtagctctttgtacagtcatcctcaataaatgggtgcttctgatgacttacttttttttctttctttctgataaattgttcttattaaggaattctattaagtcatcatggaagatgttatcttctaattttacttgatgcacaatttggaaatataattagtttactgaataatatcatcaaggttcaaagaggactcggtgatctggaattctagatacgtagaatagaaattctgaaattgcatgcaaatcttaagtatgtgtgtataaatatacatatactgagtgatttgctttgcaacatggtgatttggctgtttagaaatattaatgatatttgaacatcattaaatgaagtcaaaggccagctataccctgcaacagtcagaccacatatggtgacatgctgccacttaggggcactatgataaacaggtaaacaaccaagagagctgtgtggcaactagtttcaagctcagggttttaagagctagatttaggggcctgggttttactcacatcttcctccggtgctagctgtgaaatttggacaagcagcatatcttttgctcatctctgaaatgggagacctaagaccatgggaatactcattaagtgaatgtacatgaagtgatgcctgacacattccaaaaactctccagacaatacctagaatactactaataattaccagtgtgtaattggtctggaaaccacatgttgtgagtaacagtctagggaactgggaacaattcagtttatggacaaacatactgagggatagagtaggccgctttcaaaatgtgaaagattgtccaagaggagagaaaattgttctaggaaggcaggagactctcagtgaaaggtacagaggaatataatttggtccagtagcagaaatacctttctaactcctagagctgtccaacaaggaaataggctgataagcaatgtccttttgagccattagtcaacaaaggctggataatcactatgcggaatatgattttagcaggaactcctgcaataagggctgaagtgggggagggcaaggacaggggaaaaggtcacaacatgacccttaatttccctttgcactctacaatttcagactctatgtgtgtgttggacagaatatcaggaaaatggctgccacctttgtttgcattcatgttgtcctctttcaaatcaggcccttggcaaaggtcctgagacacattgtccaaacttgctattgacaatcctacatatattttcctgttcagatgctttggcctgccagaggctcactgggtgtcatacaatagtcttctgtgtcaccagccttgcagatttcttcaagaaactgtttgttgagtaggcgcttactagctggaacaaatccctttgcaaaggtgtaccttccttttcttgaacagaatgaaaaatgtgttgagcaggaaaagaaacttcacagtatttgtgtttttcttttggccctttctgctaggtatcctcactctaattgagcaggctctggaaacytgaaacgcacatcagtcttgtgcctttttctgtttcttccactagcagttgataattatagcttttcgtagatactcagcacattccatgtttttgatgggagcagagcctttgtatggcaaaattgctgatatacttttaactaaatctgtagatgtgttatgtttagaaggcagcggaagaagcctgagctggcagaataattgctgtgttagggcgccactgaagacaaatagtgtgcccaagattgtgaaaatcctttcttataaaaactttttccaacaccagggttccttttgggacagaaataacaatatctgttctttctgagaaaacttggagagaatgtcaatgtgatatctcagggataattcatttttgaaaaaggagartcctttctactgaatactttttataagggacatttttagctttggaactgcatttctcttccctgtctggatgttagctgtttgtatgagtggtgaggacaaaaagtaaaggattgcatcccacaaaaaccaacctcaatagtttaaggtcacacagatggctttgaggtaagaaaggaaattacatctcctgaaaggcaatgcacaggctattgaataggatgaacttggaggtctcttctagtcctgagattttatgattccatgatcacagaaactactagtgaatgtgatacttcatatctcatccattggctatttcaaatggcaactaaagtgagaagggaaatcatttattcttaaatgcaaattcaaactaacagaaattggatatatttcttggtgttcatgagcattgccagtagtaaaatatatgtttagagataagaaaataaaaacaacttatacttattgaatgcttatgacataccaggtcctatatcaagcattttatatgcatcatagattctattattgtcaacatcttatggaggaggtaactgaggattgtagatattctgaagcagtgtcgtgaagctgacactaaacactcttggctaccatagcatcctgcttctctgtagcagacgctggtgattcatcacaccacatttctttggcactctggatttcagcacaagtgctgtagacagttaattgcctrtcgctagtgtcccgcttccttcaagtgcatgtgggaaagaaggagagggaagagaatctgaaagaccgttcagcaggcaggtgcaactcagaattaagagagaataatatactctacctaaggacagscctcaaccagtggaatgatggggatggtttccgggtaaactccgaccctcattgtcccgaaggagaacacttccggggcacatactacaatcgtttcttagagtgtccctaacaggggtgagccccccactcaatacacagtggtaagaaactcattcctgcgttcttctaatacatcttccttccctatctcattgtctatgctcctcatttctgcatcctaggatcagctcccaaataaacttcctgccctcaagtccttgaccaaagtgctgttttggggaggagtcaaagtaagattttttaaagaacacacacgttactgctatgtagttacaggcataatcttactaatggactataatgtccatcataccatggggttgatggtcataaaacctaggcgtatttgggaatatttctgtgacattaaatctctaactatataatagaagctaatggtagtatattgaaatttgttctttggaattcaattattcaataaaataagagaaatctctaccacacattagcatgaccccgttgaagtcttcagaaagcctaatgatttagcatgactatttcaagatcatttttcctaggcttcctcccatcctactcctggaagtgctctgctattaatttcctttgtggtcttagataagtctcagactgcaggtgaaatgattaaattctcatttctcttgaaaaatttcacacgaagtctcttttcatctatttcaatacctgatatttaatttgaatggagtataacaactacattgatatagggaaagttttattgaatgaacaaagccatcacataaatttttctttcatttttttttttgtcagtctctgaaattagtgaataggtagagacatccatcagttggatcattcttaggtaacattttgtttataagaacagggcagtgctggaatgtggatttacccacaattctcacgtgagatttctaccattgtactgctgttttcttcttgtctctgatttttttcaatctctgctcctcaaacatccaggtagctttgatcagtgcttcaagcagagtactggagtaagtaatatatttttctataaccttgtaatgaaagcatgatctcttcttaaggactctgtacttagcgaggcatctatcggtgattgtatactttgtagattttatttgggtggttctaccatcctccatttattacatatgacaaactcagtaagattaggctaagaagaactggttcctagaagctaatgttaccctggacagttaacaaaatttttgtgaaagtactgtagagttagaaaacacaccaaatagtacaattctccacactggatttcttcaatttactgttaagttgtaaaaagtaggcttgtacctgatgaaaacatttggcaaatttgtatgcagtaccagtgaaaaatatgcacaaattggcaaaataaggcaagattctaactgctgtccatgttcaagaactataacagtagtggggtgaatgctaaatctttacaataatatatagattgtacatttgtttttcatggattataagacatttttcatttttcagccacacggtattgattcatcacttccatattcagctatgmctatatatgtccatgtcacaaagttattttcccattaaaaatttactctgtccttgcaataagaaacacaaaagagttagttcaaaggaaaaaataacaatttgcatttggataaaaatggtaaatagatttatttttgactcatcctgtgaatccttttcagattgccttctttattttttattttttgagacagagtctcactctgtcacccaggctgaagtgcagtggcacgatcttggctcactgcaacctctgcctcctgggttcaagcgattctcatgcctccgcctactgagtagctgggaccacaggtgggcgtcaccacacccagctaatttttttgtatttttagtaggtatggggtttcaccatgttggacaggctggtctcaaactcttgacctcaagtgacccacccacctcggcctcccaaagtgctgggattaygggtgtgagccactgcacccggcccagattgccttcttcagrtaagtattttaaacctcttatgagctgtttccttccttcatcccttcgtttcctcctttttcctcccctcctaggactctctttctcttttcatttgcctctattttccttcattcttttcttcctttgttcattccttcctcccttctttcttccatctccctcttcttctttcttccatctccctcttcttctttcttccctctcttccttttttcctccttatttcttgctttccttctttatttcactcatctaaaaaaaacctgtagtatagatctttgaggaaattattttagttttgacattcattgcacagttgtctgtaacccagttagggaattctttcctatttttaaaatgaaaatagctgagagatttgtgaggaaaatttgaaacaatgttgattctgaatgtttttaaaaatttctaatatttatraaacaactgtatctcagatgagcttcaatttgcaaggcatcattccattttcatttttaattctctgttccaatgcctctgctaagaaataagcattttctcataggaagagattattccttttaactttttttcaattttaatttttattcagcctcttacctttttgctaaaaccaaaagttcaaaagaaaggtgatcaggacactcccaggaattttttagccatgtgagaatatatggtgaaatgattcaagtagatgcaacatggtctactggaaaagcactgagattttgaggagaaaacttagctctgccattagttaattgtcatcaaggtcttcctatgaaaattgtagttcaattttcaaacatttattgtttttctccaaagtgctaggcatatgcttttgtgctggagatgaaagatgaataacatgtaggtgctgtttttgaagaacatcactgaagagagagtgagctaaaacaaataatgatttgtgtgctagaatagagccaggttgtacagaaaggttctattaatagcgctcagtgatccctgcaaaagaagcatttgattctgtccaaagagatgagtacagaaaaagccaaagagaagaaatgatatttgatttgggattttgaaggatgaataggatttaaccagatgaatacattggaggaaagatattctggtaggaacactgtgagtaaacaactgtaggactttgggagggattgtgagtagagtgtgcaagayggaaagtacgttggcattataatgattcatcatcaacaacaccatgtttgcttgcctggttgaatgtccctgartacaccagctgacatggatgccagaattccagctatgagaatttctcctctatttattttaaacgtaggtacaaatcagttctctttgaaccctgcctgactttgcatcatggtttcttctccttatctacttctttgtgaatgtgataactcaactttggaattgtaactttgtttctggcatcgcatccttcctaacatgctcattccaaaaactactctttcactgcactacttaggcaagaggcccccggccatgagtctcagagttctcctcctcatatcaccaaagtgtcccatgggttccagtggaaggtgagcaataacagtatctcctgcagccacctcacagaactgttgtgaaggatagagatgataacagatggaccatgtattcactttggaggtaaatagacttggatttaaatcctgagtctgactgagtaagccaagtcaagttatttaacttctatggtcctcgatattctcagtttcctatgatggggctaatagtacctacttggtagaattattgtgagaattttcattcaatgaatgtggactgaacacttgctatatgtgggctactattctagggcctggggatgtaaaagagaaacaagtccttgcctccttgaattcagactgtaaataaacaattaactacataatataatatcagaaagagtttggtggctggaagaatagcaaagggtaaggggagagagagagaggaacagagtgagagtagtgatattgcagagggtgttcaaggaaagcatcttacctgcatgaaataaagggataaaccatgtagaaatctggaagaagagtatttcaggcagatggaagagcatatacaaaacctctgttatggactaagttgtatccctctaaaaggcatgtgctgaagccctcacccacagtgtaactgtatttgaaaataaggcctctaaagaagtaattaaggttaaatgaggtcataagggtgggctctgatcccatggactgatgtccttttaagaagaggaagacatcagagctcactcactctgtgcacacacagaggaaaggccatgtgaggagacaggggaaggtggccgtctacacgtcaggaagggaggcctcaccagtaaccacccctgaaggcaccttggtcttggtcttctcacctccagaattgtgaggaaataaattcctgttgtttaagccatccagtctgtggtgttttgttatggcagcccgagctcactaataatacaggctctgaggctgaaatgtcccaggcatgtgactgcagcagagtcagtgatgggaggcagtgctgggaaatgccttggagaagtagccaggatccaggacacctttgccatgatgaggagtcaggacttgatgccaagggagatggctgtctttgaagcatgtgcttcaaggagtaaaatgacatgtgtttttaaaagatcaaactggctgctatgtggggaattgactctgggccagagaccatggtcttgagagcagttaggtagacaacaggagcccctagtggagttggtgagaagtggttgggatacattttggagatgaagctgactgaatttggtaatggattggatgacgaatggaaagaaacgagtcaggatgactcactggttattgggctgagcatccgagtgagtgatggtgtttttgtggagactgccactcttacgtctgtaatgctattctgcagacaccagtgtggctcactctctcccgtcttgcatgtctttcctaaatgtcaccttctgattcagaccttccctgggcagccttttaaaaattgcattgtttctctgtttccctgtcatgcctttcttttctctatagtatttatccccatctaacatattatatattttacttaccaattttattttcttctaaaatgtatatttcatgcatttttatctgttttgttcactgctttttagttcacatgtcttgaacgtggtctggtatacaacaggtgatccatatttcttgaatataaggatggatgaatgaatgaatgaatgggtgaaacctggggaagaggaatcaagaactttgttaaaatgagtactagttggccgggcatggtggctcacatctgtaatcctagcactttgggaagccgaggtgggcagatcaaggtcaggagttcaagacaagcctgaccaacatggaggaacaccgtctctactaaaaatacaaaattagctgggcgtggtggcacacacctgtaatcccagctacttgggaggctgagggatgagaatggcttgaacctgggaggtggaggttgcgatgagccgagattgtgccattgcactccagcctgggcaacaggggagaaactccatcacaaaaaaaaaaaaaaaatactggtcaattggaagtatctggaaggtaattgctataccattaaatgagatatatataacaattattattacaagtattcttcctcttttttttttttttttttttttttggagacggagtctcgctctgtcacccaggctagagtgcagtcttgcaatctcggctcactgcaagctccgcctcctgggttcacgccattctcctgcctcagcctcccgagtagctgggactaccggcacccgccaccacgcccggctaattttttgtatttttagtagagacagggtttcaccatgttaagtattcttcctcttctaagtgtgctgcacccacctcttagtagactttggttgggattatctgagagtagtcttttttagttctgtggctgtgtgagcacatggttgggagaatgtgaggaggatgtggccatgaccaactttatccttttgtagccactcactccccagcgtcacacaaatggatgcttacgcagatttcctatatcctccataggctcctatctttgtgctgagtattaattcccatctgtgttcaaggacggtaatcaggcaggggcagtaatcaaaatgatgtgtacagcaaaatcaaagctttcgcatcataatcaaaaccatgcagtaaattataggaatacgtgttctggtttaatcaatgactgatcttgcttggatgcttgatacagagaaaatcaaagatttggtttcaaattagccaaggggaacatattatgaatgatctcatataacttagcatgctatcacagtgattattttttaaataataagattttgctgtaggtctcaccacactactattttagcatacaacgactaagaaaaattctttagtatttgtccttacatagtgtcttgaagaatgacctgccctccaaaagcttgttacaggagagatgatataggcatgagcaaaaaatggtgaatgtgcttgtacccagcagtgttaagtaaattccgatctttgctgtgaattgcgagtgaaaagtttggggtgagtattttatttttcattgagaagtgaaataattgttagtttgtttagtagcactggtttttgggaattttttttcttttttgtctttacacattgcagagtagcagtaaagaaataggttggtcttttaaagggwgtatttcctgcttttaataaacacaagttttatgagaaaaataaataaatttcaatataaaattaagatgtacagaatatagatttagcacatataaaaaaggaaacaaaaatcattttaccttcactttagcctgggctgatttaacaaaacaccataaactgggtagatttttaacatcagaaattaatttctcatagttctagaggctgagaagtccaagatcaaggtgctggcagatttggtgtctggtgagagcccactacctcacagatagccttcttctcactgtaactcacatgggagaagtggccagagagctccctgggacctcttttataagggcactaatgccattcaggagggagggcatcaccctcaggacctcatgacttccccaaggctccatgtctgaacatcatcaccttgggggttaggatttcaacatatgaattttggattgggacataaagagtctactgcaaatttcttcatgtcagtcacattttaaccaaaatcatcttacatggacttctctagaggtagttatattttttaaccaactgcacttttatatgataacatatttttatatgccacctgcaaaagggctacctaatgaggccacctattttttgtaagtgtaagagactcagctggaagcaagttcaagtgtgaagcactgtcccctctctacctgggacatggtgcatacaaatgggagtaacatgagctttrcaggggtcatcttggcctcctgtcccacctccaccacttaccagtcatcattcattattgttattccatgaacaatgccacccacaaacccagagtgactctcagttcattgcttgtcttcacccagcgtaatgccagttgtgtgtccttaacatctttctcatctccttattttgtcctcacttctctccccactgccaatgtttaggcctgcagcaacgatttcctaaattgcccaccttccatccagcttccatcacactgctagagtaacacttcagaaaatccaagttcaatcctattaaaatcttattttaatcagtcgtctatttaattatttttattattgcccattactaggatagagaattccaagtttgtcaagtaatgaactgcatgatattcctggtctctttattcaaagtcatctcctacttatacccctaatgtgtgcgcgcrcacacacacacacacacacacacacacacacgtacacaccatcttgccttccaggcaccctcagccacctttactactcctggcatgctgtctcctgcacaagtctcattgcctttaccctctgtggaatttccctctctgtgctcttaccagatcactttataaagttatttttaaatatgcttgtgaaaataaatgaagatcacatgaacaagaacagaggtgatttatttagagtttgcaagagaatcaaccactatcarttgcatttggcacagacttaaaggaacacagaaagataggaaacctttagagtgaaacaaagagcaggttccaggtacgctgtggcatgaggaagstggagttgagctaactagaygtgaacatctgatgtggttggtttgggaagcagatcttgcttcctcyggttgattctgagttgaaaggagggagccaagaatagggaagctggcagtcattgactgtatcgtgactgttggggccagttgctgtagaggttgtggtttggcttccagctggttgctgcagaggtggtgctcagaattctgttgtcatatattgtctggccattgtccgtttgtatatttcatctctcatgatcaatcaatattttttgaatgagtacatgaatatttcatctcagtaagtgatcattccctcctcatccatcttaatsataaaattctaatgtcctaggttctttatctttcaacaaattatgtttccctttcttaatgggtagaaaaaggaagcttccccataggcctaaatgtgctgatttcaagagaaagcatacttctttgcaacaagaaattgcccaggccttcactcttaaccactatgctacatcaacgtccttagatgaaacagagacttgggggcatatatttcccaatttttcaaaatccatttttatcgcatattcaatttggcctgcttaccttatttacattacctgyctgggatgaaagacatttgaggttgtcattctggactcttaagtaagttcttcctttaaagtaaagaagctgaccttccaagctaatttatcccacttaacaagagtaataataacacaccacccactccagaaaggaaatcatgcagatgaatgaaataatgtttgtacagagcttgacactccataaaatactctaataacatggtgtctacactttgaaatgttcaaatcctatttcaatagaattaaaagccatgaagaataaaatgtgaattgcttgtcagacttttacatagaggtgcagggtgatactgatgccattagacaatttaaaagctgggttttagcaaagtttctgaggaatctgattggtttgtgggggagaaagtgatggtggtacttattcatatccatttttgtagaaaaacaataggttataacatgaaccgagaaacacttacgcagctaaatttacagaaatctgtctactcatctccgaggaaaagttttggctaagcaagttaattttgtcgttagacatttgcatagtaattgtattgagtctgaatgtgcatctgcatggaaagcatgttttttcaatcctgttctttggacatggattaatatagatcctggcgagtccttaaataataaattattgaagttgaatgcttaattactttacatttagatcttttataaccagatgcttgaacccctagtctgccatgtattgctgctgcctttattggtgttaccaggtaatagtcacctgagtttttcacatggtcttggtttgagggtagtctactaaagaatgcccacatatagtgtttcaaatattattaaagagtgataattaaatgtgcctgatgtataaaaagcatgtgaggtcatttaaactaacacttttattgtgattgttgtgaaggttatsaaaaacttgatcatgtatattatctaaagggattgttacaaacctcaagtgacttcaggtcattgaaaccattgcatgtggtgaccagctacagaggccatgacatttttcccttgcctattgtatccaaggttattttgcaaatcaccgctttgcatggtacaaccttcggagtttctagaaattgcctggagtgataaaccagagtatattcaacaataggatttmctagaattagtgggagaggtgtaattaagttactgtgtaatatatttcccccaaatgataaatatcaatatgtgaacactgaatatgtgctcctatgaagccaccttaagtggcagtttttagctcagaaattgtgaaccaatgttttgtccacctgaaccagtttgggtggatggaaaagacttaagggcagatttcagaacttgtttttctttgttaattcaaaaatgattctactaaactctagatgagatcaagtggtgatagagatatcagctgagtgagttctgttttctggaactttcttgaatctttattagtaattcatagcatttttctagatttcatggctgcagtttcatattgacatcatccagtatcactctaaagggactctaaaactacccttcctggcattcatctaagagctgggaagccatccgcttatacctggcttagaatatcatttttagagacatgaccacaagcctgctgacattcaagagcatggcttaagtgcatcccactcagagctttgtgaattcttcttgtaaattatgatgcctattcaagatttagtgggaatactccctcttctcaagcatttatcaaaacacaaggtgaatgcattatccacattaactgctgttcaaaaattctgtccaaaagttttgtttcaatataggcaaagtttctgtgtgatgcctggcatatggccaaccatataggatggccatgatctttattactgatttcttagtgtttattttgaatgtaaagttctttatgtttttcctaaaagttcctcactgtttccctcactcacccactagcccacatattcacatattttacttggttgtgactatttgaagaaagcccttaaagcttttttctaaagccccccatttaagattttcaagtacataggaaccactggggactcttactaccattctgattctgtaggctggggcctgagggtcttcattgctaactagctcctaggtgataggaacagtgctgagagcacactttgagtggcaagtctccaaagcagtgctgtctaatagaactttctgtgatgatggaaatgcttcatatctgtgccatccaaatgagtggccacttgcccgatgtggttaatgagtatttgaaatgtggccagtgcaactcaggaactaaaatttaattttatttagtttaattaatctaaatttaaatagatacctaccttatttgactatgctaggggacttaattaaagtctttatagctccttggctttccccagtcttgagaaaaagaatctgaaagtcgagggctctttcttatctccaattttccagaatcttgcatagggccaagaatattatgtatgcatagtaaatgacattcctattaagaggtctagtctgcagttttgggggcagactcatagaactgtcaaataataaaaagatttgactttgaagctataagacatggtgggtaggtggctcagcctctaccacttacaggataatttctgacaagtcacttaatccctctaagcatcaatttcctcatctcaaaatagcaaycatgattatggtaatgtaatacctatctcacagagttgctgtgttatgcacataaaattcctggcaaattatttttttcaagtgatacttgctctgcaaatgctagtttttgtggttatttcagcatgaatttcttttttcccctaattagttatatttcagtaaaacaatagaggaaggtaccctgtgtggacatagttgcaatccaattgagaggttaaataataacacaaaactacatgcagttttgtatcatttctcatgtggagaaagtagtttcgacggtcaaggaggagggcttcagcatgttactttgattctttgcattttatattattttatgtggaagcaaacaatatttttggcctgggattttgtgttgtttgatttaattccctcataaaaatgtgtcataaatgctttgctaattgtgattgaaatttcataactctatctcatcttaaaaatatcccattccaatttgctgaatacataatttccccttgtttaaagttatataatggacatattttctctttgtttttcttgagtatatttgctttgaaatagcttttttgtttttcataccctctgtttatatatatgtatatatgtaaatatatgtgtatatatataaacgtatatatgtatttacacacacacatatgtatacacacatatattaatcaaaagcattgcctacttcaagaaaataagaaaaatcacaaggggtaacatttcgcaagtgtgcaaagcactattctaaacaccttacatatataaacacgttgagttgtcactgaggctgagtaaacctttaagctcttttactgtctgctgtggtgttgagttctgaaaatattgatagtcctcttatcactggtaatgacatgacgtgccatccaatgacctttgtacaatcatgatttatgtataggttgaactaggggcatcgccatttaagaacgattaagacaaatcaaggcatttctgaaagagaacagattgattttstttcttaaagtatttatagcttgtaaggcagctgtctgcttttgtatattcttaaacaagcatcatagaccttattcaataatttaagtgttttctttagaactgttttgcagcaaaccgaacttcccatttgcattgatcagtgttttcaccttcattctagattacattttaaagtaaaccaaccaatttggataaatgtaaacgcaatcacttgttaacaatcttctgagactgaatcggtgctgggtatttctgagtttctatggaaggaaaatagttcaaagttcagattggctgtctcaccacctaagctccatgccttgccccttgctttcctccacaataaggcttagacgcaaaacacttcgttttcctgatcaccactcaggcatgagagaccaggtgatctatggctggccaataggccaacaacaagtagggagaacctcctttcatgagtagaaaggcaaagcattgtgaagggagcacctttctatattattccaacctcgaataaatgagaatttatttatttattttattccagtttgttcatttatttcttatacgctctaagaggcaactcagtatgttgattatttttttcagattcatgcccattcatcttcttaaagtagagtttctacagatgctccaggatcagtctgacctagtacagagcagtgtgtgtgtgtgtgtgtgtgtgtgtgtgtgtgtgtgtgtctgtgtatgtgtgtgtgctcctgcatgcttttaattatatattgaagatatgctaaaatatttataatgcctctcaaagattcaaagaataataataaaataagcagctttccctaccttagagaccttctgtgtacccttcccttatcccttcattttcttccctaccaacataaccactgatctgaattttgcatttacttttctcattcttctcttacagtcatactacataccaggcagctctaaagatatattgtttaattttacatgttttggacttctttaaaaaaakaatcatactgaacaaaaatggaatcatattgcatgtattcttatgaaacttcatttttcatccaataatgctacttgaaatgtatttatgttgatgtagttactacagccatttttcactgctctatatttgtctcacttttgccaggtttaatttttttctattttatcctttgaactagcttgaaattatatacttcactcttttttctaatctcttggttactccagaaattttggcttgtatacgtaactttaatcaaaatctttatgattctcttgaatgataaaatatgttcagcattttagcttcagctatttagtctggtatttaattacaccttcctaaaccacacacattagacatttttactacaatcaatgcttatagaaattcactcacatatttatcagcattttttttatttacctctccttcatgcatctctgactttgcatttgggattattttccttctgactgtagttggttctgtaggaaatcctcccgggagtattgttaaatattttccatttgtttgaatgaaaaatggccttttgaaatcttttgtattaaaagttggatgcactgggttttcagttcccggttgacagttgtttcttcttggcacattggcagcagtttctcctatagtctaatattcactgttgctgttgacaagtcatggcaattgttattcctctgaagtaatctcttcctctggttgcttttaatattttcatgttgtattgggtgttctgaaatttcactaagtctccaggtatatgtctttctaagtttcctcctcaggatttgttgtgcttcctaaatctgaggtttgaggtaatcagttctctagcatttatagcccattgctactttgcctccctcccattcattctgttttccttttctcaatagacttttccactctgtcgtgccctccaacaactttcttatgattccaacctagctgtctcactgtgctgccttctaaatcactttttcataactatcttctaggtcaataatttttccttcagctgtgtctaatctgctgataaaacatctgtaaggaacatgactgtgctgcacccaagcaggcataggccaaggtaaacaacctggatgactcagcaggtttgtggtacaagtgcatagtcccatgtcttatataatcatagctgtgtagagataacatagaaaagttcaccgccatagccataacatagagaagctcaccacctagctctcagccactattgtttgtgtaatgtataaaagtaacactgaccctgtgaggcagctgctgaataaagccatgtctcatctacctgctgtttctcaagtgttcttccagctccctgccccacatccacccactcccctcagccctcagctggggttggaacttgaccccaagcatgacaacatccattggtttttaattttaattaccatatttttaattcctagatattctttttgctttattttaaaattgatttggtcattttttaatagttacttcttccttaatcatattatcatcttcttatttatttcctgaaatgtgttagacattcttagataattcctatatctattagaattatgggttgaagttgtttgttatttgtgctcttcttattcatgttgacttgttattttatatattatatattttcatggaactttcttttaagtgttgtctgagacctgggttcacgtcaaggatgatttttgtttgcttcaagtagctgtccacagaggtagaggtgggaaatcaaccagtggccaataaattcattccccaactccctacaaaagtagtatgatgcaagccataaactcaaataccgaccaggttgtgggtatgaaatctctttggagattttttttttccttcacttagtgctcaattcatcaggcaatttcccttcttgttttctgaaagaatttattgccagttacagcttatgctgctgttccaattgtataagggatctctagtgagactccccacattgcaaagtccttagactttttctctgattgctccaactcacacatttgaaatcatacaaatggaagctcatggttgccaagactcagcagatatcttcagggtgaaacctggagtcagtgttaatgtctcttcagagtctttagtttgttttcatccttttccagcagaagagccctacaaaagaagacatttatgcagccaaaaaacacatgaaaaaatgctcaycatcactggccatcagagaaatgcaaatcaaaaccacaatgagataccatctcacacyagttagaatggcaatcattaaaaagtcaggaaacaacaggtgctggagaggatgtggagaaacaggaacacttttacaytgttggtgggactgtaaactagttcaaccrttgtggaagwcagtgtggcgattcctcarggatctagaactagaaataccatttgacccagscatcccattactgggtatatacccaaaggactataaatcatgctgctataaagacacatgcacacgtatgtttattgcggcaytattcacaatwgcaaagacttggaaccaacccaaatgtccaacaatgatagactggattaagaaaatgtggcacatatacaccatggaatactatgcagccataaaaaakgatgagttcatgtcctttgtrgggacatggatgcaattggaaatcatcattctcagtaaactatcacaagaacaaaaaaccaaacaccacatattctcgctcataggtgggaattgaacaatgagaacacatggacacaggaaggggaatatcacactctggggactgttgtggggtgggggaggggggagggatagcattgggagatatacctaatgctagatgacgagttagtgggtgcagcgcaccagcatggcacatgtatacatatgtaactaacctgcacattgtgcacatgtaccctaaaacttaaagtgtaataataattaaaaaaaaacaaaagagctgtacagggaatctaggctggcatagtgtgagaaacaaaacacacatggcagctctttttgccatccacaacaaaatactaacaattgagcctataatcagctaaatccaaaggcaacataatgttcttccccatcttttacttgtgcagttgtgttttggatccagattaaagaccttaaatttagtactattaagtttattgtttgtaggtttgactgagctccgtaaaattttttggatcttaattctatcacttaacagtcacaattttccccaatttcatgtcatgcatacatttggccatcacaacttgaatgtttttactacactgttgtaaaaatgttgacccagatcagattaaagcctcaatatcccctctaggtagagactcgtgtatgatgtggcattgactaggtctgctgttaggaatactttctctttcttttcttttgttttatttttgagatctccctctgtcaccaaggctggaatgcagtggtgcaatctcagctcactgtaacttctgcctccttgattcaagcgattctcatgactcagcctcccaagtagctgggattataggcatgtgccaccatgcccaactaattttttgtatttttagtagagatggggtttcactatgttggccaggctggtctcaaactcctggcctcaagtgatctgcctgtcttggcctcacaaagtgctgggattacaggcatgagccaccatgcctgtccatatttctttatcttcaagaacatattttgccaaatgccttcctgaagtcaacacacattgtatttatgatttttttagccagagaagaattaaatcagttaacatgaatttgacttataaatccacctgtgtgttaatcaaagggctccatggatagccacacccagtcatcatttatcatctccatttattcctcactggggtcatttgaagattctgactcagaattacatccttgataccttgctaacagtcaagttaagctattatggaattgtgcctattttcatgaatatttgggcagcctcttttcctaaagcttataataaaggcctctatgaactaccatgaactccatggacagtaggtatacagtgttatatttgagttccttcccttttcaccagatgtccaggtaatctgtactttatttctataatgacatagcatccatccttttctccttttatcttttgagcattttccagggtgctttcatcatcttggttttggatttttatcagaacatgtgtccttgaacttgcacacaagaaagactttcagtgattgacacatccaaggcttcttatttagttgttcttcaactcaaccacattgtctaatagaaaccagccaggctctgctgtctgcaccattaggatgattatgaaaagaatttaactagcattttcctatttatctttcaaatatataagcttctacttagcaatatgaaataacaaaccactgctacaggaaaaatgtggataaatctcacagagattgtgtggaacaaataaaacaaatgaagtcatgtgcaaaagactacttactctgttgttctgtttataggaaattcaagaacaagcaaaactaataaatggtcctgtaagtcagaatagagttttcccctgggactgggaaatattgactggaagaagcgtgagggagccttatagaggctctatatgttctatattttgatctaggtagtagttataagtctgtttacatatataaatattcataaagttgtacatttaatacgtgtgcattttactatatgtatgttataccttaataaagaagaaaaactcatttaggttacaagtgagaatcagttttagtgcagtacttatatgagtatggactctggagtcttggatatataatcagttgattacaatcaacatctgaatgattttggaaactaagtttcctcatctgtaaaatggatgattttctgtgataactgtacatttttactttttgtataaggcataatggagtgatgtgtgtaagtcacttaccatcatacctgccacaatacatgcaagttttagtataatatcgtcctgattcaaaacatttcctgctttttaaaacatcctgctgtttagacagatgactgacattattcaatacatcaaatggtatgttttcattagttatctatttgtgacttgcttagtaattataatggcaactgccatttatgtaactctttatgtttaaaagctaatttatatacattatctaatttaattattcacaacagtgctataaaaatgatattaattttatcctcatcttgccaacctagagcctgagatgcagagacctgaagtaacttacccaaatgacatagtcaggaaatattagagagagtcataactcagtcatttatctttccctcttcaaacggaagggtacattagagtcacctacagagctagttacaagttccaccccccgtagtgtctgattcagcaggtttgaggtgggtcctgagattgctgcatttcccaggcgatgctgacactaccgtcctatggaccacactttgagtagcaaagctttgcagatgaagaaagcgtaagcatcagacctgagttctgccttcaaagagcttgcatttcttttttcaggaaacaggactgaagtatgaaataatagaagcctccctaaggtggtttatatcctgagaacaccctctttgctggaaagaaagtttcatagtagaagagaacttaagaatactcagattatatataggagaacaaagtatgcttagatacgctaattttaatggtgttcaatgacttatatgccaaaatgttaaaatggtgggaggcccctaaattaatatcctaattcaagtatcctagtcgtgttattctcacaaattgtcatttcattatgtcaagtaatattttagggtgttttaaccatcgttatttaggtctttgattgatgtgaaaattagtctcagtgctgtaaccacaggtttttgtcagtgtaaccctactgagttccagcttcttttttaaaaaaaagtacatatgtgtacccacaaccgttgttactaattgaaatacttgaagaaaagagagaaaacagtgaccaaaattcttataaaaatcaaaagctttccattttttccagctttgctttgtttcacagcagccatttatcagagttttaacaagtaacaagtaaccagtcacctattttttaagtgacagcattattaagatataattcacacaccatacaattcactcatataaagtgtacaattctgtaggtttcagcgtattcgtagagttatgcaaccatcactacaatgtaattttagaacattttgttacttccaaaagaaaccctgtccccattaatagtcattcctcatttctcaattcactctgccctttgcaaccgctaatttactttctgtctccatggatttgtctcttccagacatttcatagaaatggaatcacaaaatatgtggtcttttgtgaccagcttctttcatatagcctagcgtttttgagatccatccgtgtaaaatggatcagttttttattccattttatggtcaaataatattcaattgaatgaatatgccacattttatctacccattcatcagttgatggacatttcagccacttccacactttggctgtatgagtaagaacacatttatgtacaagcttttgtgaggacatatgttttcatgtatctttggtatatacccaggagtagaattcctgggacatatggaaactatgtttaaaccataaggaactgacagttttcctaaagagttgaatcattttacaattccactagcagtgtatgatgattccacgttctccacattctcaccagctcttgctaatatttatctttttgtttacagtagtgggtgtgaaatggtatcttgttgtggttttgatgtgcatttccctaatcctagtgatgctgagcttcttgcatgtgcatttgcttactttgttttctttttccatcctttgagacaaggtctcactcttagtccaggctggagtgcagtggtgcgatcacagctcactgcagccttgacttcccaagatcaagtgatcctcccacctcagcctcccaagtagctgggactacaaagcacaaactctttagttttttagaaatggggtctcgccatattgcccagactggtcattcatttatctcttttggagaaatgtgtattcagattatttgcccattttttaatttttttttctttttaaaatttaattgtaaaatttgaatmacttttttgtgctcttctttgttttggtcttgttttgtttgatttggtcttgttttgttccttaaccttttggtgactagtgagtagctattggtagaaagtgggtaattactaaacaaattgcaatgagaaaaaaaagaattaaatagtgtggaacacttgcaaatatgataactaagttttaccaattatgaacaggttaatatttggtttactgtttggaaaataataatgtacaatttacacattggttctaatacagtatttaatctgtatctttgtgtcatatttaataccaccattttccaaattgttccatggaatgtaataggttttatatcaaaaaggggtctgtggcttaataagtctggagaaccataggctcaataaacgggatggagtgttttaactcaagggcttccttgaacctttaatatgtaaatagacattgtaagtgttcaaagcaaggactgtacatgaaaataaaaccctttactttccctaatcatttcttttgggacttgtgttctgtggaacacactcggggaagcattgctttaaggatgttaatttttcttaaagaaagtatattgccctggagagctcagattgtgacaactggacaggtacaaagactggatgaaacagcagcaattgttaagttacgtgttacaaactcagaattaatatgggaaggatcctgacattttatgaaattaaaactaatattaattgaacagaaatagaaaaaaacctgggaagacttgagacagtttgtgattcctctcagctagctggcatgtttattttgtattacagtgcataattgaccccctgctaggtgaattggattttgcagactcgccttgttatgtatttcaaagagctctaaatttaatacatgctgctcctcagggttcaagctttgaatcaccctccttttcctgtgttttagctgggtaagtttctctcttttcaagaacagcaactttttcaatgcagacagtttaattataaagatcttctcatttcggtaatgttttagtgaatctcatatttcctcataaatttagggagaatgcagctatttctaaaaataggaattaatagttgagttgttactggcttttttattgtcctttccagaattacaaaaaaaatagtctttggcagttcacattgcttcaggttgaaagtatgcaaaatttttaaactattccatattcgtaataagtgaaaaaataattatttttgatttctcccctaaggtactagcaatgtgtccattaggaaatttagctcttatttttggtgaagtagcagaatttttgtttcaaggcaaattcagcatagatacttgattgtaaagatattattgtttgcaaatctttgtggagttttttgggggccaaattgaagcattaactcaaaagaatggcccttttcttttattgttatgttcttttcattttatttatttgctttcatacattttctaattaattttatgtttttaccaataccagccccatcactggggttctggtgaccacttaattttactgtgaagtagaagccagatgatggataagtcaagccccaatataataaagccaccttaactagttaaactgatattatagagcttagctctgactccagatatacatatataccattactttatagaacaactctctctggaatagccgtgttctctttaagccaggtatgatggtgcatgcctgtagtccagctactggggaggctgaggtgggaggattacttgagcctaggagttcaaggccaacctgggcaacactgcaaaactttgtctcaaaaaaaaaaaagttatcttcgtcattgagatgttgcattgatcacccaagtatggtgaagaattgaagagtagccaattagagtgctcgattatgaaaatatgatgcaagatagggaccaggaaggtcaccacagttcttcctggggctagttgctatgaaagataaacccccacatctcagtagcttaacactattgaagtttacattgttgtttacaaaatgctctttctggtggactgtttcccttcaagccatgattcacatggccggcattcttccatcttgtaaacccatcatctacaaacagagacatccaacttaccctgctaggctgcatcaagccagaaggagaaagagtatggacggtcaccagtggaaggtttctgtgaatgtgactctagctctaactctgtgagctagaagtcagtcatatcaccaaacctcatcccaagggacactggggcatgtaatccaaccacatatgctcaagaagatgaaatggattttggtgaacatgcagtgatcttgacatacactgctgaatatttgcttttttatatttacagtgttgaaattaatctgactaatgaattggagttagttatctccaaaggaaaaaaaaattacacatgcacgcacacattaattatacattagtcttaggctaataattaatatatccacatgttaagtaatttctttaataagttctcttcaaattagttcaaagatgtctttggcattcctagaaggcacattttattgatctgttctcaatttacaaaacaaataactgactctttatatctcctgaatctcctttgaacattaaactgagtagcaaagcatcacacatagcaagaaaattgattttgacaatccagccttgttagttatcatttcaacaggtgccattagtatcaagaccgaggtgcctgccacagctctagtgcaataatgtgaagtaaatatccatccaagcaccctggcctcttctccaaaatagaaaatgacatcatgtaattggttttgtctgaactgctcagtgagtgaaaatgtgtttcagaagagttaaggcatgatgtcattattcctgaagtggattcttgcaaaggctgggcactcagcagcctgagtcttaaaaccagcagcagtacaaaaacctgatgcagaaccttaaccccatttatataatatggtgaattttttctcaaatgggaatatggtgcattatctttaaaaacaagaagtgatcacatgctccagaacaccactgatgcctctaagaaatcttattgaattaagacagttaattaattgtctgcaatagtcttgactcttgcctgtctctcacttgagcatgtgttgtaaattaggcaggaatatcattagggcatccagttcgttcccatgccccagtggcaaagaggggcaggacatgaagatgattttatttatttaacaaatactgatcacctgctatgtgccttgtaatgatcttagtgctgggtatatagccatgaataaaatgagattcctctttttatacataataagcaaataaaaatacaacccaatggcaggtagagtttcatgctaggaagaaagataaagcaaaatgacatgctagagggtgatgcgggagtggcatggactggaagatgggctgtcagagtatgacatttgagcagaggctgaaatgctctgagggagaaaatcataaatcatgtggatatttgttggggaaatgattataggtgtagggaacagcaggggcaaagtccttggatcggagtgtgcttggcaagtttaaagatgagcaaacatgaatgaggggtagagtggcagggattatggtggaggagaggcagaaggagcagaacatgcaacatgctggatgctgctgtaggccctcataagggactgactattgagccataaagccactcgatttcaggcttggcattcatgctctagcaccagaagtgtaatgctgggtggtctatgggctctgcatttaggctggggactaagatgtgacatttctggaccttggatgattgtcaaaggatgggaggttggttctgggttcagagaatggggaagtacattgcccattaagaattttaagagatctaagtgtgaccacaattgatgattttattatcttcacttcagtgataaaattcttcaccctcctcattccataatattctgctgctttcacctgaagttcgccaggtatgattaaacattgagtaattcagaccaaagcttccagatatctagtaacaatatacactagtcaaaaaacaagatcacacacacagacacacacacacacacacacacagacacacacacacactctttagtatatttggcaaggagaaatcattgagtgcatgaatttataatgggattgtatattttcaatcaaagatcttacatgaaaaatgttcaatcattaagataagggagacatttatgttatgtggtacccaagatatgccagtaaggttttttaaaatacactttattcatttgttcaaaagccattttgggtggtggaggcttactctgtgctactgaagacataatgaagatcaggagataccctggcagccgagagcagtggtgcatgcctgtaatcccagctactcaggaggttgaggtggcaggattgcttgagcctgtgggttggagaccaacctgggcaacacagcaagaccctgtctcaaaaaaataagtgggaaaaaaagacagagatgtccttgcaacaaaccagaaagtgaggtataactattctaattttacaaacaaggtaactgaggcacagaggagttcagcctgtgttcggagtcacacagctggtaacatgaagttgaaacacaaatgtaacttttttctacaccttgtctttttaaaaccaacaacatctttcagacacttgcacactttttttcagataattggtgtatgtaaaggatttcacttcacatggactatttggtagatatataacatcttagatatagccaatatcttgtataggaacaatgtttgtatgaagtaaagaaaaacaataggataatcaatgcaaggtagaaagtgatagcacacttctgtgattaatactaggataactggtaaagagtatatgctattttgtattactatttccataacttccaatcatgcacatggctgcttctctacaactctacaaagacagtatctaacacactgtcatacaccactgcttcctatcttgttaaaatgccaattctgacgcaggtctggtgtgggacctgagattctgcatttctaacagactccagggatgcagatgtcattgctctgtgctcttaaatgtggagtttaaggctattacagtcatttccggcaccaaccaaaacactgtgtcttggcccccacggctactggtggtcacttttgcaagaatgtttcctgggagacctagtagagcagcttacaggagttcacaaagacacaaaatgatggtaggaaggaataaagaggagaagtaaaagtgttgcaatggattctgtacctcaatcctgaagaaaccacagatcagtcacttccttcttgttcaagtgtgtcaagtgtgtcaagtgtgtcagcctgatttggcacagctgacttgatgaagcatgatctcacacagcaaagctgttgatcaccttgaagaatatgtactttgctccttggtgtaacctaaattttacctcgctaaaacaaaacaaaaagaatctaatattctactcatattattcattctggctggatgctaaagttaatttccttaagtgcttcagatactatattaaaactatccttttatcaaatattttaatataaagcttttgaaaacatgcaagagaatttcttcattagagccttctccaattttaatgagcacacaaatcaccttaaaatcttattaaaaatataaattttgactcagtgagtctgggatagggattgaaattttccttttcttaaaagatcttagagaaggtggatacagcatccttggagcactctgaatagacgggccttggaatatcttatcttcacttgtattaggatggcttttttgtgtgtgtgatgttcaaaatgatgaggaagctatatgtttacatatcaccagaagcttaaaatgatggaaaggaggctcccaccccatcatataggccattgatcaaagattctgcagtcacactatttccttaccatgatggattattcaaacaccagctgtaggaaaaggatttttttcaggaaactgatggtccattgtagtttttctgaaatcaggctgtacttgaggattactcagcgggttccaaagagtacagacatttaagatccaccccagaccaactaaatcagaatctctgggcatgaatctaatgagtagtctctagaccagcagcacctgcaagcttatgagccatacagaatcgcaggcccctccagatctactgaagtacagcttgaaaagatccccaagcaattccaacgcatgttcaattttgagagatgctgctaactgggaggcaaagctgtagagttgccgcagcaacttaattgtaaggtattaaaagtctcctttcctatctaatcgtttggatgtctgccaggtattaggaccaaaggaagacgggcagacataagaacccatccaatggtggttacattgattatatccttcctgaggcatctgaaatagtataaaataataaggagagaacaccaaaaatgtatcaacttccatgtaactagtgtgtattagcccatttttgctttgttgtaaaagaatatctgaaatttagaaatttagtaatttagaaagaaaagaggtttatttagttcgtggttctgcaggctgtacaagcttggcaccagcatctggtgaagcctcaggaagctttcactcatggcagaaggcgaatagggagcaggtgtgtcacatagcaagagaggaagcaaaggagtggggaggatgtgccaggctcatttaaagaaccagctctcrcatgaactaattgtgcaagaactcactcatcaccagggcgatggcgccaagacagtcatgaaagatttgcacccataatccaagcagctcccactaggccccatctccaatactgggaataacatttcggcttaacgtttggatgggacacacatccaaaccacatcttagtgctttacatagactgttccatctatctctcctctttgtcatgggttttggttgactttctcccagaaagtcctccctgcttgtttctggctttaaatctattgagtaaaatttatctgaaggaaatttaatcaataattcaaaacaggaayagattattcatagggagagctgtgctcacagttttgttaatttgcagtggtagcattctttatcactggctgaaactcaagtaaaggagtgaaagatcaagtatttgttgagaaactattttgtgcctagcatcatgctaaggattatggtgacaaccgcaaaaggttagtttcatggcacttgttggagatgcatgtatttaacttgcaaatagtatacacaactcgtgtgttattaagttatgaaatattgaaaaagcataacatgggagtttaataatggaacacagacagactgagcagaaaaaaaaaattagtgaagggaggtgtcattttgaatttaggcttcacagagccaacagaacttgagtagatttaagatgtggacattccattgagagaaaacagcttcaacaaaagcaaaatatataaatatacatatataaataacacacagatgacaggaaacaaataataatgagagcttacccttaaacatgcagcactattttatgttttgcatttttaattttgggcatagaatttcatgtatgttggggaaactgtagaaattcttcttattctaattaaggaaggtagctttgaaaacaagcatattttaaatagttaaaattttcattattttttcctcaaaattatagattgtggtgcttttttgtaatttttgctaacttcaaaatgtaaagttaaaggttttatgaaatatcaattctgaaaaaaattttctgctactaatgatctaaaaactgctatgttaagcaggctcttttcatagattaaaaatgctcaaaattactttgatgtaaacttcattcattatacatgtaaaaagcttggtttacatggcttataagtcagttttacagtctggctgttaagcctaattctttagataattactatgtgaaattttcgttgtcattaattcttcattgtggcaaactggcatgagtattctctattatggagtaataatattaataagaagtgcacatattcaaaataatgtagaattatatgcactataatttacatatttgtttaatgtcttattttttattatcaactttgcttgtttatttgttttatgtcacctgctgtagaatgctaattggtaacaaattatagcattatagaataggtgcaagccatcaaagtgtacatttttatgtaaatattttatttttattatagaatgagtaacctaaagataaatgcagtgcattctcagcaataagataatgctgaaatacatttcagaagatacaatatttttaaacctgacaggaaattataaaacattagcttacatgaaataagtttcattctatatgagctttaatactgcaagatctatgtctattaactgacaatggaaagttttgtgaggaaaatggttgtatgctatatctttgcttccactaacaggaaacattacagagtcacaattcttaatagaccgcaggctcctttacaacttagccatctatattactcacttttatgtccctagcattggtgatagatggtgttatttattcacaattcttttgctttccatctttgccatgagtgtaagtggagttgacaatctactgcattgacttggccctgtgacttgctttagctagtcaaatgttagtggatgtaatgactttacatgtgcttgtgtggtatgactccttctcttgcatttctgccctttactatgagaaaaatatcttttaggtagttgacgatttcgaaatgaaaaggatatgaagatcagaacccaacctgtagcataacacaaatctatatgcacaaagcacgttccatgcagtcatgtcttagttctgggatttctaggtatgggatttccttgagctgagcactacatgtaatagtgatggtgaactatctaggtatcggtttctaaaggttttctcagtagtgggacagtagctgagaaataaaggagaaattggctaggccaggagacttctccatctctagggtcgccaggtaatagttcagattacttcagagatttaaaggtgcagcattagaacatggttttccaggttagcagggtcaggcagttaccagaagattctgcaagcatgacttggtgcctgagtgggtggcgagccaggggtccctgtccaatccccaagctgaacagagaataaaatccggattatgattaagctcatatccaccaccacaaaatggagagaaaaacaacmgatttggttaacacccagtgttcaaggaatgagaaaagggataggaagcaaacttgaagcattgaaaaaatatgtcaggtcctgaaactggggggaggagaagtgggaaggagatgttctgaagagcgtcactgagaaaggcatatttatacctgaataagttctctccaatctgcctgcaatttttagctagtttgcctagtgtagccagattacagcctttgggtgtgttctgtgtcaccaatgaggagggctctgtaactgttgatgattgccatagaagggtgggtttcctgtcaagtcctccaggtactatccagatgctcccccaggatctgacagaggctggactaagggagccttctgaagaatagagtagcacacagcttgagaactgcagtgtggactgaacttgaagctcagctacatggtgttataagcagacttacaaaactacctctcagtttgggcaactgaaactgaaagtttactattgaatatagacaaattttggccaggcgctgtggctcatgcccagcactttgggaggctgaggcgggctgatcacctgagctcaggagttggagacaagcctggccaatatggcgaaacctggtctttaccaaaaatacaaaaattagctgggcgtggtggtgcgtacctgtagtcccacgtactggggaggctggggccagagaataagttgaatcggggaggcaaaggttgcagtgagccaagagcgcacsactgcactccagcttggagtagacagagcaagacttaatccccctaccccccaccctcccaaaaaagaaaaagaaacatgtaaaatacattttcatttaaaaagttaaattgtagtatattcacttttagtaataaattttttataatatgtcattaccaggcagacaaaaaaaacttcagatattttctttcaaagtgccttgagtgccttctgatagaactgctaacgagcaaaactagtactagttaaatagcactaatttgataatactaattattgtgaattgtttggatgacttctgatacatatattttactttgaaggggctttttctaggaatattgatatttaatacctgttatatcttctatttgtaaatgattattaagttggctacttgctctgcagagtattaggaatttcagtttttactggttggtggttgcatgtagttttgccaaacagaatgcttaataaacattttaagcttgttctgccttggctgtatattttagttcattttttgtaaattttctcaaaattaattgtaggctagcttacctataatagtccttaattaccattttgggggggaattcttttgtatagtaattgttctcccccaactagagtttatgtgccttctctgtccttctctgtccytcacctgaataatataatgctgaccatcatggagtaagcactgaacttataaatcatttgaattggttttttgatctgaaattcacagctgatgaaagcagttgaaagtcgatgttttctgtgagtcatgattttttttttccccaagctggagttgaaatctacttgaatatctctctcctatgacaaaggcaaaattaagtatcatgataamtttcaggattmgaataaaataatcacttaatagtgatgtgaattttcatgaacattcgcagcttgaagaattattttagtatgccatgtatttatagtttaataaaacatatgtttctctatagttcaatttattttgtgcttgaaggaattttttttttttttttttttttttttttttgagagggagtctcgctctgtygccaggctggagtgaagtggcgtgatctcggctcactgcaacctctgcctctcgggttcaagccattctcctacctcagcctcccaagtaactgagattacaggcacataccagcacgtccaactaatttttgtatttttagtagagacggggtttcaccacgttgggcaggatggtctagatctcttgatcttgtgatccactcacctcggcctcccaaagtggtgggattataggygtgagccaccgtgcccagccagaaattatttttaaaactgtggttttgtattcccaggataaaatgtgtatcttttgtacagcttcacaaattagtatgtccmtttacctatagcagtgcataaaaggatatttctttaaagatctatttgtataacattctayagtcccctctttattgaaagtactaatagcaatatttctaaaattatttaattttccagtgaatgccaaagagtcccaattatgggaaaatgtgttccattttggaaaatgctacatgcagttctcattttcactcagaaaaataaaaggcaatttaattacaaaggacgcaattttatagattggaaaaatatagaaatccagactgcttgccaagtggagtgagactgtgtgtaataaagtagattttgaaaacttatgctcaaaacacaatcaaaaagtcacagaatgtgagggtattatggatggcaaagagatatttggcaaatgtaagcagggcaggcagtccttcattttttttttttaacctctttttctaaatgccctctgctgaagtgggatagttatttaggggtaaggaaatgatggtgggaaaaaatgtgggagacatttttctctccacgtgcctgaaatcttgacattgttctctcgatcgatggaaataatcaaaaaggagaaggccatagccctggttaattaaccagctcactatttaagagcacaattctccaaaacagccatttatttctatctaataaacattaatctcaaataaataaaaacatattctctctctaattctattgtaagcaccttaagacaaaacctgagtcttctgttttgtcctaacaatggtgcaatgtgccctctagagaagacccttcctaagtgtgattggctgggatgggcttagctgttctacctttttctaaaggtggcactcccacataccttataaatgcaggtctagtttcatcattccattaatcacatgctgacatatcagcttcaattatttaaatcaaatatttacagttaacattagttatatgaagtcggtcctcagaaatcactgtatggaacacacttttatagttgacattgtttaacaatgtccttctaaatgttggccaagtaatttgcctgaagagcccttctctgcctgaagccataagtacttgaacagacagttttttggggagatcttcctagttaaaaatattgagctaatatctaaacttatagataacttygggacatttgatttgagttaaggttagaacaatgctgcgtaattctggccacatatataattaatttaaattcttctagattaaaaaaaatsttgcagaatgctacagagctgcaaatgaagactagtatcctgttaaaaccatttgatctttaaactggcttgcttcatttcataatggatcgaagacaatggacacaaagtatataggcagtaaaataatgataaaataartgttggtactctaaaatagaaataaattagaaaattaagaacaaggaaaacaaaacacaaatgcacacacatagcagctaagctggctcatacctcagggcctttggacctgttgttccctattcttggacccgttgcttccttagatctttggttttgttttactttttgagaaggaattttgctcttgttgcycaggctagaccataatggcacgatcttggctcaccacaacctcagcctcacgggttcaaacaattcttctgcctcagcctcccgagtagctgggatcayaggcatgcgccaccatgcccagctaattttgtatttttagtagagacagggtttctccatgttggtcaggctggtctcgaactcccaacctcaagtgatctgcccaccttggcctcccaaagtgctgggattataggcatgagccactrcacccggccaccttctcagatcttttgctagctgctgctkcttcttcttctttttttttttttttaaatggagtctccctctgtcgtccaggctggaatgcagtggtgtgatcttggcttacagcaacctccacctcctgggttcaagtgttctcctgcctcagcctcccaagtagctgggactacaggcgccccctcaccatgcccagataattttttcatttttaatagagacagggtttcaccgtgttggtcaggctgttctcgaactcctgacctcaagtgatcctcccgaagtgctgggattacaggcatgagccaccggcctgctagcttcttctttcttgtcatgtgtctcttttgagatatcactcttccagagatgctctccttgaccaccttgtctgaactatccttatagtccccttgtgtcatctccttttgctttcttttcttcagatcatttatcaaaatcaagttgtttcttgttcacttccatgtgtaagtattgttgtctgtctaccccaattcaaatagaaactccaggagagtttgctcactgctatatcccccagttgtgcatgtgggtaccaggtgacactttctaagtagtttaaagtgagtacatgttcttaggaacttgctatgtggcctgaagctttctagaactcaaaatgaagagagagaaattagaaaggcagatgcttaccactgctccccagggaataataatttgaaaaccagcacttaattataatagacttgtattgccaggaaccccatccagtgggtactgagctggtacagtgagaaaactgtcaaacagaactttgtacaggagatactcttattgtggtccaaatctggagggttctattagatgaagttcatccaaacatagaacttagattaagggagtagmtgtatactccacagccaatccttcacaaaactcatttgtctccattgggttttttataagctctggaaaacaaacaaacaaaagagatatttaataagttatctatttttttccagagtttcccttgttctcgtgctgatgattaactttaactcttcaaatcaattgtaagctgcctaaaggcagaaaagataatgtatttaaatatgtcttcttattcttaggacagaagaaggtccctatacatggcagatgttcattaaggatcagggtttastgatgttaatgctattatataggttcattagtcatataaaagttcattatgtgccaggcactttcaaggcaagttctgagaaacaacattaatgactgggcacagaatctcagactagaggacctcatctggtgaacttgggcatgaatgagcacagcaaattagtggcagagcctagggcttattctgctaataggagcaattctaatgttggcatgcactcacacagggaaatgtgtgatatatgtttccatcacatagggaaagcattaaaaatctacatgcttggactttactcctaaatcagagatttggggtctacagaggtgttgaaaccctccctcaatcttggagggtgtattagtctgttctcacgctgctataaacaactgcctgagactaggtaatttataaaggaaagcagtttaattgactcacagttccacagggctggagaggcctcaggaaacttacaatcgtggtggaaggggaagtaaacacatccttcttcacatgataacaggaaggagaagaatgagtggggggaaaagccccttataaaaccatcagacctcaatgaacttactatcatgagaacagcagcatggtggtaaccgcccccatgatccarttacctccacggggtccctcccatgacacatggggattatgggaactacaatctagatgagatttgggtggggacatagccaaaccatatcagagggatacactgagatacaaggggataaagcagataaaaaggcaaactctagtcaattgaatttctcatatatctttcattctaacccgttcagatgtactaatttgtcacatgccatggttacttttccctytttagactttcaagttggaaaaagcttttttcagattcagaaagataaaatatcagccatgtattaaatgcattaaatgtttttctctcagctgcttttattccaaaatattttttttttttttttttttttttttagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctccaaaatattttcttaagggtcactgacaatcttgcaaggatgtaaatgacaagctgtatttgtttgttgacattatctatcaaagaggcttctaaacacttttgtgtttctgatgtgaataaaggaaatacaacattgaataataatccaggcaggttgcaggtggcataaggcttcagaactccaccatagaaatgaacgtgattggaaatgcagcaatcaacattttgacagaaaagtgaatgtttcaactgctttatgttcacaaattgtttctattttctttttgtattacaaaatgtaagcagtgtgagtttgtgtgtatatgtgtgtgtctatgtgtgtaaattcaaaggtttatcctgtaataagatagaatcagagatagactccttgctattctcaggttattttttccttgttcacatttttttacacttgagtaaaatacttctgcaagacatattggaatagttttgtgactaaatcctagaatttgcaaaatagtgaatcacaatataatgtttcctttggatactattttggccatacttggttggctttctggaagtatgaagtggaggtttcccagtgacacctgtagcagtgcttctcagggacatagaaagacaccaaattctcttatactgggattcatccaggtgaccagcatttgctttgcaacaatcatctgtggtgattgctcaagtgtagaagggttttcaagaactccatcatggagttttgtagtggcagattagctgtcctctacttctcctggagtggctgggattcttcaacaccaaaagaggcattgagtctttcttaattggcttcagtcagagagggtggggatatgtgaaacttctcagtctgatctgttcttcagctcctcagaaaagttctacagctactccagatctgtttcgataaaggggcggtggtgcaatgaaattattcataacagcccactttagaggtctgcctgaaaaaggtggagtatttttaatagtagatgtgttgagtgtcttatccatatcctttttaccgaggctggtgcacccagcccttgagatgccgagtacattatgttgcattcctcccaggggtggcacacaggcaatgactgactcgtatgagggtgtaaacgtgcagctcccttgcctctaggtgggatgtgggatctatgccagcactgtccaggataaagtcattaaatctagaaagtttacatggattcaatgaattcctctattcgaagtcttactatgtttaatagcaaaacaaaatagttacctaatgcagttcaatacattttgatatgttgttatgatgaagaaacatgaaaattctaaaaatgcccatttgttgattacagagcaattaagttttaaatgattcaagtgagtctaggaatgtaaatcttaaccattgcagaagtgaattaaacatgtttagagaaatcacaattagtcaaaaaaggtaaggtagattattctaccttaccacagggctcaacagggaactccacagggatcaagctcatctagatgccaaatctttgccagctccttcctctgccccatcctacatctctcactcccttacaggtttcccctaaatgcattcccttaataaatcatgggacrattattttcatctcagcctctgcttctgggaaacccagctaacaatatcgaatatggaaacatcaaacccctgaatataaccagggctgcctcttacttaaagactcatgcgtgaaatgacctgaagtgcttagaataatctaccttaccttttttgactaattgagatttctctaaacatgtttaattcacttctgcaatggttaagatttacattcctagactcattsgaatcatttaaaacttaattgctctgtaatcaacaaatgggcatttttagaattttcatgtttcttcatcataacatcatatcaaagtgtattgaactgcattaggtaactattttgttttgctattaaacatagtaagacttcaaatagaggaattcattgaatccacttaaattttctagatttaatgactttatcctggacagtgctggcatagagataaacatttaattgatagcttattttatgaaaaatataacatggcaaaggtttacagttctgtttaatctcagcagtggcatgttaagaagacaaacggagattaggaaacattttttctaaataaaatacctcattttatgtggtactgataagcagtatttacaacatgaaataaattattcctcgtatacttattgaataccttaaaagtatgtgctaggagctgggaacccagagtaaaatataggtcttgttcctaagaggatacgtctattatggggagatgaaaggggggttaggggcaagcacagacttgtaaataatctatgagtaaacgtctatacaccagatttgcctagaggatggtgtatttgcgtggcaggayattgggtacagctttagcagtgaaaagagcaaagtgcaaagagaacctagaagaatgcaccactgggagctgactattattattttcattaaaggtgagtattgcataactaaaatatttcagctcaatgacctagttaaataaatcgttgtaataaataaaaatgtcttcctgtctttatgtaactgctcattttgtgaaaagcataacttggctgcacaccttttttccgccttcttctgataaattcttggagtccaaaaggtatctttcatttagtagatttttcaaaatgtttatattcatagcaagttctggtttgggtcaagcaggtggtagaaatcataactgcctccagaaatcaggagggcccacgcagtacaggacttggcaggccctggtggcctaaggtcagccagagtgcagatgcaatgcagcaactatagtaccagcattattctagaaagttcttacttcttggaagtactgacttgtaagtaaaagagcattttaacttgatcatattcactctggagtcttctacatctgaatctaaaggggaactgtattcttcctgcaaatttgggattctctaaataaagttccagggcaccagaggttccactgggttagacctttgatttattttaatgaagagcccttcttctttgttgatgtctgacagcacattcacagtgatccagtcattttkggggtaagatagaaggaatccaggtagaatacaatataaaaatgtctcaaactaggcaagagaagagtctagtcctgtggtaggtcatatttgtcaaaatatttgctaccctcttagctgttcatcctcactgagcctctctcttcaaaagattatccttcatatcccaacactgtgaggcttgagcacgtgctttgctttgaacaatgaaatacaagggaagcaatgtaatccatttctgagccaaaaaaattaagagccattgagtgattctgccaggcagtctcctgggtcatctccagaatctggagtgcagagccacagtgacccataatggacattgtgtaagcaagaaataagtatttgttattcataaatyaccagtgttttgggcttgttactgcaacattgacccattggtagaaacaactcagcttctggttaatagggtattattttaaaatccgctatgaacattcatgtatagtaagtctttgtggatggacacaggctttctatttctcatagataaattttgtaagcaaatggcaaactgtttacaaagtggttctatgatttcactgtcccactagcagtgtatgagactttcagttgctccactttcttactaacactttgtatgacagcatctttttaattttagtcattctaatacatgggtagtgatattgcagtatggttttaatttgtatttccctaatgactaatgatgtgaaacaccttttctagtgcttatttgccatcccagtttcttatttggtaaagcgtctgtttatgctgattttaggagaatagtttcttttcttattttcagattttgagagttgttggctcatatatataggcatatatatatatatawgtacacatatctatatgtacacatatatatgtgtacatatatattarcatatatgtgtgtgtgtttttcttaatacaaatcctttctttagatatatgatttttcaaatattttctccaagtctgtggcatgtcttttcattcttataacaccgtctttcaaacagcataartattttacttttataaaatctagttatcaatttgttcttttatggattttggtgtttgtgtcatatatatatataaatatttgcctaactcaaatattttatcctcttttttaataatttattttttagtttaggttttatgcttaggtcttataaaaaatattgagtcattccatctatgagcatggtatatctcttcatttacttagtttttaaatttctttcagtattgctttttagttttcagtgtataaatctttcatatttcttgcacttaggaaggcattcagctccttgatctatgagtttaaatttattctcaccaaatttgaacgtttttcagacattacgttctcaaatatttttctgcctctccccctctttcaaggactctaatgacttttacattagaccacttttctgggaacaagttccagactggaaaagtggtctaaygtaaacgttgtctaatgttccactgggaacaagtactgtgtgtagtgctgaccattgttaccccgaaatcttgaaatcttgtgggtagtctttcctcaaccttgggaagtcagtactcaagtgaatactcactgggatcctgtacagatcttcagagttattgctctctgaagctgttttccaatattcttttctgtgaactcaaattgccttaatcttcctggattctcagcaatatctcctcaactcagaatccctgggttctcctttcctgtaccaaggattgccaattctcacaagacaataagttgggttacgataggactcatctcatttgtttacctgcaccccaaggatcactgtcctttgttacctgacattctgtgtcttaaaaacggttgttttgtatgttttggctgttttttgtttgttcttttttttgtttttttgttttggttgttgtttcaggttgttgaggataattcttatccctgttaatccattttgacagtaagtagaaataacaaaattcacttataaattagtatatatattcttggttcaaggagtaatgggctaaagtaattttctccaaattgtgttatttgtcttggccacatcattaactagcaaacctactcagttttaataaatggttgctttgccaaccattttttttttttcaaccagcccctctctgttttaaaaagaaaattaagctacccactttctgtttacttacatagaattccactatttaggcttttgaaaatagcccttctgacttgtaaataacttatttgactctgtgtgtgagtcactcacttttatgtagcttgcattgttaactgcatcttccaaattgaattctggtaatgctgataaactgttcaaataggtcttttgtatgtttgcatcagagaaagttttatgggtatgtttggtataattaagtgctttttctctgtgtgtgtgtgtttgtgtgtgtgtgttttaaataacatggcataatgctaaataatccaagcaggaataatttgtttttattaagtcagattgccttctgtacatatgttggggagtaatttagtaggttatagtttcagtgtaataaaaaatggtggggttggggctggtggaaatgatgcctttcttctgtgcctaagtgataatgtaaacataagtcaggaactaagagtatctgtctgggaatatataataggatcaaacctaagcacaaatattcccagaggtagatttttcttatgctgatttagttatgaactggtaaatttgttttcatgactcaatttctacaaagcaaactttattatatatatatatgtgtgtgtgtgtgtgtgtgtgtgtgcatttttaatgtatgttcatttttttctgttgattttttaaattatgttcattacataagttcctaactgatagcattctcatcgtaaacaggtcaaactgttcagataaaataaaattcccttatatcaccttcttatctccagctgatttctttcccagaaggtaatcactgaaatgagcttggtgtgggcacctctcaatggggaccccaagatccccttctgtaacatacctgccacttttgaggtttgaatactcatgggctgctctccccttttcaaatgcctatccctgcaccatgattttctgttttagtcagtcctatatgtcatctatctttcactgatttctctcatttctggtcatcaagggcacccctttttattctatcatttggctgaaaaagtggcaaacatgaacactgacttaaaaaaaatactccaaaaataatttgagtttagagcaaaagcaaatctatcattggttaaaattttttgtgtaggttgtataacaaatttaattttcatgaatttctaaggttgtgattttacatcatttgattttagctaatagtttaattttatggtaggtttcattagaggagataaaaggctttggtttgcttcgtgtctctggaaaatttattaaatctccatagttttcagaacctagcaaatggtaagcttgtttccattctaactttatgagatgctttgtttcttgtaaagtgaattttgagagtgctgtgtgctttagcatcactggaagctgaacctcaggtagtagcccttaccttggtgtatgagagtctgcatgagtgctgtgtgctatagcatcactggaagctgaacctcaggtagtagcccttaccttggtgtacgagagtctgcatgagtgctgtgtgctatagcatcactggaagctgaacctcaggtagtagcccttaccttggtgtacgagagtctgcatgagtgctgtgtgctatagcatcactggaagccgaacctcaggtagtagcccttaccttggtgtatgagagtctgcatgagtgctgtgtgctatagcatcactggaagccgaacctcaggtagtagtccttaccttggtgtatgagagtctgcatgagtgctgtgtgctatagcatcactggaagctgaacctcaggtagtagcccttaccttggtgtatgagagtctgcatgagtgctgtgtgctttagcatcattggaaggtgaacctcaggtagcagtccttaccttggtgtatgagagtctgcatttccaccttcgaagattctgaaaaggaattaaaaagtagtgtcttgaatattggataaacttaagattacaagaaaacattctggaacatgactttcctcccgcttttgaagtttttcacttctttttctctagatctttttatagatgttcagaggcattttaggttgaattattatgtgtttaaggaattctaagataataattaccgggaaattaactcaaattacataatcatgtattcgagataagatacgttgtattgttgtggtaggcaaaaatgccatgacccagcagaatattttaaaattagcaatgtattttaaatacttgaacgctctctttcatttcagaagctagcctgcacttaagtcagaaaacaaaagctaactgccacagtgaatgaaatactttaggaagagaggagagaaaaacaggcttttctcattctgtaattctgagtgttctttaaatgtgtcagaatatttgctttgtccattttctgtgtcaatttctacttctttcttcttgctcagaaagtttcataatgctccctctaacataattaagtcatttatctttcctccctctcttgctgtttacttccttgcttccttccttctctaccacttctagtttacatagtaagggacttctttggcttttgggtagtaatttaagctccaaatttcagtttcatgttatgtaaaacacaaatgatacttaccgtatttcacatggttgttatgttgaggactgagccgcattatgtgagaaggctaaacatcatgtccttaatactgaatataygttcttttccccttttccccttttctttcttctttgctgtcccactctgagactcctttcttccaactctgagatgtagttttaaatcttttatgaaaaaaaaaaaccttatggagaaagggagaagaggtggattcatgagcaggaggagaatgataactgaacttttggcatcagcatttactatggctagtcaccattttaagcctgtcactaaatgaagttatattcatttagtctcattacaattctatgaaagtgctatcattatgtctattttatacttaaggaagcaaagtcttagattaaggcaagatcacatagccagtaagtaatggggtcaaaatgcagaccttaacattttggcttcagactctgtactttgagttcagccggtgtttgtggactttgccttaccttcctttcttttttttttttttttttgagacggagtctcgctgtgtcgcccaggatggggtgcagtggtgccatctcggctcactgaaagctccacctcccgggttcacgccattctcctgcctcagcttcctgagtagctgggactacaggcgcccgccaccatggccggctaattttttgtatttttagtagagacggggtttcaccctgttagccaagatagtctggatctcctgacctcgtgatccgcctgccttggccttccgaagtgctgggattacaggcgtgagccaccgcgcctggccgatttaccttccttacttaaccaatcatgccactagcttgcactggcctcaatacccaacgtttttcctaccttagggaccttttcctaccgtggggcctttgtattctctattccatcctttctgcaatttttccagatctttccagctcagcaaaattgccatctctccacattgccttcttcactctattcaaagtaacgaagggtacttcccccaaagcaactgatgttcccgtggcttgctttattaatcacaataggacatgatcttctacattaggttttcctccatgttttctggcagcctctgaaggatatgagccataacagagcatagacattgcttttttctttgtagcttaatctccagtgcctagtatcattcccagcatataatatgtttaatgtgaactgaatgagaaaactaaatgagaggcttaattttatacagcagtgaaggtatgtcccagacttataatttaaggagaacttactctctagaaatgtggagtagctggacgtggtggctcaagcctgtaatccaagcacttcgggaggccgaggtgggtggatgacttgagcccagaagttcgagaccagcctcggcaacatggcaagaccccatctctgcaaaaaaaaaaaaaaaaaaaatacaaaaattagccaggcaggggatgcgcctgtagtcccagctactcaggagactgaggtgggaggatcacttgagcctgggagatggaggctgcattaagcagtgatcgcgccactgcgccccagagagagagggagatgcagggtaattgatttgtacctttactttgaaatgtttaataattagtgattttctcagtcctctctttttctcatgggcccctttagtaaatgctgatggacaagattcacaggccatactttaaagccattgatggaggtagattttcttcccagggtgcttttttggcatggagttggctaagaatgtccttaaaggccatcatacataggtggaaagtagaaatcagttcaaagaaagactggcagagcagatcataagtcaatacatgaatcaagttggcctgtatcctaccaagtacaatcttttgtttagtggtgtatctactaccacactctcaaactcctaatgatactttaaaattaaccttcatgctcatttttataataatgttgaaggtcaggcaagagataatatcctcactttacaggtggaggaactgagtcaaagaagtacaggacttgtataaagaaaagctagtctatatgatgtctctaaatcctgggtctgaactactttaacgatattaaaagcttgcttgacataaaattttaagactgttacgattagagtgaatgtcagtgatatatgtgtctaaggaatttgataaatatacatgagatgctctaatgaattcaattgcttggaagtgaaggggaaaatgcacaaatttttacttaggctcatgcttttcatgtagaaacaaacattgaaatttggaagtgaaaaatctacctcttatcttgggtatatatgctgcctatatatatgcatatagtaagatgtttaagtttttaaaattaactgcattgttgaatatttgaaatacacatctgwtatttgttattgaactttaaaatgatatatgaggatttaggtaaatactgtctgtctaaaattaattttggaaagtaactcataagatgatattttcaatacagttttgccagcaattattaaatatgtttcgagaagaaaattgctattcaaattacccatctcatccttggcactttctaaaaaccagacaaatattttttagtttgtgaaggctgctcataacagttacaagctaattaattataaaagatttagccatgcatttgaccataaaatagattggttgtggctgctggattatagttttagatgattttatgatccatgtattgccttgacttactgatgatttaaatgattgtgtgtgggtgatttaaaaagcaataagattaataaaatatttattttgggtaaaggtacagaatatgttttgaataaataaagtatggaaaaggtatctaaattcctcatacatttttaaaatcagttaataaatagtaaacatgcaagaagctcattaactatagaaatttagcctattaattagggagtgttcatttttaaccactatgttcattttctagtctagtacataatatttttcacaagtcttcagaacctcatttttccttttatataataatgactctccaaatatctttttgtttcttggtcattatttatcttttaataagacaataaaaccaataataaaagtgtattcctatagccaatagccaagaatcaaaatatgcctttatgggtttttcttttcttttctttttgagatagagtcttgctctgttgccaggctggagtgcagtggcacgatctcagctcactgcaatcgctgcctcccaggataaagtgattcacctgccctagcctcccaagtaactggaattacaggcacgtgccaccacgcccgggtaattttttgtatttcagtaagatggagtttcaccatgttggccaagatggtctcgatctcctgacctcatgatctgcctgcctcggcctcccaaagttctgggattacaggcgtgagccaccacgcccgaccacctttatgttattttatttaaccttcaaataattatataaaattgatattatttctttactccaccaatgcttattgggcaactaacaactatgaacccttctgagaatttggggtacagtggcaaaataaagttgtcaaagggccctgtccccttggggatcacaatctcaaggcggcggggaacatccggaaataagatagttatagttggtgatgcattaccagagacrtgtgatgccataatagtgactaacccaaggacagtgagttagcttttgttgcataaattacccccaaaatttagtggcttaagacaactctttgtttaggctcatgtttcggctatttgaaatttggggtaggcccagctagctgtttctgctgatgtacgtcagactaagttcagttagaggaacttataggagagctgtgaacttccagatgagtcgaagacaggctgagggtatcctcaactgagatggcttatttctgtgtcacatggtggtggtagggatcccaagtacagcacgggtcattagtaaagcagacgttctggccttcatttcattcttttgagtgtatgctgtataaaaattgaccaaattatccacaaatcttcctgtaccacttgtcaaggttgaaaacccaagaaaaaataagattctttctmtcactggagtgatattactgagcttttcagagtctattctcatgccaagatgtatgtttgttaaattttgagccggatgtggttttcattcagaaagtatttgatgatgacttctcaagcaaggaataactataatagcttatgtgcttttgggatattttaggtaagggtgaaaataataattctgagaaacatacaagtattgcttttttcttcacattccctaattttcttcttttgtacattccacggaacaatgccttctcatatattcacctgacgtgttgaacatcaatataggattgaatgaagcaaaaccttatgtatgagttacactggagaaaatcaaataactatatatttttttctggcattagaaagtcagaaagatatacagaattagtgccaatgactgtatcagttgttcaatgaagagaagataaagaggtcatatagcagagaattgtatttgtatactcttgtctataaaatttagaacattttggttgttgtttaaatttatataagcttgttttattcttggtatatgtgccaatatctaccctttaaaatccatgccattcaggtagctcaaaggatatactcaactctgacatttgtaataagtgaataggctaacttgctgcaatttgataaaaacagaagcacacattaagttaaatatttgtggagatttgggtgtgattcacaaaacttttctctcattttatttttcattaattcattcaaccaatgcatactagaagtgtattatttgttaggcattgttttcggtgcagggaacactgataaataaacaggtaatgttactgctgcctttgagcttctagtctattaaacattagatggacaagtcagtctttctactttttagaaacaaccagcagataatatttgttaacaaaagtcatgatgtaaggaatttactaaaggaattcagaaaagattacatatttttctggttacataatataagaaatttactgaaagattatagaaaagattatgactaaactgtatccagtattttagtgatttgtttagcagattattaatttaggtaaaggtcattttgattggaaacatctatcaaatcagtccatgaggtaaaagaaagcaaaagaaagcagagtctaacaaaggagacagaacattttaataagagatacctttaaattatattttataccatacgaattggtctctttgtttgagaattcaaatattttacagccaataccacatacatttacattcggattctatatactcttctagtttctagttatatacagatatttcagataataagaaccaaatcttgcctcaaatgctaacatcgtggatgacaacatagagcctactgtaatccattrtgatatgagcaatgatggtaggtttgacagctgcatagggatcacaggagaaactgtacctgagctgtacctgtatcaaacaactacataattttttctgtcattgggaagtcagaaagatatacagaatcagtgccatacctgagagttcaactgtgtgcaaatagctcacaccgtctctaagtgttttatttctataataagaaaggtaagatttaccaaactctttcttctttatttttattatacatcctttattagtgattactagcccatgctcaaatgttagcttgcctcgaatcaaatcctagagtcactcttaattatttttatggtattaggtaagtgatttcacctccctaagacatagtttcttcttccataatatgagatttatgaggaaggtcctaacttgtagtagggtggtcaggaggcttaagtgaaatcatagctaaaacagttaacaattcctgaaaccacacaagtacactggatatcctgactattggtacttgtattcatacttgcatttataatacgcatttctcagataccccaacagttcatatccagacacccccaatggatacacctgagactgataccaggtcatcatttttcgttctcatgctgccagctacacaagaggcacgcactgtggatccacagacgaaacagacagaggctatgttccattcaagacctggaacagatgatcccttttccacgacaaggaccaacctctgccaaaacaaatcacttggcacaatttctaactctaaattaatgtcttcacttatttgcttaataactccctccatcctcgctgtcagatcaggctaggagagactccattggatgagcagtagactgctcttccccaggtgcctagcacagtgcctgatgcaccacacgctctcagtgtgtgcttgttgaagaaacaaagacacagtctgcccttttcattgaaagcagtgccccaaggcagcgggtccaatccaggtcacctccattgtgccttcccatgagggcttgctcaaccctctcccacctcctgtggccacctctctagagaagcttcttccagcttgccagacagtctagcttggaatgctgaacagcatccctggtccttctgaattttctagctggggaagcaaaatgtcagtctatgattaatcccacacaataggtggtaagaaacataccgatgccatatcttggcctgaggcacaactcttctatggagttgagtttcctgtaaattcgtggctgttgattgttagtgtgcagtcttaaggccttaacatgtatttataaacagtcttctttttaaaagtgcaggagcagtgtatatagtatgcggtatgccactattttttttaaaaaagatatatcgcatatatatatatatatatatatatatgactttttcttgcttgtattatccctatgttttattttattctccaaagttgatattgttttcttctaaggaatgcaattccaaaaaaacaaatattgaaaccaataaagacataaaatttatggttaatagcttcatttcatttgttaaatgtaattaacgtatctttttattactaagattatttaccattttaatgtatataatgactattgcattagattttatttttaaaatgctgttacgcaaacttaaaaccaaaattaccagtgttctatgggacagctctaaatacagtatagctattaaaaatatatattcttaaagtgtgctaggaagaaaaaacacttgacatgaactattctgacatttaaatcttctcttattcttgtcagcactgccacagcaaatgataaaggtggtattaatagccatataattttctgaaatttttgtaacattttttaactcacaaggcagctggacatgtttacagcttgaaatcttttattgcattatttgtaagatattaatatatggatatcatatatgaaggaaataaaatgcataattattttctggcacattgacttgcatttaattaaatagttttttcctacttaagttcatctatctatcgaacatttctatgttctagttattctttgaacaactgccttcttatagataagaaaattttcggtttgctgattggtaaattggtagttactcctccatttttggttcttgttagttttctaacactaggttcaaactcttgaagaaaatattttgttctgcatgcacctttgcagaattcttcgaaaatttgctggcagaatagttgtagaaaaccccaattacagataataattttgccattttcctgatgacccctagagaggaataaatttgcaaaattagtttaattttgttttactcctgtgtcttgtgctttctcatttcctttcctcaagttatagaaaatacataagcccagtacagattcagtcccctcttccactctactctggccagtcacctctcttcatcaatcctggggatgactaaagagaagtagggaatatatgatccttccactgaccagctatgtgcagggacatttggcaactgagttgacctttatctggacaatgatagaatgagaacccctcttagaggttaatgtgaagatcaaattagttaatagaagggaagacactttggaaagtgaaccacaaaggccaccagtaggagtagaatactaggaaatgatctttctaaatgccaatctggtcaagtgcttcctgcagcctgtctccaacaatacaaagtatccaagctccttagaatggcattcagatctctaaggatagctgatggcttcttggactgccctttgattcctaagagatactgcccatggtttttcctttcctcaaattcctggtaagacacctctgtcttccttctacacactattcaataccgtcttctctttgacatgaccttttccttccacctcttttcacttctctcttacytgcagggttaggagacacctgctatgtgagtgtatgtaaaccatacttcacagagcaagccttaaaaaaataccagctttcatcctttttccttcccttcctattaaaccctatacagtcatatgtacaatgtattgaataagtatggtgagaaaagaaagtgatatatttgtatttcttgtacagtcttctacaaatctctgaaattagacatgactgtgatttttttttaaaataagtggatgttaggatctgggctaatagggttgggggtctgagggagacttttcattgtatacattgatttgatcttttgaatttttaatcatgggaatatatttctcatgtcaatattaagtaacataaataaaaatttagtataaaattttaagtctagaaaagtcgaatgtaaaagtttcattcactcgcctaatatctaaattatgtgacttacaagcatatggtggagaaaagaatatggctcccattatcaatatttcctcccttccccttgtcctatttctcctccattactcagtagaacactctgacatccttagggttgaagcagaggtggagaggagagttaaggagcataaagattttacttgaaaggcattggtttaatcagtttttggcagctgagcttgacagaaaaacaatgtatttctcagtctggctatggtcccattgcagatcaagagggggctgtgctctgtgtcacctccactctaaggcccagtgacggagcctgcaccgtttctaatgtttccggttactgtggcagaaggaaaaagcrtatgacgaatcacacactggctcttcaaatgtctgcccagaagtgacacagtccccttgagctataagttcctggtcaaaacaaacaacatggccacacctaacttcgaagtgggcagagacatgcagtgacccatgtatctaaaaatactaaaaataatggtaaatagcactgataaatattttctgaaaaatataaatcaagagtggaattccttttaatttttcatttagttatagtttgggctgtgagatggttgtgttacacatgaaattcacataattagaaaactataggtgagtatgctttaaccccctgccccaacttcctcctctttctttgttcttgttttcttcccctcctctttcgcttatattttcctctgacctcaccctaaaaacacagtttaacctacaaggtaccagaataccaaaccaaaccaaccaaacaaaaacaacaacaaaaattgggtgccctctggaatgtttggctccaaaaaaaatattgaaatctatagcaccactgaaatgtctaatattaccaatgtggcattaataaatggacagtcgtgctcttttgtagcttttctctctggaaggaagatattggatagtttttgttttttagagacaaggtcttactttgtcacacaggctgaagttcagtggaacgacattggcttattgcagcttgacctcctgggctcaagtaatccttctacctcaacctctagagtagctaggactacatcaccaagccgggctacttattttgaaagttttggtagagatgggctcttgctatgttgtccaggatggtctcaaactcctggcctcagcaatcctcctggaggccttgatatccaaaagtgctgggattacatgtgtgagcccctgtacctagccagatagttcttactgtgacaaggggacaagaagccttttctcagggaggaccaatggcaattctttttaccccacactctcaacaatgattcttccaggaccatttccatttcttcagtctattgcctcctttctcattgagtggcgagcactcttgagacccagcagtttgctctatctcaacccactgtgacaaataggtaaacataggctgggatgtaaggaatggataatggatactggttttagttaccccaccagagacattttaagttaatgcaattgatgagtaaagcaacatgtatggttctctctcaccaggagaggaaaggaatagaaagaatagagaaatatagcctactagtcagtttggtgtttgttccaaaataaaccctaaaatctttgcagaggcaaattgcttattactgtaccgtcaagtgaaatgctccatgaaatatgttctgttttgctagacgtgtttggacaatttcctgaaactgttaaactgctcaatggtattaactcttctccaacaggccattagaaattttagcatttaaaagagagaagagggaaaatacagttggctcagttgagaagcaatctcttggagctggtaattatgtcacatctgtttggagaaacaagttggcctttaagagagtgaatggggtaacaatttaattaaagatgggttagattgcatggaaattacttgctattattattggaggaatctatcaaaatggaccactgggaaagcactgttttcactgtttcttgaggaaattgttcttggcataacagtagaatttaacttccttttctgaatgtaagtttcagccctgctgtatggaggagtgagatcattgcatagggtctgtgcacttccccagtttctgttttcttcctttcttactcagatgctgttcttttataactttgtttaacataacacttgagccaacatggtatgatctggtttgtggtcgctttctttggtttgcaagaattttggaaggtattatttgcgtttaaaacaaactatttgcctattggccatctggccagtaattccagcatagaattctaagctctgtgaacttgaacctaactcaattgaacttgctaatctaataataagtctattgccccacctcaatattaccagtgggatggtagaaggttttataagcacctcagtttttttctcagtgtgaaatcatctatatcaatctttttggtgctgtaccctatactgaacatggaaattccaccatttaacrtgctaaacagctagcaaagaactattccatagatattgaacttgaaaactatacattttaataagccaaagtacatcaggaaaaatcagagctttaatgaagctacaattgtagatatgttaaaaaagacaccaagttcattgtaaatgaatttccatttgttggttgattatttatagggtgaattgccaaaaaagatagagttaaataatcagtccatctaactgaccttaactaatgtaaaattactttctgtaagcccaggttagttataaaaagwttgaccctttaccgcagtttatctgatataatctcagattaattaatcttgattagtttgttatttgcctcagatttttaattttaaaaggatattattggaattgtactttttaaaatagttttaataaaaatattacataggtctattcatataataaaactatagtagaaccttgaacaaaatagaggtgaggagagctgactctttacatagtcaaaaatccacttataactcttgactccctaaaaacttaatgactaagagcctactgttgaccaggagccttaccaataacatagtcaattaacacatattttgtatgctatgtattgtatactgtattcttacaataaagtaaggtagagaaaataaaatgctactaagaaaattgcaaggaagagaaaatatatttactattagttaagtggaagtggatcatcataaaggtcttcatcctgtttgtcatcacgttgagtaggccatggaggagggggcatgggaggacttggtcttactgtctcagggatggcaaaggcagaagaaaatcagaatataagttaatcttgcaactcaaactcatgattttcaaggatcaactgtaatttcttagtaataaaccctttagtctcacaagtgtcatgatttgaacaacaaattgtatggtcacgttggtcaccctaggtagaaatttgctgatttcagcaaattggaagttactgcatgattgtcaggatctgagaaagcaactgagaagtaatagttacaataagttacaaaccttttaggacggtgaacattttaaggcgtatgttttctccatgtgtcacaaccaacagtaaacaaagatcaaaatcatggtagaaaagcaggatttaatggacatcagagaaattgcagatctggaatacaaggcaataaaaatttacaacaaggaagtggtaagccagagagagctgcttcatggtggtaggcccagggggattggagagagtggtgccagaaagttggatagaaaagttaatgcaacaattataaagaagataadaacgtagtatttgaaaataaatattttaacaagataaatataatacaaaaaatggaataagaaaaatacattattatcgaatattctgtattgagttttggaagtttatgtgtctccttttctaatgccatgattttgcaatgcattattgttagtaatttttaggtctgcctatccaaattaggcttttgcagcatctaacaccctccaccctagctcacttggtgggtgagcctccaatgactacacccaaggaggatttaacacagggattttatgacttgcaacaagtcaggaggacatggggttggggtagttcagcagtgcctgtctgaacaaaggtgaaaattgggcttttattgggctgatcaagggggagtaaaggcagccaggagcagtcgcctgtcatgcttctacctatattgcatgtatagaaaagggaaaataaactccttcctgggcagggttttagtatgctaaggaggggagttattcaacttcaatccaactcaagcatcagcattgctgcgtccatcccagttttgttttgctggggctgaacttcttcctataactttttgaaacaacaagaactcaaggtgtgacagttacaagtgggccctttttcacagtgtgtacctaaacacgtgaggaccctggattacagaatgacagactcgaagtgactcaagttccggttgttcatctttagatggtaaagatggctgtacgtactatccttgcttatttccaatctattgtttaaactcttgtatatgtaataccgcagaggctagagatacaacctttgaccaaatgagtgaattcaagtaatccattactaatgtgatctggaaacaaacatggtgttgaatgtgcatatgtcagttctatgttgggagttcactataagtaggagttctctaaaagcacttccacgtagaatgcaatgattatttaaaaataagtaataaaaatgtgcaaatttaaaacatgtatatgctttgaattatatatatatatatgaattatattttactatgtatacaatgaaaactgaacagtaacctcagctattgtataaaagtgaaaccaacaaaagattttttggggaggaagattattttactactgacataaagaattgccaggaaacaatgacagcaaacacaaccaacttttagttgccatttaagaaaaattctttcagataatgcattcctttattacttgaacggagggcagaccactccgtccattctacccttggcacacatcacttcctaaactgtcttattgcttttaattgtatattttttcccttaatttcaattaaaatctataattcattagcygtcaaaacctgacctgtttgaagtagtagcaattcaacattaaacctcgactagtgttgaataatattttggggctttgtgttgtatgctacagagtgaccccccmcaagttccttgcccatgtgtggctagacaatggaaatagttccgtgcttcaacatgttccccaaacacattccacaggagagcgcatccgagcatcaattcttgtaagacaactgggaaatgaagtcataatttgagctgaagcaaggaagattattaaatatattttccatgtgctttgaaaatatatgcaaagtaaagcaatcagtgcttgccactttgtttgtattctaaaagaaagctagttaaggtttttcatcaaactgtattcttctttaggcttataaagtaccatgaagaggaggtaaagagagagtggatatttcagtggctaaacccaaagttttttagcatttagactatggcaccctctagaaaagcaatttaaaatgtgaaaaaagagaggwcagttaaaaaatagattagatagataggtagatagatggataacaggtaggtagacagatgattgataaagagataggcagatcatagatagatagatagatagatagatagatagatagatagatagatagatagatagcatgaagatggttgaggtgactacaccctatgcttccttctgaagtttcgggaataattgttcattttccaagtgactgctcaatacaacattgctctgttaggtaatttaatgactggtgtaagtacaaaaaacattgccatctgctttgtttcttttggccttaattataatgttatcttcttttcagaggctatattgtgaaacacttattattcaccattatttctggcagtgattataatttatgaccaacagtgcagcactgaataatgtcttgattgattgactgattaatgtagattttgtaggtgataagggacaaaaagcctgagaagattttctggaaatgtaaaagtaattttattttctactatgtttgatgcccaaagatcactgtactgataattttagtgaataaagtgtcaactataacaaggagcttgtttattctatcaaccatgtgatttcaaaactggagcttgctttcacttttgaaattttccataagctaaatctaatcctctatatttacaacgaaattaattttctgagttatttattttaggataactctgatctttttcttttctttttctttttttttttttttttttaagatggagtttcactcttgttgcccagactggagtgcagtggcgcgatcttggctcactgcaacctctgcctcccaggttcaagcgattctcctgcctcagcctcccaagaagcagggattacaggcatgggccaccacgcccagctaattttttttttgtatttttagtagaggcgaggtttcgccatgttggccaggctggtttccaacccctgaccacaggtgatccgcccgcctcggcctcccaaagtgctgggattacaggcgtgagccaccgtgcccggcaaccctgatctttttcaaactgcaatttaaaatttactgatcacacagaactgaattgatttttaattgtcattctgaagaagtaattaaactttaattactacttctgaaagagagggtttttactaggactttttctgacaggacaataatttcattttttgcaatttttatttataattggcaaataatgattacatatgtttatggggtacaatgtgatgctatgtgtatatattgttgaatgattagatcaaactagttatcatatccatcacctcacacactaatcattattttgtagtgagaacacttaaaatctgcactgttagcaattttgaaatatatattattattaattatggtcaccatgctgtgcaatagatctcaaaaattattcctcctgtctaactgaaactttgtaccttttgattaacatctctgtctcagcctctggtaaccaccattctactctctacttctgtaagtttgatttttttagattccacatataagtgaaatcataacagtatttacttatctttctctacctggctcatttcacttagcgtaacttcctccaagttcattcatgttgttgcaaatgacagaatttgcttcttttttttaaggctgaacagtgtatatatacatacaaaacatttctttatccattcattaactgatgaatggagataaatatatataaaacatttcttcatccattgattaactgatggacacttaggttggttccatatcttgcctgttgtgaataatacttcaagaacataggagagtggatatttctttaacagttgatttcaaatcctttggatatgaacatggaaatgagattggtgaattctagggtaattctattttcagttctttgaggcatatctatactgttttccctaattggctatactagtttatattcctgccaactgtgtacaggggttccctttactccacattctcgccaacgttcgttatcttttgtctttttgatgatagccattctaacaggtatgagctgatatctcactgttgttttaattttaatttctctgacaattagtgatattgagcattttttcataaactggttgaccatttgtatatctactttcaagaaatgtctatttaaattctttacccatttttttaaaaaattcgattctttgttttctgctataagattgtttgagttccttatatattttggatattcactccttatcagatgtgtggtttgcaaatattttctctcgctctgggttgtctcttcagcacagaaatggacagtcrcacgttaccacctgtatgatcattattttaaacacaagcaggaaaagcttttgggttccaaagtttcagtcattatgattgaaaaactgccaaactggtagtgaaacatttattggattggggattaagctattcattcttttcgcattaaaacaatgatgtagttttattcgtaaatctataaagttaagtgcacagtcatcacttttagtacgttctgaktcattgaaatcctgtaaaattttatggaaaaatctgtgtaaacaagctttaaataaggcaatattccaataccaaaactcgggatttaggcataggtgctatatttacaattcttaagtaattttcatgtatttcacatatttttaaaactcatgttacaaaatagcctaattctctttactttctgtgtatgagggaggaattaacattttgtaatataaacctcccaaaagttattcagaatatttctaaaataaactgttttagattcttggagaaattctgtgatgtcaaaatctctttcctttttttaaacaataaaaaacattgtggctttgtttttttaattgataaataataattatatacatttatggggtgcatttatggggtgcaatgtatacatatatcaaattttaccccatattgtacattgggtacaatctgtaccctcataatacaaattgtaccccaatgtacaatatggggagcaatttgatacatgtatacattgtggaaggagtaaatccgactaatatatccattacctcacgtacttatcatttctttgtggtacaaacatttcaaattcattctcttagcaattttgaactatacgttattattaactctagtcacctaatgtttaatggatcaccaggaattattcctcttgtctaatggaaactttgtaccctttgaccatcatctccccttttacctcccaccctctcccaacgtctggtagctaccattctacttcctacctctacgagttcgaatttttagattccacatataaatgagatcatgtaatatttgtccttctgtgcctggcttattttacttagtataatggcttcatttttttaaaatgtttaaaccaaaggtttcaatacataaatctagacacaaacaagtactgtgtgattccattttttataaagttcaagaacaagcaaagttgatcaaagacaagagacaagaaactttcagtagtgttggacatattctttaatctttgtggaggccacacagggatatagatgtgaagaaattcactaagctatgcagtcagtattagagcccctggatgtacatgtgttatgcagtaatgaagggcacacacacactcattcattcacacacagcaaaagcaatctatgaagtgacaacacgacacagtgaacactgttttcatggtaaagttgcaataagacaaattacattatttttacagtataaacaattatattcaattaaatgcacgaagtgtgctagaatatattggataattcggaacgaatacctatactgcaggtgctgaagccaagagagaaacatccccattgaagtattgtaagaattctgtcccccctgccagttgctatgagatatcactgaaatatggtagtgttttctaaaatctactgcatgaggataggacaaacatgctttcagtgaaatgataaaacgctaccagaactaaaagaaacaaaagtggtcaggtgcagtggctcatgcttgtaatcccagcactttgggaggccaaggcagaaagatcgcttgagctcaggagttcaagaccagcctgggcaaaatagtaagacctctgtctctattaaaaaaaaagttaaaaataacaacaaaaaattagctgggcatggtggtgtgtgcctgtagtcccagctaccaggaggctaaggtgggaagatggcttgccccagcaggttgaggctgcagtgagccaagatcatgccaccccattccagcctggacaacacagtccctgtctcaaaaaaatcaaaaaagaagaagaagaaaaagtattttaaacctgtcattaagaagaaaaaagatgtaattacacacttarggaggccagagtgggcagattgcttgatcccaggagtttgaaaccagcctgggtgggccgggcatggtggctcacgcctgtaattctagcacttttggtaggccgaggtgggcagattgcctgagctcaggagttcgagaccaacctgggcaacacggcgaaaccctgtctctactaaaaatagaaaaattagccaggcgtggtggcgtgagcctgtagtcccagctactcgggaggctgaggcagtggaatcacttgaacctgggaggcggaggttgtagtgagctgagattaggccactacactccagcctgcgctgggcaacagagcgagactccatctccaaaaaaaaaaaaaaaaaggaaaaaagaaaccagcctgggcaacatggcaaaactccatctctacagaaaaatacaaaaaaaaattagcaaggcatggtggtgtgcacctgtagtcccagctactcagaggctgagaagaaaacagattatctaccgtaataaagcaagaaacccaatccctaaacaatactgtgccccatagagtaaagccgtttcatttctcttttagtactttttctaccctaacaaagaaaattgtggctaaaagttaaaacaaaaacagtatctttttgctagtttcatgatatatcttgtatgtatgtatgggtgaatattcttatattattatttttggttcatgtaaagtaatttttccaagtgaatatctaagaccaatgcttctgaaactttaatagtcatacaaatcacctgaggattttgttaaaactaatattcatctccaggagttcaggggttaggctaagattctgagtttccaataagtacccaggtgatagtaatgctactggcctacacactactctttgagtaataaggtcttagattaaagtggacttgggcccactaacattgattagcttatgacaggaagacaaaaaacaaaaacaaaggaacaaacaaaaacatagaaggtaaaatgttaaaatcaaggcacaaagtattgctgtatggaaagtgtctgaattttcaatatattcagccctggaggaagagcttcccactaccacttatttactgtttctgttctaaactggctataatagcccttcaattatagagctgtttcagtaatagcatctgcttcattataacagcagttttattaaactaatagttgttagcatgaagacaccattacagtaaattacatttataattatggctctaaatatactcaggttgcatacaattattaaaaatttccaccctaatcatttacctttcctgaagctttcctcctatcacatagatgctgtgagcgtgtgttagtgtatgcaggcttttctatgaggctgctttcctatatcccatacaattattcaaactgatgcctggtgtatctagaaatttgtattcctagctcagagagcagctaattagaacctccttcccaatctctacttcccacaatctgggtcatttccttgtttagtgccttgatcagaaataatttattgtctggttgtgcatggctttgagggaggcacaatataaagaaaagttcatataagaaatgtgcacatttaacatcaatgcataacaaacaccccaaagcatagtggcttcagctaaaaactgtctatcattgcatttgggacagctgggagtgcttatctagatttggctcagctgggcaggttagttaaggtggctctgttacacagtgtctttattagtctgttctcatgctgctaataaagacatacccaagaatgggtaatttataaaggaaaaaggtttaatggattctacatggctggggaggcctcacactcatggcagaaggcaaaggaagagcaaagtcacatcttacatggcaacaggcaagggggcgtaaggaggggaacttcccattgtaaaaccatcagctcttgtgagacttgttcactaacatgaaaatggcacaggaaagaccctcccccctgattcagttacttcccatcaagcccctcccacaacacgtgggaattatgggagctacaattctagaaagacttggtctgggacacagccaaaccgtatcatcatctcacatgtcccctctgagcccaggtcctcctggcagtgacccaagcacatgagaacacattcaaccatgacagcacatttcaagcctccgcttcattgcttctgataatattactctggccaaagccagttacatagttaagctcaacttgtgttaattttgcccacaatgaggccaaagcaagtcacatggccaagatcaacataaatggagcagagaagtgtcatctcctatggaagtgaacagaaatgagtgatcatttcagaacaacaacctactctatcagagatagtttcccttttatacatgtaagtacaataatgttgaaagtctctgagtttattttcataacatgctaaatagccacagtcttatttagccaaattacaaacattggaattgcatggtttcttttagaatctaaggtttttatagaaaatataacatcatatatatatatatatatatatatatatatatawatatgtattccattttgatgctatatactactagtcagtcacctgtaagagtttttgactaaagttttcggcaagatagatatagttgagtcatggtcaaggtgaaaagggtattcactcaacaagaaaaccatccatcaaagatttccyatgtgccctttgttacggctgtgcagctaagtacaacacagttccaggctttacagttcttagagtgtttacagacaaataagtaagatgctcaatatgaggtggtaggtcctgtgtactgggtgtatgccagatttcacaaggagtgagtttaaccactggacagcagagtgggtgctagagctgactcttgaaggatcagaaaaaattcaccacaatagaggggttgggygttccacatatagagatgacattgggctgcattcggggagcccacaagtaatggcatagaagtgtttgtgtctgatatccccttccagacatcccacaacctaaagagctagacactgagggggcctgcatggtgagcctagagccaactcaagatgcaggaacaaaacagaatttattggaacatagaaagatatgaaacaacagtagttgctctgagaggcgtcgtctacatttgaaattgctgggtgttgtgctgaacccttattaaccccaataaggaaggcacaagattcaagaagccaaagaagagacccagaggcaacaaatgagacatggggttttattaaggctcacatacaggggagagaggccagtggtggtgagctaaatatgataacctcatagcccagtggcagtgggctgggcgggaaaacagcaactgctagcaatcagcatgcactttatatagcatttccacttaacacmctcccccagtgacctccacctggcaaccttcatattgtaacctaaaactctgggcctcaatcccctgtacggcctgtgttccacaggactgaataggatgggaccggggctcagatgttcctcatggacaaggaatgaatctctggattggctactcctggattccctagttcagaacatacattcaggtgctatacaaggtcattctaaggttatgcttaagttattgctgtcaggtatgtttatcctacaccaggttgataagacaatgatgtcatcagtcagagccacataarcttgacagccattaaaagtttatcttcctggctaggcgtggtggctcacacctgtaatcctagcactttgggaggctgaggcaggtggatcatgagatcaagagatcaagaccatcctggccaacatggtgaaaccccgtctctactaaaaatacaaaatttagctgggcttggtggcatgcgcctgtagtcccagctactcaggaggctgaggcaggagaatcgcttgaacccaggaggcggaggttgcagtgagccaagatcgcaccactgcacaccagcctggtgacagagggagactctgtctcaaaaaaaaaaaaattatcctattttatttgtttttaagataggttctcgctctgtcacccaggctggagtgcagtagcaatatcataacttacttgtcttcattgactaatgaatcccaacatgctgagtttgattgtcaccttttctctcccagcttcagcaatactatatgtttagaattatagaattttttcacagctcacaaaggagcctctcaggggtgggatgtaggataggactgaagaaagaaaaccctactggggagaaaatatcaagtggagactgagtattcatttctactctttgctaaagagtagttaatgtactcacagtttatgttcagaacattgtcagtttcagagaaagatttcattagttcattagtttatctataaatttatccatcctgtacttattgggcatctactacagcagcagtccccagcatttttggcaccagagatgggtttcatgaaagacaatttttccatggaccagggcagcaggttgggagggctgatggtttcaggatgattcgagtgcattaaatttattgtgcactttattttattattacattatagtctataatgaaatacttatacaactcaccataatgtagaatcaatgggaaccctaagcttgttttcctgcaactagatggtcccatctgggggtgatggaagacagtgaaagatcatcaggtgttagattctcataaggagcatgcaaagtagatcccttgcatgcaaagttcccagtggggttcttgctcctataagaatctaatgctggggccaatctgacaggaggcagagctcaggtggtgatgggagcaagggggagcggctgtaaatacagatgaagcttcacttgcttgcctgctgctcacctcctgctgtgcagcctggttcttagcaggccacagactgatagcggtccatggctcaggggttggggactcctgtactacagcatgccagacaaaatgcccactgaggttggaaatgaagcgaaaacagacacactccttgctttctcggtagcttacagactggagagtaagaagggcattcctacagtggtgaatactatagaggagtagtagacaacgtgtgtgagtgcatttagtatggagctgggagacatttatgggaggaaagataaggaaaaacttctccgatgaagggactttaatctgacatcagaaagaagagtagtagcaaactaggtaaacaaggatggggatgaggaagtaggaggtacaaaatacaaaacgaaacaaagcacagaatatctcccagaacaaagccctcttcatcctgcctgctctctctcccccatagtgattgacagtttgaggaagggggttattcttagggatcagaatatttttgtataactgcttccattttgtataattgcctagtttcccagggtaaataaaggcaggagacacattcagggccaaatacagaactctatattcttacttgagaaacacaccaaaatgatatgcaaatattactatgtagtatttatgtcttccttctctccccaaaattcccatgtgaaaataaattttctatgacctatatactgtcattttgcttaatcattttaaggcaatatgaggacatcatgtattaaatcctggagaattcttagttttcagatttcttgttggatatttcctgatcaataatgtgcaaagggagatgatatttgggccagaaccatcagtttaagcgtctctatattataagaaattctgactcaggctacttaatgtagtttcttttttaaagcatgaatgctttaaagttcatgttttagtcaagaaggaattgcattttctcaaacctggcaggcccagaaaaaagctacttagaaaatcacacttaggtgacagaatgataagaaaagtccctttaggggccattagcactttgcctgaagaaaaactgttagtggttcttcctagctttttaacttacagaagcagcactgttggaaagctcttggtaaaaacaacagaagtaaagcagtttattttggaatctcatgttaggaattccagaatatcccattggttaattttaagttagagtccttattattgcaatttccatcataatagacatattatatttgtaataggtggtgggacaaagactagagtttggatatatcatagaaatctatataccaaactttcattaactattttgccagttaaccatggccaactgatttttttttctttgttcacctcctccataaagttagatctaagattcaagtaacaacctatgcacctttttctaacagtactttattaaagtacaatttacctttagtaaaatgcacaaatgttaaatgtacatcacacagaactttaacaaatatacaaactcatctaacatccagatcaagatatggaatgtcaccccaaaaattccatgttgccctattttagctaaccactccacgactaaaggcaactgctatccaatttctgtgggtataaataacttttatttcttttcaacttcatatcagtaggaccatacagtatgtagtctttggggtctggcttcttttactcaaaatctgtgcattttgaggatttctgaaatattaaggatagcccagggcttctgcaaatgtcagatggacatacaactcaatttatataaacactgtgggaagtaagctaatatttgttaacctgaaagtttctgattatcatgaaatgtccctaggcagggactatgttgttagctacacaatatctaagaaaactatcctaagacaaattaaatatagaaataaaatcacaggcaatagcagatatatctaagcttcttatagataagctcatcccaagtactcttgaggtgcaaaaagaaaaggctaattataaattattcttatccatttattgaggctgttcccttaagggctaattctaggtaatgcttcattaaccttgtatcagttacttgttcttgaatttcaaaaattcattttttccataatttttattaattcagtgaggccctccttctcatttgtacaaattagtaagatgtcaacctacatgtggagttctggagattcatcttaagacttataaaagggaaaaaaaaaaagaataagtaaaggtattgagggcctactacgtgctgatggccaaggtactttcacctacattaacaaatcaaatcatttcaataggccctgtagggtggctcatgtctgtaatcccagcactttgagatgctcaggtgggtggatggcttgagcccaggagttcaagaacagcctgggcaacatggagaaaaccagtctctataaaaagtagcaaaaattagctgggtgtggtggtgtgtgccttcctcccagttacttgggaggctgaggtgggagaatcacttaagctcaggaagttgaggctgcagtgaattgtgatggagtgagactgcctaaaaaaaatcctttcaataaattatgattcacagaatccaatacatccaatgatccaatggaatgctagttcaaatacattggtacttaagcatggactgcattctaaaagttcacctctaactcagctattttatcatagaaacacagatatataactaaacaccactttttcaagaaaaggtaaaattgtgaattgcatttcaaccacacagaaaccaaacaaagttcgggagtgcaaactatattctccttctttcttaacatmagatttttccattgtagcaaatgtgattaggcagggccttgactaaatcactagaacagtgagtgctgacactaaagctggaagctaaaaatgcctccagaagattgtccttgagagccaagagtcaccttctcctgtgataggcagtctgctactatccccatgcaccctaaagctggtatgcaaggactctctaatcctgtggtatgaaaattcagtcgcctcacctcaaggctagacagatacagagatgcaatgtaggatctggagctccccttggattgaacacacatcttgcttcccttcttcccttacaagcgtttcctgagagcccttcttcaataaatcattttctaagaatctctgttacctccccatctcaggctctgcttctaggggaaaccaatttaatacacccattttatctatgacatcatcctcattctggcctgtggttacgctaacaatttatcttctcctggagtccactaagaaggacaaaagccattcagaatagaccaataaaattcaaagcctagtcttcttccagcaccctatgatctacactttctccccaactgacacacgtggtcaagcagaatgcaacgcccttttcttggaacccagaaaagacaaattaaggaaaatgagtttggaacaatgaaacagtctcctgtgcaaataaagcagacactaccattttaagtatgaataattggaaaacaaggcattgaatagtcttaattacaataagtatacgaagcttgcattagtcttaattacaataaatataagaagttttaaaactaagtgttctaagccacaaaaaagtaaaatatgtccttgtttgtacattatttcaaacataggaggataattaagataagaatgtgaaataaaggcttatctttatttaagactaatttgttgaggcaagaaagttggtggggtgggatgaggcccctgcttctcaaataaggaaatcttaaattaaatcaatgccagtcaattgctgggacattttagtcaaactgggtgtaatgtgctggttaagctatcaaataaaatgttggccatagagcatgattcgtggtcctcaatggaatcggcagttgaggatgagattgctgtagatgctcatcatcctctacagaagtgatgaactgagagcttgtatctttgaaagggtcatataatccttggacaaagggggtagtaggcctgttatccctgctgcctttattcatccacccatctaaacaaccctcccctcagtgtttactgaatgccaactctgtgccaggaactagtctagacactagggatatagtagaaagagaatgtatacggctcaggaagttgtgatttagtgaggattcaaaagaaagattagcaagtctttggagcaaaaattagagtcaagaggaagttttgcaaatgatcctgatcataacaaatatgtgtgtgtgtgtgtgtgtgtgtgtgtgtgtatggagagagacgacaacaaatatatatatatttggctctctctctctctctctctctctctctctctmtmtatatatatatatatatatatggagagagacaacacctccaaagaaaagagaaaaaaaggaaagcacatgaccgtgaacgaatctagcagtatgagaatttgattgaaagtctcagggaagacctgagatatagtgaatagttggccacagatatggtgttagtagcagacatcagttgggttactgaacaacacttttaaacccactaaaaggggacaaatggaatttactcagagcttagtatattaaggttactcagatcattgcgcattgggagggaagaagatgcttgtgcattgtcagagttgaaaactagagactgtgtgcctgagaaatgcccagtgagacacagaggaagcaactccacggatgcagaaaccatgccacccagaggcctgcatggggagcgtgtgttgtatggaatcaactgggcggagttaatacgtgaaatttcacattaactaattaattaattggttaatcaactgattgattttaaaataccaaaaagcttccaacaatcatttcaaaatttgatatatatgttgaaaaatacagcaacaaaacaaagtataaaatacaaacaaaatcttaatttatttcaatgctatgtattaaaagccttcatatccaaaaaatagcaagattgttattaaatacatttacatactctagtcaaaactataatattctataaactaacattagagaagatgcttgaagaaaaataaacatttaaaatacacccatatggctttaggaattcagaaaattcaataaatcatgaaaaaaatgaacctcctgggttttgttttgttttttcctttgagggaggggaggggaacactatgagttttctctttctttttattttttcagtttctttctacaggatacctaagcctaggtcaattgtttttaataacttcgttttgctaatcggtcatggcacttgtttctctccttaaatgcaaattaggatgagaataaccttgtaaacrtgtctttgtcttctcaaggtcatgtttggccaacagtatcagtcagggtttctttttccttttttaagcaggcagccatgttctgattaaatatttataagtctagttgagtaaagttaaacggagcagatgaggcaattaagaagtaaaaccaagtgtcaaactgcagggtctccttaaatgatgcaagaccttgggatcctgacacttttcattgacactctttgtaagccagagttgttttgtttgtatgaaaagtggcagtgctgtctaagatttactgatccctgtttagaagtcatctaaaaataatatctgagtaactcaaaycctctccattttccccagaaatagttttactgtaggggtgagatgtaggagagggagggagcgtctgtgtactgccacagctgggaacattactgcacctacttcctagtgccttgcaggcatctttgggacttgctaagaacctttggagaagtgtaagcagaggttaattgttcaaccacctgcttttagaaagatataaattttatatatgtaaaataatttttaaaatcatgattaatagcctatatcccttcagttacttttacaaagccttccaatgtccagaaggaaactgctgacagtgacatttatggagaagggggaaaaaaaagtaatttttcaactcaaattgaagggcagtggatagagaggggaacataaattcattataaaatatcttcttaacccatatatatagccaaaaaaaaaaggagctaattgcagaccaattatggaaaaaacctgaccttgggagaaaggcatgctatttatttataatcagtattaaggatttagaagcattttcaaggtttgcatttatttggggttgaaatgtcataaatatctgtcagcatggcaatattctagttaatttgattttggtgttgataaggccaagttcaaataatcaatctcaattaggctgattaatttcacactaaaaaactgtactgaggggacacaatttacttaaaccctaattgaccgtgttgtgcctttgggcacagagagatcttaaaaaggagaaatcagggaaatcactatacacaaacactggaaaaactgacttaattttcttgtttttaccaacaattggttgtgttgttgtcaaatggataaagtagaactttaaagaaaaatcaactttgtgcagtctcttaaaaatacctgaatgaaatgaaataaaattcataaaattctatccaacaattgaaaaaaacagctttttttttttttgcttggaggctagaggatgatgatgagtagctctattctgttagctctttctgtagctctattctgttaaattgtcatgacatttgttcagctcctaaaaaatgaaaattgggattgaaaatcaatttttagtattttttttccaaagcatcagcatacttgaagcctgtgttactatgaatggttacccttaaaatgaaagaatagttgttacttttggagcgggatagtaaccaggatagggcatatgagtggcttatgaaacacactaaatatcctatatcatgatcagcggtggagatacctgagtatgttaattttgtgaaacctcattgatttacacgctaatgatttatgcacatacaattttacttccttgatactctaattttttaagttgtaaaaaggaatttatatttaaaaaaaggttggactcctatgttcatttctataaatgaagctgtcacacagacctgaaattttatttgagcactggctctatcattttcttttgatgatgatgtttctttgatgtatgcatttttatcaaatatatctaatttgatgtttctttgatgcatttttacctagcttttaactgggacctggtttctgtagtgtaaaaatctatttgcaatttctagtgtattatactatttaatgccttcttctcatttggaactagaaaatcacttgggttaaatggtgtccagctgccttcagagataagccctggctttgacttattaatacatttccatcggcctttcctggtaataaacattcttactgtcctccaatatggtaaaatatttagcgtaagagtagtcttggctcacagtatagttgttgaatccatgctgtttttcagtcattggctgctctgttcattacattctatacaattttgtatactgatgtcttggggttttaattgaattttaatgaaaaaatggcccggattagcagtaatatggccagctgtgggctgcaatgttaatatgcacctactgtttcaatttgctggtaaagctgataatgactgaagagggcagctaatgcaaaaaactatgcctggcaattacatcaagtcaggttttcacccctcatctttagcagcttgcctccagcttttaataaagagcagagcaaaacagggccagttcaagcatcctctgatgtttgtttagacttttctctgttgactgagcatttgtaattttaaaggtctggtctctagtgtagttatgggcagtggtgtcagacacatctgggtgatgccagacacacttgagtatgcattcttcagccatactagccctgtaagatttagtaaggtaattttatatcttttagcttcagatttcttatacagaaaaatgggtataattgtatctttttcttggattattaaaaagattaaatgaaattatggatataaattccttaaatagcacctagtatccatttctgagctcaccaaatggtgaccattatttttgttaaatatgcttcaggttttccccatcaatatcaaaaattaagattggacttggaataaaagttctattttatattttaaatcttacaaatgraaataaataaacagcatggattcaataactatactgcgagtcaagactactcttattacactgaatgttttaccatattggaagacagtaagaatgttggttgcccagggaaggccaatggaaaggcaagtcaaagccagggctagtaaagtatatgatttcacttatatgaagtataaacacaagtacaatcattttatgggattaatgtcaaaatagtagttccttttgtgaggcatagtacagtctggaagaagcagaagggtttccaagatgctgaaaatgttccatttcttcatctgggccatagttgttgtattttatatacgtaaaaattcatcaagctgtaaacttaagatctatgcacattattgtaattatgttacaactcaataaaaaggaaagggcttagcaacaatttttttaattaattgaaaaaataaactagcacagacctttgggaaattaaaaagtcataacagtgctcagtaatcccacccctagtttctctattsaatattctgatagcagaactattccagtaacagataaaatattatgtatatgraggtgttcaatgcagcatttcctattttagaaaagcgacactgaaaacaatataaaataaatgtctaataatgtggtaacaatgacrtaattgatgatgcatcaattccaaaattatgcagtcatcaagaataactacattatgtaaaatggtgcagccactttagagggctctttggcagtgtcttataaaactaaacatacctcagccctatgactcagcaattccacttctgcatttctaccaatgtaaatgaagacatatraatccacacaatgacttttacatcaatgttcataacagctttattcataacagccaaaaactgaaagcaatctaaatgtctatcaataggacaatggatgaagaaatgatgatgtattcatacagtgcagtaaaactcaggaatataataacatgaatagatctaaaaaaagttgaatgaaagaagccagacacaaaagttattccattcataacaggttacattctaagttattccattcatacgaggttctagaaggggcaaattagtctgtggtgacagatattagaacagtgatttacctctagtgggaaggtcaggaactggcttgtgatgaagatactctatcttctttggcaggatctacagcagccatcatatgacactgaggatctgcccagtaaaaatgtaaaagtttcagtcctaaaattgttgagctggtgaaccaatgccgggatttccgtaactcttacataaaagaaagtaaagccttatttgttcaatccattatagctggtaacattctgtaaaagaggacgcaaaaggcacccatgaccaatactagataatacgtattcaatcattagamccttttatgaaaacaaggggcgaaaagtgctgcgacaattcccagagaaattgaaatggatatttcctatataatgctaaaagagcatcagatatgaagtaagagggtgtgaggagaagctgctaactacataatgcttcaacagtgaaaaaaacagttctacacaataaccttctaacgattcctcattgtggacgggtaggtggtttgtacttccagtcccttcagtatcagatgtttatcatatatcaaaatcacacacttgatgtttttcctttgtactgaaatttttaacttgttttcattctatttcaagaaatattgatgaatcattttgaattatgctgttatgaagacattcatgtaaatctgtagtaacatcataattgtatttaattatgtatccatttatcattttccaaaagattaaaccatgcacaaaaatacccctctgtgttctttacggcagtattaatagytgcatatacctaggagaaaaaggcaatttaaattttctcccatgttattttagatgtattttactcctcctcctcaaagtgggtatgaacagcaacacttcccccagaacctctcgcatatgctcaaggaacatttgcagggattttatatagtccgtcctctctttggatatgtttttaaaaataaggaaaagtttcatcttttaaggaagtgccttttattgacattcaactagttactgacagatttttactgttcagtctcttaaaagggtttgaaggaatgagaactgggtagttgtgttgctggtcattttaacgttattttatttattttctcagtagttaatacaagcattgtactgcagtcacaaaattcagaaggaggaaataagctagtctccctcacaccctccttctccagccatcctgtgcccttccccagatgtaatattttcaaatagtttaacgtacgtttctgtgctgattactttttttgctatttccaacaatgttgctatgaatattcttgtcattgcccccaagtgcacatgatttcaagagttctgtaactcttggagtataacaaggactagaatttttgcattgtatgctatgagtattttcagcctagctatgtataattagttactgttttccagatagttctcatttatcttcccatcaggagtggaggagagctgtgtggctccacatccttgctcataactgtcagtgtcaagcttttcaatctggtgtgtatgaaatcatatttcactgtgattaaaatgtgaatgttctggactaacaaagttgagcatcttttcggatgtttattcaggttttcacttctatgaagtatcttttcaagtgttctgcacatttgtttttctctgttgagtttcttggattttttcttattgactcataaagcatctctcatatgctttggatgtaggtatttgtcagttatatttttaaatgcctaaattggatgcagcattccctaacttcaagtctgtcttattttctaaagtaaatatttaagaccatttcttcttaagycttaactacatcttacaagctttgatacctaatatatttgctataatctacttgttaatacagtctgatttccattatttctcctttgatccatgaattgtttagaagtatgtttttgtatctataaaaaaaggagtattccttgtaactttttgattatttatttaaactaaattgcattataatcaaagaatatgttcagcatgataccaatacttcaaaatttgataagattagctttattactaaaatgtggttaggttttacgaatgcccacatgtacttcgacatgtatrttctccactcaatcaaaatagtacattgcacttttcaactattatatgtctttactgttggcctacaatcacaagagtctgatttgtccattattaatgaacactttcagtttttatattcaagcatttggtttgatccaggtttatttttatataaagtgtgaaactaagttcaggctgtttttttccccagattccagttgtaacaatagtttttattgaataattatctttttcattaccaatttgttttgtcaagtttgctacataccaaattgtcttatttttatttacttatggatttttattttatttcattaatctattcatgcaagaatgggacatttttattaggtgacagtaatgaaaatttaaactaggttttgatgcagtgatatactgatggacccaaggtagaaaattaaactagatttagaagagagaatttagaaaaatgaatagggtcatggtcttttttgtctaaaggagagtgtgtgaataataagtggaaatgaaaaacctcagcagagggaagtacacattgttaacaattattcagacccatgtaacaaaagaccgtaattctctgctctgtaaaagaattatattaaagagacaaatgtcacactaaatgatacttgcaggacttacacaggtctctagagaaaagagtgagtataattagtacatgtgttatgatgttttgattctagtccaaaccaactagattaaatacatttactttttgaacaaaaatggcaagacataattattacaattggaatgtgatagtaatatatataatatgtatatcttagtgtgtgtgtatttatatatgtatgtatgtattccttgtgcctaaaacacttcctgctaggaaattaagccagccttctatatttgtactcacaatctatcctccaagatatgtagagttgataaaaattaatgcttgcctacaaaatttcagcaatgcttctcctatctctgtacctcccctctgtatacatttgaaaaattaatcctgaccatcccaggaggtagaaaggaaagggtggtaaaataaatagttccttgagattttataaattcatccagattaaaatatatatatatatgtatatgcacacttgtcttgaaaaagttgtgatgatgttatatatcagaaataaaaaattgtttccactcatccaaaagtttaggactcacaaatttttttcaagcagaaataattttgtttcataaatttggtttaatttcttttgattacataaaaaactagaaatggaaatttatgtatatagcaatgtaaaaatgatagtgagtttaatgctaaaatctgatctactgggctctgtttaacctaatacccaaagcttaagtaatggttaagttggggtttagaggggcctattaccttcttcagggcattggtattttgtttcctaccttaatctaaaattagtgtcttatttgccagtctaatatattttacaatcaatctacattgcctaccttttggagtatttctatttaaataaaacaaaatgagcgtttaaactgggaacgtattagattcttctgagctattgagcagtatcagatccttcagcaagaaagctgttttatcatttactaagtacctaggcacagcatcaccttgcccrttaaaagccctgtcaggtacacatttkggttgctaggcagctgctggggaagcaatctcttccacacatatggtttatgccacctggcctgcatttcacaccaacctccccaaacttcccagggagttgcaagagaggtcctcatgttcctgtcttcactttccatttccctgtcataagcactccatttgttgtcagctttcattaaggacatttccaggagctaaatatggtagatttctattaactgattctaaagattcacattaaacagaaatagagcaaaaccataaagccatctgtggaatttgagagtatggaggggaatatattaagattaaaagataatcccggttacacttccattttcatgacatttgataaaaacactttggaggaaggagaagaaatgggccagtgagagggaggaagaagaaagagacctggaaaggaaaaaaggcaggaaggcagatggaaggagaggtacagaaggatgaatggaaggaggaaatgcaattttttttcttcctttttattttattttattttattattatgatactttaagttgtagggtacatgtgcacaatgtacaggttagttacatatgtatacatgtgccatgctggtgtgctgcacccattaactcatcatttagcattaggtatatctcctaatgctatccctcccccctccccctaccccacaatagtccccagagtgtgatgttccccttcctgtgtccatgtgttctcattgttcaattcccacctatgagtgagaacatgcggtgtttggttttttgtccttgcgacagtttactgagaatgatgatttccaatttcatccatgtccccaaaaaggacatgaactcatcattttttatggctgcatagcattccatggtgtatatgtgccacattttcttaatccagtctatcattgttggacatttgggttggttccaagtctttgctattgtgaataatgccrcaataaacatacgtgtgcatgtgtctttatagcagcatgatttataktcctttgggyatatacccagtaatgggatggctgggtcaaatggtatttctagttctagatccctgagaaatcgccacactgacttccacaatggttgaactagtttacagtcccaccaacagtgtaaaaatgttcctatttctccacatcctctccagcacctgttgtttcctgactgtttaatgattgctgttctaactggtgtgagatggtatctcattgtggttttgatttacatttctctgatggccagtgatggtgagcattttttcatgtgttttttggctgcataaatgtcttcttttgagaagtgtctgttcrtgtccttcacccactttttgatggggttgtttgtttttttcttgtaaatttgtttgagttcattgtagattctggatattagccctttgtcagatgagtaggttgcggaaattttctcccattttgtaggttgcctgttcactctgatggtagtttcttttgctgtgcagaagctctttagtttaattagatccgatttgtcaattttgtcttttgttgacattgcttttggtgttttagacatgaagtccttgcccatgcctatgtcctgaatggtaatgcctaggttttcttctcgggtttttatggttttacgtctaacgtttaggtctttaatccatcttgaattaatttttgtataaggtgtaaggaaggcatcatctttgagatgaatgtgaatgatcgtggaatattccttctgtgacagactttatttttgagacaggatctcactctgtcatccatgctgctgtgcagtggtgcaatcacagctcagtgcagccttgaactcctgggctcaaggaacactcctagcctccccagcagctgggactacaggtacaggcgctgccatgcccggttattctggcttcaagcaattctcccacctcagcctcccaaagtgctggacttacaggcaggagccactgcgcccccggcccttgtgacagacttttaatgaaaccattatatttacttctttgacagcctgttactatgtcaattcctccagccactacaaaacctgtcctcatggtttagagcattggcagtcactccctaaaattggagtggagtgaggaaggcagttctgtaggaggggcttatggactccttaagggcataggctgttggagtccctgctgagagatctctgccctaccttgtggaactggagtgaaacaacgggggcrttgcttccagccatctgggagagaggatccagagcttcccctcagagagctgggatgttgtcagcaggcatcagacagagcaaaaagccatttttctttattctattcctgatacaaagcaactgagatatgcgtttctctttggaattgaggaagggagaataatggagcttttgcggtgatggacagggaaaaagtgggggagcagttaattatccatcttgacaggtgtagacacaggctgggaagctgggtgtgtcttaatccctgctcctgaaccaccgtggggagcaggaagcctacagtttccttatatcagcaaatgcatcatgttgaaacaattttactgcttgctttctgaatttaaatatagattttccctgagaagggctcaagcatgcagatggtaagaaaaacaacagtctagaaagatatcttcaagttccttctcctggttggtggaaatagagcaattcttttccaaaatataatttttagagttttaaagtaaaaaaaaaaaaaaaaaggatagagtcaatttggaatttcttagctgaccattctattagagcataggtttttcagaaaatagagattatgggcaaaaaaaaaaaaaaaaaaaaaaaaggaaagaaaactgttttaagtatgatatcttcagtgtaatatatagttaacatatactattttgttgtaattagaatatgcarttattatatattaaacatatctacatctgtagtaaaatgtgttgtcctacatttcagaaaactataaggcttttgggaaagaaaatttaggagtatacattaaaagccatgtcaatgccattccctttaacatagtagttccatttctaagggaaagaagttaaaaaattgaataaactcacatgcatgaaaatgtttcaattataatcatgaaaaaggaaataatataagtaaccaggatagaggattgattagggtagttgctctcaattttgccccccagtggacatttggcaaaggacagcgcccctacaacagagttatccagcccaaaatgtgagtagctccaaggttcataaactgtacattagtgtaattagagtgtactgactcaacagaagaatgtgcagtctttaaagctcatattataaaggctaagcttcaacatgaaaaattattttgatataataaaagagaaaataacaggatgctatttcatatatacattattatggtcaaaggtagttttaccatgatgctggtgaaactttagttgcaggatctctcacttacggaagcccttcaaaggcccttacggaggctgtaactgtgtttcatatggttataggcttttgtataaatttttaaactaagattattttaattttattttaatataatatttttctttttccctcctgaagttatacaagtttcaggcaccactaaacttgattttcctttgactatcattttaaggaaatgaaacttaatgcacatgatggaggaaaaagaatgtgatgagaaattaccaaatagctaactgaagtcatgtaaggatgaggggataatggagaaacatttttctcttctctagtttccaggtgttttccagagctattatattagtttataatgaaagaaatgattcttaagagaaagaaagttcatggatatacaagaagaaaaaaaaatttggaaaaaaaccaccatgttaggcgccggatgagtttgttgtggtttgagttttgatcttctcatgctgatctttccggctttgtagttctctctcctctcgtacttctccatcattcatgcttgtgtccaaccacagtattttactaagagagcatgtgttctagtgccctattgctgcagagcaaaccacccaaaaaacctacataggctctgctgggtggttctcactgggggcctctcaaacagttgcagcaagatggtggttgaagctgaagtcatctgaaggctcactgggctagacatcccaggtgatcatcactcaccggccccatatctcagtgctcctatctgtagcatctcctgacagcagagtagccaggtcttcctacatggccacttggtactacaaaaggcaagaagaaagtgccagtcctcttaacaactagatcgagaactgagagagaatccattttaccatattcagtggttcaacacaatcccaagccagcacagattaaaggggatgcaagggtagactcctttgctgcatgggggaatatcatacagtgcggcaaaggaagggcttgatggaagcctttgaacacaagctaccacagcaaagaacatttgatttccaagattcccataaggtagggagggatatgcaatatagagcaagcatcttccctagaaatatgcatgtgataaaaatatctacctacagagatattgttagcagtggaagttattcaagttagtaatggcaaattcatacgggtctgcagcaacctcaattcttgcttcctcagaagaaagaatttgactgaggggcataaggcagaagacgagatagaggcaagttttagagtaggagtgaaagtttattaaaaagctttagagcagaaatgaaaagaaagtaaagtacacttggaagagggtcatgtggacatcttggaggtcaagtgcactgtttgatcccggacttacagtttttacatgctgtcctacttcctgcatcttttgtcccttttccggtggaatgccctccgaaggtcatataccagttaaactttgccattttgcctcttaatgtacatgtgtgagctcactcgcccaactcctgagatctcatgaggaagctgcgcatcaccagtttcaggtatttcctatctatatagggagactgcctttccctggtgctggctgtgaccaattattattttagagagacagttaacagccacctgcccagggtcacctgactttcttggtggggtgtggggggagccctttcctgccccgctcatgcctgactagctacctactgtaacaccatgtgtaacaccatgaacacaaaatgaatatttctgacaatcagctatagagtgtaaaagcttttaagtagcactttgccagttagaatgctctaaaatggagcctcctaaaattctccaatataataattttctacggaaatctatcagaatagagcagtgacacccagaggaaatttggaaatgtttagtagtatagtgttttatgcattttaaaataaacaataactaatattttaattggaattttttgagaaaagatacaagctactttcaactgaagaaaagtgtcccgagctaaaaagactacctttgcatcatcatagactgcttgatagaacaactaaggaagtaaatgaaacggaactcactagaggccacctgaatcatcaacaaattagtcaatcagaaatgttgactagagtccctctttgatgaataacaaaattcttattctgtttccaaatgtaagaataaatgaccagggctgttatttgctctaggggattaatattctgtacattcagttaatcttgcttgtgattaatcagcaaatagtcaagacaattaaaatatacacatatcttatgaaataaagagatatttgcaaatatcaacaaaaaaggacattatgtaaaaaattcacttattagaagcatgtcagtaggccacaaattaactaaccctaagcattattttgctttctttgtagcacattccccttatatggtactcttttctgggaaacatggtcttgctctgttgcccaggctggagtgcagtgttgcaatcatggctcactgcaggctcaagctcctgggctcaaatgatcctcccacctcaaaagcttttctagtagctaggaccacaggttatgccacacctggctaatctttaaaaaatgttttgtagaaatggagtctccctatgttgcccacccttgtcttgagctcctaggcttaagtgatcctcctgccttgggctactaaagtgttgggattacaggtatgagccactgtgcccagctgataaggtactcttttatgtcagacatattaaacaaccctatttattgatatcaaagtacaatgcaccaattctgtgaccagaaaatgagacaataaataaaaactatcttaaactttctattccccattttatttttacagctaacttttttttttttttttttgagatggagtcccactgtgtcacccaggctggagtgcaatggtgccatctctgctcactgcaacctctgcctcccgggttcaagtggttctcctgcctcagccttctgagtagctgggattacaggcgcctgccaccacgccagctaatttttgtattttcagtagagacagggtttcactgtctcaggctggtcctgaactcctgacctcaggatccacccgcctcagactctcaaagtgctggggttacaggcatgagccactgtgcctggcctacagctaactccttaactacccctctccttaaaaaagtaatcaaatattttcatcgtgcccttaattctcattttcagtttgtcatagctgtagaataaatggaacttaggattaatacagaacaatttcttcagttacttactctatatgacaaatggaaccagttatatgaatgctaagacctagtatcttgaagactctcaagtaaaaaaatgctctggggaaaataatttaaaaccatttgtctctggttttgacacacttcaaacaaacttgtacaatatattttcccaacctgaacatattcattcattcaaggacagatcagtcacccaatggacatatatttagcaatgattctatgtgtaatcatgattctgggaacatagaattaaagatgattaacaagttaaaacgtctccctttgaggtcgggaaatattcacctgactttactgttatactgttttatcccccagtgcctaatattatgcttggaacagggtagatacttgcctcttttctttattttctttctttctttctttctttccttctttctttctttctttctttctttctttctttctttctttctttctttctttctttctttttctttttccttccttcctycctttcttttcctttcccttcctttcttctttctcttttttctgtcctctttccttccttctttccttccttccttccttcctttctctcttccatttgttgttctttgtttttttgttatttaaataagtaacattaataaaacacactggtggaaataaacagaagtgagaacataaacagcttaggtgactgggatttaagcatatggctttctatgtcttagcaaccctcatgtggttggaggttgtcagtcttattccccatttgacctccagyattagcccagaggctggacaaaagaagtaatcaattaataattgatatcaaaataaatgattcagtgtcttttcaacataggacaacacagtcagtgaggctaacaagaatgatatcaatttttcaagatgttaaatgctacacattatactatactaaagaaaaaagaaagtttgcatcacttttttttcatttatctggaaaatttatttatattgaagttctcatttagttttggtgcctgatgaatgagctattacttgatattctcttgctttctcaataaccatctcatctagaaagcagggtgggacttctcttttttttacttttctgacgtggtgaagcgtctatcagaacatctttcctctcattggcagctcactacggagcttgcaaaggttcacaggtggctgaaacccaacccagttgtaaatcacaacatgggtacatcttgcatattttagaagacagaaaagaaaataccttgtcagccagcaatcagaagcacattatatctcagaaagtctgccccttgtgcctgtcagcctgaatgggacctttcacacaaaccttcctgccaattcacttagagcagccagacaactccctccctcccatctttcaaattactccacatgtctaagttttcctttaaaatgtttccaaaccactggagcacacctctcatcacagacccccattgatgagagacaggattaaggttatgtcagatataactgatgattagagttatttccaccttctccacagttgttgacagacagcaaataaaggcaacattgttagacctacaattgatctattgaagttaggacttatttcttgactcctgaaaatacaaccttctaccagggctattctaagccagtgatttagagccctgatgccctgtatttatttattttttttactaatttttccactgctatgcaatgaggcatatcattattattattgtaaccgcctggctctcagtggcatgtgcacaaacacccagaaagtaaaggcatacagaagcctccgttaacgttgagaagggacagacaccataattgttttccactgttccttccattttaaacagtggggatcttacctatgttaagcatttctaggtgaagcatagactgcttaagagctgtatgagtagaaattaggaatttaggcttcagatccaaccccacctgggttggtatttgggtttcaacatatagtagctttgtaactgctggtgtgccactaatgctctccaaatattaaggaaggctttgaatgctattccaagatgtttaggctttcttccacaggcagaagagagcctttgaaagccttggagcagatgagtaacatagtagaaaaaaatacttcgagataacttgcaaagaggagttgtcaatctccaggatttgctcagctccattctccttctgggcacatggaagttctctgtgtctggcactgcattggttctccaaatctcacaaacagtgcactgaatgactgtgatgattgaataattgaccaagaaacccagataatgaaaggaagaaagagaaagaaagaaagaaagaaagaaagaaagaaagaaagaaagaaakaaagaaaggarggaagatagtaatgaaatgtgggcatggttgactaatgtatgagagttcatcagatgtataacttacttttcttttgaataatttgtatttatttattgagcattacctggataaaatacataactagttccatgcttcacttaatggtttaattatcaagaagttttgaatcaatactgacctgcaagcaatgtctcaaatctggaagctaccaagaattctgagatccaagttttctttcaaacttccctcccttttgcattttgaagtggtagtacaatttggatcagataaagaggaacaaggtggtttcagctagctgcagaacacagatatgacttcattacccagctgttagtaattttcctcccagtcggaggcagaattttgaatagactgaaaacatgtttgtgcagggttctaagatgctacatgaattcagatrttcattcatttaattcatataatagcctcagatgatatctttctttctcaccacaaggctatgctttgtctaaatggccaggtaaacatcccagaagtgagtggtccctgaagtggtccgtgaaccgatttccacgaccggttctttcctacgtgtgaaccgtgctctgctgcaatctactagtgcctcgggcattcctgcggcctttgtctaagcmgaaagggtagaacttcctgaacactaataaaggaaacataaaagcagaggtcagctggaagattggcaataggctaatgaaactgacagtcatttttgaccattttaaacaataagtttgttgcccctacatcctccacattagctgcccagtcttgtcaagtgacacacgggatattatgttgaatttttaaggtgcttcttggctgtgaatatggcctgggatctttctttccttttaataatacttagcacataattgttctgaaatcacatgttggaaaagctcttgactagaaatgttgagagcgggggagaaaaagaacagcacttaagaaaagaatggaaaagtttcagtgacatttgcaaaattgcttttccttctgatttggttgggaaaattatttttcagactctagggaattattgtttctcacacacttcatataagaatatatttcaagccagaaaggaccttagaggtggtgctcagtgtccttcgttcagatcagggaaggaaactgaagccgagggacgttaattgaattgcctctgttgtggctgcaaagtcagccagtgaaaacaaaaattctctaggaagccagctttgtttccttatatttaaaagtcattcactcatgtattcatttggccacagactatgtattgcacagctattaatattatgtggcaggccatatcaaggcatggagaatacagtggtaaacagaacagatcaaacctctgcccttatgttggtgataaatgctctagcaccttggtaatcaaaatacctccgtattagcagtttatcggaaatgcagaatctcaggccccaccccagatctattggatcagaatatcctttaaacaacatcctcctggagtttcatatgcattttcaagttgagaagaartagataaaaaaataagtaaaataaggaaaataggaagagtttggggagcttaatgggagattatgtaagagagatatgtggaggtcaaatgcccagggctctgtgggttatttgaaggacgtgggcttttgctctgagtggggtggcaaaactggagaggattttgagacaaggcatggtgtaatgtgactaagtataaattctatgtagcacagccttaaatgttagasaggtagaaaacagatcagtggcggcctggcaacaggggataggccacaaaagggcacaagaaacttttaagggtaatagaaatattctgtaccttgatggtaatggaattacactcatgtatatatttgtcaaaactcatctattggtgcacttagaatgaatgcatttcgttatttgtaaactacttccaaagagttccaaaaaaaaaaaaaaacctgttggacacatctgatacggtttggctgtgccgtcacccaaatcatcttgaattgtagctcccataatccctgtgtgtcatgggagggaccttgggggtggtgattagattatgggggcagttcccccatgctgttctcgtgatagtgagtgacttctcacaagatctgatggttttaataagggggctcaytctcattctcgctcctgctgcactgtgaagagggaccttccaccatgattgtaagtttcctgaggcctccccagccatacagaaatgtgagtcaattaaacctctttcctttataaattactcagtcttgggtattcttcatagcagtgtgagaatggactaatatacaacatcataaccaggatataacttaaattgtgtaaaagaaataagcaggatcacctccttatgtgggtactatgctcacaacctgggtgacaggttcaatcacaccccaaacctcagcatcacgcagtatacctctgtaacaaacctgcagatgtacctcgggttctaaagtaaaagttgaaaatttaaaaaaaagrcagwtgagagaacagctgttgcaaagagtatcagttgaaaccaaatttctctctaagccagaagaatagtgggtatgtgagcatgtgcaagattttgcactgcaaaagatcatttcaggagtccagaacacttgagaatatgcagaataacagtggagaattcaaagtgataccgaaatgcaaaagcacactaggtcaggatttatgagatagattctatttttgcctcacttctactactgcctaactttgtgaccttggacaagtcatgtattgttcttgggaatacaattttcttctctttcaagtggcaatcagagcacctgtttccacattgctatgtgggggtcaagtgcaatgtgaatgctggaaaagtgctttgaaaatgagaaggcactgcgtatgtgtaaggactgctaaaatggccttttccaagatgcattcacatcagtgacgccaagaagttggaaaggacaccaattattagatgtttctgacactgccttaacttcagggcatgtgcaagttttcctgatgtgcatgtgaaactgtgtctattacatatgctgaagttttcccccaaatgggaccagcacccacatgtctgatatrttccttaggtagagccattcttctcaataaaacacaaaatagtgaaatacagaaatgtctgatttgtaaagagagggtatctgtaacaaaattgaaagtcacagatttgatatctacttttacattcttgtatccagtaacatttttttgagcatctgctactgagtgaagcatggaaggatacacaaagatgaataaaacacagtctttattgtcaaggagatgacagtctagaagaatggataagatgtgtctaaaagtaacttgaatgcaaagccatatgtggaaactataagacaaaaattaacgcaayggagttagatagggggaaaaataaacacttgtctctcggaaaccttcctgagaaaagtggtgtttgaagtgagcattaagaatagattaagtcatgtcatagaatcaggaaaatacaaggcatttctggaatgatgtggtggcctgtttggctgggagacagcttatgtttggggcactagygtgatatggaagaggaggctaaagaaggttaattgaagacaggaccatggaaggttttccatgctagcctttctaggctggaaatggaaaaccactggaggtttctgagcagaagcgtcgtatgactcaaagtgtgtcagcggaagaggactttggcagctctgttgagtatgcactaatgttgggacagaccagtggtaggaaggccaattaaaaactaaatgcaatgatttaggggagagaaaatgaggatttcaactagtgtagtagattataggtttggacagatatgaatgaatataaataacattgtatcaaaaaattggctggaccttaaaaccatctggatgtgggaggtgagaaagaagaaagtaccaaggatgactctcaaattcccagccaaagtaaaaagccctgaaagagtgcatgggtgaaagatagtggatgtatttttaagacatgctgacttagtggtgctagtggaacagctaacattattatttcttctatacggcacacatttaccatatgttattctatttaataatcaaaacaggcttgtgagaagagtaagatcataccagttttacatagagggattaaggctaaagagaagtaacttgcttaaggtggcagaatcaccattggagaagaaacataaatattgtgttctttgtatgccatcattgcaaaaatctagcagattgttgaacataagaaactgaaattcttggctgggcgcggtggctcatgcctgtaatcccagcactttgggaggccgaggcggacggatcacgaggtcaggagtttgagaccagcctggccaatatggtgaaaccccgtctctaataaaaatacaaaaattagctgggcatggtggcgtatcctgtagtcccagttatttgggaagctgaggcaggagaattgcttgaacccaggaggcggaggttgcagtgagctgagatcgcgccactgactccagcctggatgacaagaacaagactctrtctcaaaaaaaaaaaaaaaaaaaaaaaaagaaagaaactgaaatttgtgatttcctggtccagtgatcatttctaattgataccaatgaatccctctgatgaatatttcactggtatttttctaatatatgatacattcataagttggttcctaagctgtattttaagagaacatcatgatttagatttttcttatactaccaagaatgccactctgattctttatggaaactgagaccatacacttaagctctaggggggaggtaatgtaatgcaacctgtgtttctaaagcacaatcacactataaacagaccttgctgcaaaaataagtatattcagcacagagctgataaacctcagatctgtggctgaaatgatcagttgatgatattatagtaaacaccattaccaatgttgtgttctggatgtttttcttcaagctgtgtgtctgtaggaaatgactagtatcataaaccctcttgacaaaaaaaaaaaaatcacatttctgttttccaaaaagagttttttttaatatcataataaatgagttcttttgaattcatctgtgcttttctaaatattatcttctggcaatgactttgccttatctctgctctgctgtttctggagagcataattttgctacatgtatctgaagatttataattgcgcctcttaattggaaatcaaggcttggcattagttaacagttactggtgaaatggcccactgataaaaacaaatgcttacatttctagaataataacaggaattcttctctgaagaacccagagtggcagactatcacttcacaaaactttctcatttccccaaacttgtaataaagccagctcattgtttcttcaggctactaagcatcaagcaatttgttttctgtgttcagtctgtcatcttacggctcgctctmatgttcactgaagccctayggcagactttgggactaytgtttttttaaataaacaattatggcattttcagatatggatattatcaaaggaatgatctaattgtccrccacagatttggatcagatagttattcctcataatacctcaagctgagactcaggaaactagtcctgcgtggggacatatgtcaaatgcattacaaaagcatcacctccttagtctaaataacgtcaccaccacccacccagttatgcaagcaaggaacttagacagtatcctttttacctccctcttcctcattgcccatatctaacccgttctatgttctgaaatagtacttctggattcattctgtcctgttgtatttttggatccatccatttttctctttctcaactaccccacttgtcagtccaccttgacattccacagtggcctcctcactgttctctccatccttcattcatgctcctctccagtgttttctccacctacattgagagcaatgtttccagattaacyagtatatcaagtgagtcctaggtttaaaaacctgcaatcactttcattgcttttagtataaatatcaaaatccttatgcaggaccttgaaggctctacatgctctagccccactcacttctacagaccatttgttctaagtctcctcttctctgggaggaagagatcccctctactgagaatgcttctcttctcccatctcttcccttagttatacttttcctccaccttcatatctcaagtgctagttcctcagagaagccttcctcaccacccacacactcctggtccagggacctcccttcctaccttcctccctcccttcctccctttcttcctcccttcccttcttccttccttttctttttttccattctctccttctttctttctctctttctctttttttcctttctcaccattagctttctttcttcccattttctttccttccttccttccttccttccctccctcccctcttcctctttttcacccttccttccttctttcattttttctttctttctttgtttttctttcgtcttccttccttccatcattttttctttctctttgtttctttctttcttttgtctctctccttctttccttccttcctcccttcccttcccttcccctccctccccttctttctttccttccttttcttctttcatcctgttttcattaatttgttctttctttccatcatctatctttctatccttccttcctttcttacttcctccctccctccctctctctctttcttttcttctttctttttcttctattatctactatctatgtttttgtctattatctatccatctattcatctatctgtctatctctatatgtatatattcaatagaaccaaatctctgtatttcagatcacttatttctacttataatcttatatttattcatatctacagtcttaactctaggctgtaagctccgtgagaacagtggttgtatttggtattacttaattttatgttctcaagcctaactttgtgtctgacacaggtgagctttcaataaatattagtagaataagttaaagtgctttactgagctctgaatgttgatcaagaagtaaccactgcgaaatattggatgccaagaaaataagctatttaacatttcccagcaaatgattttcagtgaagcagtgaggatgggaaagacacaatccctgaagactgaaagaaatttaaaaagaaaatgggaaggcaaatgaaaagcacataaaacaaatacctaatacatgcagggcttaaaacctagatgatgggttgataggtgcagcaaaccaccatggcacatgtatacctatgtaacaagcctgcatgttctgcacatgtatcctagaacttaaagtaaaattttaaagaagaataaccagaaaataaataaataaatatatatttttttaaaacctgctttgtcaggtactgttayagttgatatagatgaagtgaaatctaagaagaatgtctaggcccaagatgcctagtgcttgcttttaactattttcattttttagccaattactaattaacagaggactagttcaggactcattggaatgtccaggtggctaagggactgcacagtgtttgcttttgattacaaaaacaagccctagctcatgcacttcctgataagtttggttctgtgtccccacccaaatctcaccttgaattgtaatgatccccatgtgttgagggcaggaccaggtggagataaatgaatcatgggggcagtttccctcatgttgttctcgtgatagcgaacgaattctcatgaggtctatgtttttgtttttgttttttgagacagagtctcccctgtcacccaggctggagtgcagtggtgcaatctcggctcactgcaacttctgcttcctgggctcaagtgtagctgggactacaggtgtgaatcaccaatgcctggctaacttttgtatttttgtagagacaaggttttgccatgttgcccaggctggtgtcaaactcctgagctcaaagcaatctgcctgcatggacctcccaaagtgctgagattacaggcatgagccaccrcacccgcggagatctgatggttttataaggtgcatcsccctacctttggcactcattctttctcctgctgccctgtgaagaggtgacttctgccatgattgtaagtttcctgaggcctttggctggattttggacttgcatggggcctgtagccccttcattttggccaatttctcccacttggaacaggtatatttaccccatgcctgtacccctattgtatgtaggaagtaagtaacttgcttttgactttacaggctcatacgtggaagggacttgccttatttcagatgagagtttggacttggacttttgggttaatgctggaatgagttaagactttgggggactgttggaagggtatgattgtgttttgaaatgtgaggacatgagattttggaggggccagggatagagtaatatggtttagctctgtgttccccccacccaaatctcaccatgaattgtaataatccccatgtgtcaaggacaggaccaggtggatataattgaatcataggggtggcttcccccgtgttgttctcacggtagtgagtgagttctcatgagatctgatggtcatataaagggcttcccccttccctcggctctcattctctcttctgtcaccctgtgaagaggtgccttccaccatgattgtaagtttcctgaggcctccccagccatgcagaactgtcagtcaattaagcctcttttctttataaattgcccgatctcaggtatttcttcatagcagcataagaatggacttacatacttccccaagacctcttcattgctgggccatcacagtaccctgaatatgttcttaaaatcaaactttaaaccagttagttgcttttaagctttttctatggtgtcttgtgcaccttacatcaaattcaccatgtataatgaattaaaaagtataactcctagcaacaactcctaaagagtttggagacttcttctggtggcatctctcttgctcttgtaccctctctctctttttctctattcctctccccaagtstctgaataataaaatttctatcaggagtggattaaaagatacatctatcagttcaccaatttagattctataacaggaatgacaggcattaagacattgtatccaataatgtctgggctaacttttttgttgtcgttctcacatcctttccactgattaacacaaataattgaattaagtataatttcataagacatgaatgactgcatttcatcataaatcactcataaattcttttgctaaattgttggttttcaatttaggataactgaaggataggaattttaccttcaggttagctataaccaaaaatatgaggaaaaaaaacatgatctctgccagaagatcactggaagagatttagtgtgagatcttccatggaaagatcagagcaatacagactggctcaaagagagcacatagcctcagacttttattctaatgtataagaaatggtttttatgtactttgtgttcattgatacttattttctttcttggcttcagccaaaatatgaatgtaccctcagctttcctttttcatggcaatcattgattctaaaggcctggcacagatatgttcttcgaagggtgtgacctttaccgtcctgtgcgcatcagctatctccccatcccatacctgcatccctttaccagagggctttctctggtagactgtccttttgcatgctggagagtgagctcttccagaggcagccctcaaaccatgatctatgggagctgacagatcctcagttgtgtcatcccttaggtgacaaactgcaccatccctggagcatctcatggtgaagtcctggttcccacagtggtagcttgctcaacagtgcagcccttattggctcttttccatcctctttcttgctttcccactcttctacccgtattttctctgatcacctcccaaataaactatttctctagaactcttgtctcaggcttaaattttttctgcaaaagggaatgcctttggatttctgtaaaagggtctgcttcaaggagaaatgcaacctgagagagaaggtcatggttttcacaaaaggctgtggttacartgagatttgaggcttaaatccaggcttgtgtaagactgttatgtgttactagttgttaaaatattgagtgcttttatgcttgtttgcaaatagctacttctcccaactctgcagtggtcatgaccacttcatggtcatccattccttcccatgattcaacaactaaagtttattacttgccacaacaggggcttctaagaccctcattaaatgctatgggcaccaactgtttgaatgattggtgtgcttgctatgtgaattattaaatattttaaatattatttatgtttaatgtggtgcccaccagamccagatgtaacgtacagcttttccttggacagtatagagaagaccttgaagttatgttcttttaactcagtctttagtatttctctgcatgaaatccttcagctccatgtccagttgcaccgtggtagatttgcagggaagtggatggatgaaagagacaggagaaggaagagaggacagaacaatcaatacttgatgatgaacttctgggaaactgcgagcatttccatttgaaacaaatagagtgtttcttatacaatagccatatgtatttgtaaacaataaaatgcctgctagtgtacaatggattgcacttctctgatattatacttatattcttggctctgctttttttctggattcaaaatattcataagaaatgaaatatggaaccaaaagtcacacatacatacacacacagatacattttatagtagatacttgctgcttggcccagatatgttttgtggattaaattctaggccccatgctggatgccagactcactacccatgtttagacccctagacatcagacatttactgcctggccctgtgctcccagctgcccatccaggtggtaagttttatatctcgaaaagctttttcaggctgatttcatggtgaatatgtgttaatcacctcagggagttattgagaatttgggataaacttgattgggtgaacaagcagcatgtgtccaaatatagctattcctgagctgtatctttgatatatttgatgatgcttgaaaacagtccgatttacatccatcgctgcattataaagaacagggctgaagatttataagttgaattttgttgcaaatgccaaagcatgggccacagataaatcagttaccagaataagggtgattttataacctgcatgtgttttatagtttctcatgacacaataatcataaaattcaaaaggcacactcttgcaagtgtgaaaaggcaatttcagggttccttttggtttctgctattgcaaggcaggatatagatacagtttctcactatttagatttgctattgaagttttagtggagtgccaaagatttcagtcagcaagtgtcagtaaatgatatcaacacagctccaagttcaaggtggaatcgtttcttgaaataaagtgagcatttggtgcccagaaatcttgttttaaaatacaccaacttctcagttttggaagagctctttattttttaaaaatagattcttattatgtaagcatacaacttttcttgtatgttcctgttgctcgtatttgtacacatacacagtgaaagttatttttaaatcttttattcttatctgtaactgctgacagcatttgaggtgtggaaacttttaagactgaaaaatcaagtaaaggaaaattcaagcaaatgaatacagaaaaacattatcattaggagccttaataaaactgctgtttagcttgtcacgctggcacattcctgtaatcctagcactttgggaggctgaggcgggtggatcacttgaaatcaggggttcaagaccatcctagccaacgtggtgaaaccctgtctctactaaaaatcaaaacaattagctgggcatggtggtacatgcctgtagtcccagctacttgggaggctgaggcagaataatcatttgaacctagcaagcagaggttgcagtgagccgagattgcactactgttctccagcctgggcaacagagcaagactccatctcaaaaacaacagcaaaactgctgtttaactccacaaaagtcattacaccactatacattcactaaaattgctaaaattaaggaaaaaaaaaaaacagtagtaaggccaggtgttggcaagattgtagaatagctgaaactctcatacaggggtgatataaaatggtacaactactttggaaaactctctggcagtttctaataaagttaaatatgtacttacctctcctatggcctaacaattccattcctaggtatttacccaaaagagatgaaacatatatccatataacaacttgtaaaagaatgcttatagcccctttattcataaaaaccccaaactggaaacaacccaaatttccaccaactggtaaatgaataaacacattgcggtataatcacataatggaatactactcagctataaataaaaatgaattgctaatgcattcagtctagtgatgaatctcaaaattatagtgtttttgaagagagctgaagagacacaaaatggaccatactctacacttccatttatattaagtttaaagacaaggaaatattctgcagtgatagaaaccagaatagtagctgattgtagagtacaagaggactgattggaaaggagaacattccagagagaggaagtgtattataccttagcctggatgatgattgcatggtcatatacacttgccaaattgcattgatccatatgtttatgatttgcattatttgtatataaattatacctcaataaaatgctgttaacataaaaaaattgcccagcttctgagttcttgcttaataatattagtatcacctgttgctgttctacgttaactcaggagctaaattcaaattcagtgtatgacaaaatcttatttgtgtgaaattactgggacgtgtacttttgcatttaagaaaatgctccaaaaaactgaagattctcccttcatgttagaaacttaaaaataaaataaaataaaataaagatttttttgggaggaagggaatcttaagttaaaatgtcacaaatctctcctatcatgttagtcacttttttcttgacttggcatttgcttggttgccttaagcctttgtctatttttcagagttctgacagagttgagtttgataatttttgctggttttatcagtgttttcgtggagaaatgggcccttggggctccctactctgctgtttttgctgacttcaccaccaaccctcatattcttaactctgtatccttaatagggttgaatgggtttcaaaaggcaaggtaggcaatggatcatgatactaagtcaatgataggagctttgaagtgaaagaggtgtttctaacaaaaagtagatacacactctccacctacactcctcttcctccatcatatcatacaattcagaagcaagaagaaaacacaaactcatagactgaggccatccaccactacctgaaatgctgcacctcactcaacatgggatggggcttcgattgttatgatttaagcacttctgaaaacacactttctacttcctgtttggtcttaagtcttccctggaaaggtcatctatctccatgtatttcctataaatatctacctctcttattaagtgttacattcaaatgtgacaaattaaaatcaagtggaaatattttgtgttaatgataaggtaaagccaactgtgtatgtcagagtagaatatggcatgtgctcttatcataaatattacaggagctatttgtttgtcagggcttcatcaaaacatctgaaaattgcttgacttggaggagaatagactataatttccatgtctgccccaaataatcagtcattgacaacttagaaaattcttatcaataaagatggaatcaattttttctattccacaaaatgtaagcatatcattttgagacaaattttaaaatcgttttagacttgacaaattacatgaaagagacacttagtcagaaatgattttttttaatgaagtgaaatttaataagtgactctgaatgtctgttgatgtgttgggaagcccatctttgcttgaccaaagatttatccagtaataatcaaaacatctaagttagtcttagaatttatatatatttcccatcctggctaacaccctcctcagcatggcagcagtaggaaagatggcggccacattctctctatgggtacctgattctggaaggagcagagcagaccttattaccaaagaattgtgtttgtctgttttgacctgaagagtccctaaaagtacttgccttcgttttacctaacttggaactctcttagggcagaaaagcagccatgtagaggacattcctccaaaacatagaaaggtaaatgaacaagcctctgccacttagggcaaaagatgatagttgttataaacaatagacaaccctaaatactggaaggaaaagctggagaatgagttactttagagaataattgctttgaaaaagattccttataatagaaaacctaaaaagtgatgcatatgcccaggataggacctatgctcaaaagatttgagaagacactaagctttcaccttcagcttgagatcttaaggcttcacaacagcaggaaatgaaggctaaggcagagttgtaaacagccaggctaggagagggttgggtgtgtgtgtgtgtgtgtgtgtgtgtgtgtgtgtgtgtgtgtgtgtttgctctaggcatttagggaaatctgccaaaccactagctaaccacaagctaacaaaatagagacttcagagtccatacaacaaaatttatagcctttaaaaatagtccggaaaaatgagcaaagtgtttgaatagacatttatccaaagagatatttaaatggaaataaacacatgaaaagatgcataacatcagtaatccctcaggaaatgtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatggtgcagccactgtagaaaatggtattgtattttttcaaaaataaacatagagttaccatataattcagcaagttcacttccgggtatatatctcaracaattaaaatcagggactgaaacaggcatttgtacactcatattcatagcagcattattcacaatagacaaaaggtgaaaacaacccaaatatccatcagtggagaaatagataaacaaaatgtggtatatacttacaatggaatatgattcagccttcaaaaataaagaaattctgacacatgttagaacatggataaatcttgaagacatgctaagtgaaatatgccagaaacaaaaggacagatatttgtatgattccactcgtatgagataactagaggagtcaaatttatagaggcagagtggcagttgccaggggatcatcagagagaagtataagtagttattgtttagtgagtacagagtttcagctttggaagatattaaaaagttctgaagatggatggtggttggtgatgattgcacaacacaacattttgaatttagttaatgtcactcaactgtacacaaaatgactaaaacagtaaagttgggctatctatattttatcacaataaaaaatagtttagaaaagtcactaaagaaagaaacaactccaacccacagcaagcagcaaaaataaaccccaagcagtggcaagaatctggtttctggagttaccacataataatattcaaaatgtcttgttctcaacaaaaaattatgagtcatgagaagaaacaaaagagtatcccactcacaggaaaaaaatgaacaactctccttgaaaaagcacagatattggatctactaactaagactttaaatcaactcttacaaaacgggtgattaccagagcctgggaaggataatgggtagggaggtggagggggaagtagtgaggcttaatgagtacaaaaacataggaaaaatgaataagatctagtatatgttagcacaagagggtgattatagtcaaaaataatttaattacacattttaaaatagctaaaagcatatcattggattgtttgaagccaaaggataaattattgagatgataaatatcccatttaccttgatgtgattattatgcattgcatgcctgtatcaaaatatctcatataatacataaatatatacacctactatgtatccacaaaataaagaattaaataaataaatataaatgaatcaactgttatatatactcaaaaagataaatgaaaccatggacaaagaactgaaggataaaaaaagaataaagaaaaatgaacagaacccaagagacctgtgagacaccatcaagcataacaatgtaaggggagtctcaggaagtgaggagagagaaaaaaaggcagaaagaatatttgaagacataatggttgtaaaactctcaaagttgataaaaggcataaatctacacattcaggaagcttgatgaactccaggtaggataaatacaaagacagccacactaagagaaattgtaatcaaactgttgaaagctctagacaaagaatcttgaaattagcaagagagttgcaattaatcacatacaaatgatcttcaatgaaattaataactgatttcttatcagaaacaatggaggcaagatagcaattggtatatttaaaatgccaaaacaggaggaaaaaacaacctgtcaaccaagaattgtatacctggcaaaattaagaaaaaagtaaatttaagaaaaaagtaaaatatttccagataaaagctgatagagtttttcacaagtagacctgtcctacaagaaatggtaaggagatgccttcaggatgtaatgtcagcaaactcgatagtaacttaaaggtgtacaaaagaaataaaacacactactaaaagtaaatacatagtcctataaaaaggcctattttattgtattattggcttgtaacccctcttttttctcatatgatttaaaagacagatatatcaaatgatgaataaaaatctatgttagtttagtttacatacaatgtataaagatatagtctgtgacaaaaacaatwtaaagaaagagatatggagaatataagagcaaagtaattgtatactcttgaagttaagttggtgttaaatcaagccagattataagtttaagatgttagttgtaatccccaggataactactaaaatattaactrtaaaatatacagaaaaagaaatgaaaagtatacttcaaaaatcaaacacaaaagaaggcagtaatgggggaattgagaaacaggaaagataagacatatagaacacaaatagtaaaaatgtcaaaagtaaatcctttctcacccataattacttttaaatgtaaatgagctaaactctccaattaaaaacagagattgtcagattaaaaaacaacaagaagattcaagtctatgctgtttacaacacattcactttagctccaaagatacaaacaggttgaaagtgacggaatgtaaaaagagatttcattcaaattctaaaagagaactagaatagctatactaatatcagtcaaaatagaccttaggtcacacatgctacaagaggcagaggacattatgtattgataaatggggcaattcatcaagaatataaaacaattgaaaacatatatgcacctaagagcttaaggtttgatatagaaaagggaatgagcctaggtcggtcttgtactaattcagtttaatttacctctctgagtttcattgtgtataactctgcaaatcctctttttttataacatagaaattccttcctacctttctttcttccttccttcttttaggaggcaagttttgagtacctacttttgacaagccctgtgctaagttctggagatacacatctcagtaattatagcccctgtaattgtagactttatagtccaagtcagtagctttcaaattttagtttatatgagaatcccctgggaggctgatagaaaatacaaactactgagcctcacccaatgtgtctgattcagtaggcctggagtgaggccctaagacctgcatttctaacaaacttccaggagatgctcatgctgctggtttgtggaccgaactttgagaactacccgtctaagtcatggattctccattttggctgtacattgacatcacctgtgagctttaagaataccaaggcctaggtctcatcttcagacttaaattgcttgggagttgcctggtcatctggattttttttaagcttctcacatgtttctaatacagaactaaagctgagaaccacttctcatttctggctgcttattacaaccacttggaaaggttttaaaaaaaaatactgatgtctagaaagcattatggattaatgcaatcagaatctctgagaattgagccccagcactagtattgttgaaaaacgtctagtgttgttcaactaatttgaaagtttaaccagagctgaactccatctaagcaaaggtaacatacaawgagtgaaggagagaggtaattttaaatgtcatctttttttgtttgtccttttaaattatcaagaagcagacaggaacataaatggaaaaccaagtctcccataacctaccactatagtatgtctattataatcatacatttttcctatccagtctttgaccatatgtgtgtatttttatatggatcatatatgtgtaatttgagattctgccaaaaaatttctttaagccacagaataaccttttaaaaataataagtaaaatgggtggcattgtcggattttctccatgttcactgaggaaagataacaagaataaacttgatctcagcaggataatttaggcttgtaactggaaggaccttcctagtcagcagaattaaactgctcaaggagaaaaagtggtgataaactaggatatggaacgaggaatcaaagtcctatctagaagccagatgatgggaaaatggccacagagagatgatctgggacttggcagggactgttccaggtagaatgctgaagaccgttagtggagagaatttgtctcttcatctgtatttcacttagaatctcctgtgtgtggttcaacattttgtggtggtttgtggatacactttctagtctaaaggaatagaactagattaatattttctattgtaaaatttagtatctttaacttagaacataatataattatgaaccgtataactaagttttgcaactcatgcagggggattatagataaccctagagcactcattctttatctgttctaagatagtcgggatatgagcagttgaagacattcctcttagttaatccaagtgggtgccaagacccatgcactggagagttgaaacaaaatacaatgagtctgaaatttcaagcagaagttcaagcgtctctttctattctgtcttgatacattgcattgaaagaactgctatggtttaattctatcagtgaaaataacagggtttgtgatgtttttaatttakttttccctccccacattaactttcctcatttgtgttyggtaaatttgcttcaactgctcaatttgcatgaggattaaatttcattaacagatgcaattagaaagtggaatttatagaataagtcttctttataccctaacctaattgacataaggattaccgatgtaattgactagaaatcctttcaagatagtcaagctgacatttaatagtgtttttctctataaaattaagaatgttcactacaatctacatataagaactaataagcctattccctccacccatcacctaaaattatagagctaggtcaattttatattcttgcagcaaaaaactcccctggcatgaggttgaacaaagtctagttaagcttgctatttttttccttttagtagaccctcccttgagtaaaaaaagatagagaagagcaaasggtcttcgctaagtgaactcatagcttagccaaagtctttcagagctgagtacggaggggctgcctcagtgggaagcagaaattaagacctgctcctccatacatcctacttgcatctttagcctcgtttctttacagcagttgtttgcaaccttggctgtacattgaaatcacctggagcaccttaaaaattgtaatgacaagaccccactgtaggattctaatatacttgggctgagatgcagtccacactatgtgagtgtgaaaagctgctcagcrgtcctaatgtttggtcgtggttaagagctgctgctttacagtaagcagtactttgcctgtggccaggtaaggcaaaaatgtgcctggggactttgggaaaaagaagcaggttctctcagtaaaagctgtgctccggcagaaagccggttaagtgttccttgctgcctatttaagaagtaacagtgccaaggcaatcccatttgctctggccatgtgataattaacaattgatatttgtgtgaagccagcctgcctaacagaatggtgtgcagtctttcagccaaacagtacactggcgctcctctgtggacttaaaattgcattctaaaaaagtagatggcatttttaataagcaaaaccccagtttaaatataaccaactgaaattataagtaatttggtaatatgacttcatgtgggggtcatcttaacattaataatacctgaaatgaaataatttctaaaatatttctaatctcaaattactacctttggtgatattttgggtgatagactatttttacaaactagaaaagattctaaatcaggaaaagtacataactgaggtctggctttttgaagcacacactcactttttttatgaaatacctgtttgctgaccatggtgtaggccattaatgtcattacctctaccacttgaataaaagtgaatccttttgtagcttatagtgtgtaaacctatgagacttatagtatgtagatgtatgatactgacagccaaaacagtatgcatattatgataaatcactgggtaataaagtagccaatttggaaaattctcaattggagtagtccttgtgtgttggcaaataagacttgcatttatacagtgaacaaaaaagtttgcttaagaattaggagcaagtaattgattttttaaaaatgatgtggttctggtggaagtagtatagccctaccaagtagaaaaaaagcaatcaatttaattaaaaagtctcagctgaaaaaaaatttagttcccatctatagacaggggctctgtccttagatacagcaggaagattcaagaccccatcatctctctcctcccacttctcaacctcctcttggtgtgtttcattgtccaaactcaaaaggaagccaggaggtgaaggctggctgatgcggttcagagaagtttgtctcctggacacagtgcaatatggagaagctagaaagtaggtctgaaaacagagacaatttgactttttgcagatgacatgattgtatatttagaaaactctattgtctcagccccaaatcttcttaagctgataagcaacttcagcatagtctcaggatacaaaatcaatgtgcaaaaatcacaagcattcctatacaccaataataggcaaacagagagccaaatcatagtgaactcccattcataattgctaaaaagagaataaaatacctaggaatacaacttacaagggatgtgaaggaccccttcaaggagaactacaaaccactgctcaaggaaataagagaggacataaacaaatggaaaaacatcccatgctcatggataggaagaatcaatattgtgaaaatggccatactgcccaaagtaatttttagattcaatgctatccccatcaagctaccattgactttcttcacagaattagaaaaatttactttaaatttcatatggaaccaaaaaagagcccacgtagccaagacaatcctaagcaaaaagaacaaagctggagacatcacactacctgacttcaaactatactacaaggctacagtaaccaaacagtgtggtactggtaccaaaacagatatatagaccaatggaacagaacagaggcctcagaaataacaccacacatctacatctttgacaaaccttacaaaaacaagcaatagggaaaggattccctagttaataaatggtgttgggaaaactggctagccatatgcagaaaactgaaactggatcccttccttacaccttatacaaatttaactcaagatggattaaagacttaaatgtaagctctaaaaccataaaaaccctagaagaaaacctaggcaataccattcaggacataggcatgggcaaagacttcatggctaaaacaccaaaagcaatggcaatagaagccaaaattgacaaatgggacctaattaaactaaagaccttctgcacagcaaaagaaactaccatcagagtgaacagacaacctacagaatgggagaaaatttttgcagtgtatccacctgacaaagggctaatattcagaatctacaaagagcttaagcaaatttacaagaaaaaaacaaacaaccccatcaaaaagtgggcgatggatatgaacagacacttctcaaaagaagacatttatgcagccaacatacatatgaaaaaaaagctcatcatcactggtcattagtgaaatgcaaataaaaaccacaatgagataccatctaacaccagttggaatggcaatcattaacaaatcaggaaacaacagatgctggagaagatgtggacaaataggaacaattttacactgttggtgggagtgtaaattagttcaaccattgtggaagacagtgtggtaattcctcaaggatctagaaccagaaataccatttgacccagcaatcccattactgggtatatasgcaaaggattataaatcattctactataaagacacatgcacatgtakgtttattacggcagtgttcacaatagcaaagacttggaaccaacccaaatgcccatcaatgatagactggataaagaaaatgtggcacatatataccatgaaatactatgcagccataaaaaaggatgagttcatgtcctttgcagggacatggatgaagctggaagccgtcattytcagcaaactaacacaagaacagaaaaccaaacaccacatgttctcactcataagtgggagttgaacaatgagaacacacggacacaggaaggggaacatcacacactggggcctgtcagtggttggggggttagggcatggatatcattaggagaaatacctcatgtagatgacatgttgatgggtgcagcaaaccaccatggcacgtgtatacctatgtaacaaacctgcacattctgcgcatgtacttaaagtataataaaaacttaaagtataataaactttattatactttaaatataataaagtattatataataaagaacttaaagtataataaaaaataaaaaaaagaaagtgggtctgaataggcaaacagaaatatatggtatatctgtttaaccaacagctttcctctcctttctctggaaatgtaaccagctagaagactggagtagccatgtgactaattctgactaatgtggtgtaagtaaaagtggcaaggtaggactttaaggaagattttttttctcaagaggatatagaccccagaacctgtgttttgtcctcagtcatttcctccttcatgatacctgcaaaacggaggtgaagattgaggttccaactgccattttggactggatttaggcaaatttgcatttggatgtcattgctaaggatgggagagcagaaatttacaagaagtgtgtgcactagtgactaaagccaccacagcagcgctggattcctcttctgaatttattccctgtgaaggaaaattaatcattatatattaaaaaaatcaacagttcaaaagtttcatctcattatgtatttgctatcaattatataattaaagtatgatgtaggaatttttaaatcatcrcttttaaattttaaaaattagttctaagaccccaaactatgtgcaattttacaaagtatatttgactgccttacaacaggctactatctacttaggtattgtgcttacttcagatgaaaattgtgccttatcaacaggtggaaacaatcattaaatattaaaaatatttgcttaatgtagcaagtgaatgggtggacgaatcatctcagtttctatcgggttttcagcatgtgaacctagtgtttaccttgtcaaaaagttgattgtttctaataagcaggataacagataytctagcaccttcaaagtcgaacagagctgagaaatgaagtgtgacttatcctgtggaatgtaaaaaacaacattttttaggaagcatgtgaatatgaatgagaggatgatcatcatttaaatatcaccaaataaacataacatttctgttgggcatcttttgagcagttagattttccatggaatatgttccagctttgttttgcttggttggtaatcatagcactgaatttaataaatagatattattgaatttccttggaatgttcctggtgttgtaacataaatttagtgcttaactggctatgatatatggctacatatctatagtacttacaggtggtgaagtctgttttaggttttctgcacttcggttacttagcttgagctatcttgagattataaatcacttctttttttttttttttcaaactacacattcatgacatacagcatcaacagaagatgatttattctgtgaccctactggcaaaagaatatattgatactataattttgctaggtgtcatttgttcttgagggttccttgtgttggtatgcaatagcaaattaatccagaattgcaaggtagaaggaaatataacagaactcgtaattctgatcctgagtcagttagctgaataacttgatcagatcacatctaatttttctcaatgagagcactactggcatctcaggccattgtgtgatattggcctgggcactggcctcacaaacactgcaaagcagtagcactttcagccagttaaaatgtcacggacttctgcagcagcctcttgatttgtgtgttccagaacttgagctccagggacgatgggccaagtttgggagcaagtactagagttttaacttaaagttaaaagcggaggggtgctaaaatgttgactctgatacaggtctgtggcaatttaattccatttccccctctgtcttgaaccccttctacttgaccactaacagtttttagcctaaattatccggatacccaagtcttcacttcattctcccctgtggacaacccaatgcctgggaacatgatgttcataagtttagtattctccaatacatcaagatcttgatggaaaatctctctaaaatagtaatgggaaaaatcttccctccaaaattccaattattttgagtgaacatcatcatgcatataaaaccaatgtcactggcatgcatcagaaactttaatttaacataggttagcaataatcattagtagtcgaaacttcattgctgatcagtagtgggatggtgcctgtgaatagccactgcactctagcctgggcaacatagcaagactccaactctaaaacacataaataaataaatactttaaaaaaatcattagtaggtggtatgttccttctctacttaaaagcaaccaatgttgaaatgtccatttgaagttgttaaaaatttttaaagacatgacttagaaattgcgacttagcaactaaagctgtgactttgaagtcaatttatactttaaagggaatctattatcagttaagttttcagatctcataaccaaattggaaatctgaagaagtcagaagttctaaaatgcagtgttttgaaaggacattgatatatagttgtgatattgtcttagcaacacatttttctttaaaagaagaatttcttcttgtattatcaatccttaaaatgggtcatgtattcttggaaaacagggtattcatgcaatctttaaaacaccgtctaaacttcaagtgaacttcaaacagcccaaaccaaatatatgctggataaagtgtattgtggttactggaaaactttaaaatatgaaacattcctattgctgttggtattttacctctgagaattttctagccaaagttctatttgaacagaggtcaaaaatcagttactgcgtgggcttttcttaagggatgaatttaatgaaagggcctagttattgcaacatatgctgccttcatttcaaaagatttccttaaagcataatgattaaagcctgtggagaaaaaaatttgtacttttcaaaagctccatgaagtaccccacagaaggaaaaacaaagttctgaatccacatatagaatgaataaatattccttttagcttaaaagtcataaaaatcattagttatttttgctcccttttattgaaagtgttttaagagttttaaaagaccagtgtacactgtatcaaatattcctgcttatttccaaagaaaagtgaactgctttattttgaatttttttttttctttacacagagtagggaagaattcaaatgttcagcaagtattcttaagcacctaagtcattgcactaaagtaratctcatttgatggctctcttaaggtggattctctagaaccaaagactgagagacacttttgggtacaaagagtttatctggaaggtgatgtcaacaagcaccagtacagcggggagaaatagagagaaggaaaggcagcaaggcagccaatatggtgtgagttaacaagcaggttactattgtggacaactggaagctaatcccactggagtattggggatgagaggttataacacagatcttactgttatcccacatgaggggcaagggagcagaggtagttatccaccaacaggttttgattgatggatgcatctggtttgtaagggagctctcccttgaaatgctctttcattcaaccactgctgctcatcccatacttgggcctactggacaccagcaagagtgcctttaggcagaaagcttcagttgtttgcctcgaaagtcatcgtaggaatgatgggaactcagaaaatattgccaggacactgactacatctgccacggtgaaaagctgtctctaaaatccaactacaaagtaaacaagtatttccccaaaagataaatgttaatagtaaaatacatatcagaaattatccaaactgtctagtaatcagaaattaaaacaggattaatccaaattgaggggtatttaattatcaaatttttataaaactgtgataaagcctaatatggcagggtactgttggtactaagaatattatttttaaaagccacttggcattgtgtttcaataggtaaatcaatgttcacatacactgacctaatgattaaatttctaggatataagtatgaaagaaacgaaataaaacttgaagagagtgacaatatcctatgtgtccacaaaaatagggaaatgattaagtagattatagtgtatgcaatcactgatatttttataatcaataagattagggttgttaaggtaagtattagcatgaaaataaatgcttatactgtaacaataagtagaaaaatgatgcacaaaagtatacatgcattccagttgcagctatcttatttttcaacagcattaaaaactactggaaggaaatacatccaaaaggctaatagtgattaaaatttactaccagtgtcaattacaatgttttatttgcaaggaacagaaaatccaactctcactggcttgagcaatgaaatatatttcttcatgtaactgtgtaactagaaagcccaagggttgggcttcaggtttgaaccagccagcagctcaaccaggtcattaaaggtctggttgtttctcttcactcttccttaatgtttgcttcatgccaaagcaggctgtcctcttggttgtcattttgatgccaacagaaactagaactagaaactagatgcttccatgctcacactgagggtcagaatgagggcttttatccctcaaccattgaacaaaatttcagaggtcatcttactatcagctacaagcctgtcggtgaacccaaaactgtggctgggggataagattggttgtaagcagatcagggcacccctctgcaacagtggtggagtcaattcccctctaagtctgtggcttccacccagtgaggaaggtagagagtgggtgaagaggagacaatgccaatatctacggtaatatatgaatatatataggtatatatgtcgtttttgcatgtgggtgcatatatgtaaagatacatatatacgaacacacccatcaacagaggaaacacaactgcacttaccacgctgattaatttttttatttactcattcagctgacacctactttgttccagacactatcttagagaccccagaaacaacaataaataagacagttaaggtccctgatctcacgcagctgacacctactttgttccagacactatcttagagaccccagaaacaacaataaataagacagttaaggtccctgatctcacggagctgaaatcccagtgaaggaagacaggcaataagcaaatgagttcatgatcaggaaaaatggtatgaagtaactaaagcaaggtgccagttggagtaaccrggtgtattttgttttcttttgagtggttagaggaggactctttgaggaggagacatttaagctgagatctgtatgaaaagaagagccatccaggcaaagatcaggggtctggagcacacagagaagaaagctcattagtacaaaagggctttaaagtcaaagtaatcctgggattttggagaaatcacaagtcctgtgaagcagagccatggtgtatgaaaagtggaatggaataaagagagtgtggaatggtatgtaggcaccaggtcatgtaaaactgtggagacaatggttggaatttgggtgtcatgcaaagagcaaggagactcatttgaatgtttttagtagaaaaagggaaatacctatttgtgttttttagaaatctgtttgggaggccaggcatggtggctcacgcctgtaatccctatcccagcactttgggaggctgggacagagggatgacttgaggtcaggagttcaagaccaacctagccaacatggtgacactccatctctaccaaaaagacaaaaattagatgggcgtggtgccacacacctgtgatcccagctactcgggaagctgaggcaggagaatcacttgaactcgggagacagaggctgcagtgagctgagatcatgccactgcattccagccggggtgaccaagtgagactccgtctcaaaaaaaaataataaataaaaaataaaggatctgtttgaggatggtttataagatggcttgtggagagacaacaggaaattcaggcctgtacttgtctaggcaagagatggtgacgacttgaactaaagagtaatagaggattgagaggaatggaaggcctgatgtatactgtgtggagataatgccctatgtcctactgatggagaaagtcatggaataaaggctaactcaattattttatgtgagcaactggtgggttgatgggctgtgaccaagatgaggaaaacgagggaagatttggaaagaaagggaagaactaagaacactttatggacatttaaagctcggggtgtctgttagtcattagggctgattacatatttgctggcacactccaaaagtgaaactgaggggcccttttccaaaaagcaatgggggaagtgccaataaagatactaaaatagaacacttttctttcttctgcaatctctctcttgactggtaatggtatttttttaaaaattactatttaatgtcattctaagtaaaaaaaaattaaaattgtttattacgagttttaacattcattcttacattgtgcaatgctattttcagcaaataaaatgccattttaatcatttaatttatatacagaatcacaaaaattatacaattcacatttcatagatagtacatgcctatgttttttgttcttatcaagatagaggaactactgtacaaaactagtatcattgtttttattttacttcttgatacatgaacaccctaccagccttctgtaccttcagcttacttatgagaaaggaaggactggaaagaaggggaactctgggttgttccatctttctcactttttctatgtcattatattcagtgtaatggttggctaatagaaataacacataatgattaggattattggtgtttcatgttttagaatgctatttctgcatttgaagcaagttctgattctaatggaaagcatgacttttcatagatgtgagaacctggagatgtaacacttttatcatgtagttggtttgagcctcattgaactctcattgtggatccatggacattctgtgcacccgagcattgcaaattcaatatgtgagcagggcagcaaagaacaatggacatgtatcttgcacatatctcctctgcttatgtgcattctccattgttcsatcagacttcagttacaaaacacaagctcaaagataaaatgatggagaatttcaggacaatgactgcagaacattaaactaagcatgggtccttctgagtactgggccctgtgtgactgcagaggcctcacactcatgaagctggccctgcattcatgtggaaatgtgtaaaaaatagatattgaagtcgggagagctggtgaaaggtcatttttggagatgtaggcttgggaattattagtatttatatatttaatatttagggcatagacagggtgagaccacctacagggagtgtgcagatgaagaaaatttctcagaaaagaatcctagacactccagtaacacaaaatgccgtggacctgaaaagtatattgagaaggaatggccagaaaagtaggaggatagcaggaaagtccaaaattctaaaacccattagaagacaatagttaaagtagagggatatgatcacttatcttgaaagctactgagatgtcaagcaagatgagaaaggaaatgtcattattggatttgccaacataggggtcattggtgaccttggtgaatacagcctctctagaaaaaggaggacaaacattcaagtgaatattcaggagataatgaatggtgagaaaggagacagcaatgttgacaactttttcaagaactttaactaggaaatggaacagagaaatggtgctgtgtttgccgaaggatggggtatcaagggaatgatgtcaatatgtttggcagyaattattttcaatgctgcatactattccattctctgaacctattgtaaactatatattcatgagtgtttagtatatacacatacctctgttttgcaaagcagtttgtcatgctactaccatcaacagggacaagaggtcccaattattcacattctaattcaaagtgtgagactctggccaaatgatccttctgacctctctgtaaaaagaccaagttctaaatgactttggctttcactttgatctctgttaatcaagatttactctgagctcccaaaggcataaagagctttttccttctggtttcttgcttctctccaagcaggactttggagtatcagtgggtgattacagtgatagtttccttcatggctttcaggccatgaacaaatgaaaacagaacaaaaggccaagaattccatgcttctgtaagtctgttatttcagggtaattacacatttacatttttgcagctagcagctgatggacattgtgcaaaagggaaaaaaagataaatgtagatttttttaaggttttctttatgactttgtttttaaagactactttgtgtttgaaacatacaaattagagctcaaaagtttccagcaattagtttacacagcaaaagagaaggaatcaaggccaaagaacaatcttatttaaaatgctgtggttggcctggcatagtggcttatgcctgtgatcccagcactttgggaggctgaggcaggcrgatcacctgaagtcaggagttcaagaccaaccaatatgggtgaaaccccatctctattaaaaatacaaaaattagccaggcatggtggcgagcacctgtaatcccagctactctggaggctgtggcaggggaattgcttgaagacaagaggcagaggttgcactgagccragatcatgccactgcactccagcctgggtgacagagcgagactccttctcaaaacaaaacaaaaaaatgctgtgtttaagaagagggtatctgaggatcatggaattttagtcacagaaaaaaacagaaatactaagtgtttattattcttaatcagtttcatcacatgtaggtcctgagtcaaggacttgaatgaaaatcgtttattttgaagaagttcccagggaacagcattagaagtatgtcgaagggaggaagggaagtgatgtagtcaataaaggatatgttatcaagccattactactgtgggcaaccagagtcaatcccactggaaactgggaggcatgatcaaatacaagcctcagagtttccccactggaggtgcaagggagctgggatatttatccaccaactttcttgagtcattggttgatggttgtttccaggagacatcaactctcttgcacttccagcctgttaggccttaagcaggctctggccatggaaaaatcacttcaacagaaaagatayaaaggctgatagttagaagtcgagtccaaattcaataagatggtaaagagagacacagctggggaatcaacagaggcctgtaatcggtatggaagggacaatagtcgttaaaacaaagctccctctgtacttgtttctgacactaatccaaatgaggacctccaattcccccttaggaaatcatccatttagtccaacccatagattggcttataaggacatggaggctcagtgatacttagtgacttgctcaagggtgcacagatgcagtagagaaattggacatcttgatgtattaatatgtgagtttgatgaacatgagtaaaatgtgtcttcaaatatttagacagagagaaagaaaatagctgtctgagacattcaagtgaagcatttcaaatggaaacttcttagcttatacttagccccagccagactcagaaacagatataggcactagactagacagcatcaacattccaacaggagttttcccttcaccgtggaagattattattgtgcccacagaaaatgtctgtgcatagacagagcccatatgactcttgcattttctttcctgacttagacataaatttggcaaaggagcatcatgcgaagtggacagaacgttccttttgtcctttgaactagacaagaatcaggcaatgaccctgccttagcactttatttagagatgaattcccccgctctagggttttggtggacaggtttatttcactgtaagtgggaaaattcctggctgtttctcacctcaccgaagagtgctaacagagggattcccattgatctgatttgtttgcactgtaaggctggattcaacttcagcgtgaaatcatcttgcaatctgaaataatcttgattggatttccgtttggattaacatcacgtaagagttgatatccactctaccatcagagattgtggtctatgctacttcttttgtccctttgtttwatataagtaacgagcttggagatgtaaatcagtcaccattttaaactgattgatcaaactcagtaagaaataaaaccttttcatggaactcactcagccttcaaacatttgcaaattaactaagtcataagtactctagaccaatttataaaaacacagttaaaatatctcaattaaaatcatacatactcacatgttcaaataaactgcaataagcttctataaaattgcttagaaaatataatttctgttttaaatttgtaaattatttcccaggtcatcaaattaataattgaaaaaaaccttctaataattggtgggtatttctgcctaattttcattaaaagtggtagtttagtctgtcctcctgaagcacttaacctgattttatatcttaataaaggaacactatttaggagtttggggactgtgctatgctgtgaaagccattccttggagcccatttttgttattgatgaaattcttccagtctgggatgaacaaactgtaaagccataaataaaagaccaaggagaagaaagacactctgatcagacattcctaattctaaatatagtttaagaatctgtctcctgttcattttagcaaaaggtttggagataacatttcacactgacatatttccatacaatcatttaaatttattatttccagtttttagtgtaaatatacatatacacatagtctctctttatatataaytaaaaatctaagctcatcctagaaatattttgggaatatgtattttataaagaaacagaatcagaatataatttgttactcatctctctttccaaaggcaacccaagttaatttcctggaatctctcctagtagtatttttaagcattcatttgtcttttatctagctggaattaagttaaatgtgggattgtgtttcatgccattgttttatattgtaagatattaaaacataatatttttaagttgtagccatcaatttaatgattaactacacaataattcatacattacctacatttctatgagtttttcaagtctacgtgtgatggtgagacctgcatttgagataaggggcaaaccgagtgcatggaaggaggtacagaggtaatattagagagctgaccttaatcctgtagagccaggtcatgaaaagggagtagagaacctcaagagaagagcagagggagaaagaatgtgagtttgacgacaagttgcattaataaaaaaccaacaatcaagtcatgtattatttgtagacatacaaaagataaatactttttaagagtcttgaggccggatgcggtggcccaagcctgtaatcccagcactttgggaggctgaggcgggcggatcacgaggttgggagatcgagaccatcctggctaacatggtgaaaccccgtctctattaaaaatacaaaaaaaaaaaaaaattagctgggcgtggtggcgggcacctgtaatcccagctactccggaggctgaggcaggagaatggcgtgaacccgggaggcggagcttgcagtgagccgaggtcgtgccactgcactccagcctgggcaacagagcgagaccctgtctcaaaaaaaaaaaaaaaaaaagaatcttgaaaataacaatgttgaatcataaaagcatttcacattttccttgatgaccttctaacttaagcaatcttaactggcaaaactaaaaaatcaaaatattaataattcccccacgatatgtgtcctagtttagtttataagtcttggcacttaagagatctaatgagaacttacatttaaaacatgttttaaaataaattttaaaagctagagataaatccatggacagtaaaccatgctagaggtaaatccatgggcaataaaccatgccagttctcttttctgtgctaattattagattatcaatgcctttatttttctcccctttctgtcttcctcttttgattttgttttcaatgttaaaatgccaaggcacttataatgcttcccatattaggttttcttctgaaaaccatttgtccttttctgtataccagattctcattataactgggtctgtgcgtgtgagctgtggagcctccacctttgtaaacaagcctaaaaaaattgcttctgtaactaataagcctgatgccttcagcccatagggatctctttcatctctgttctaataaaacttactagcaattaactcataatcctaacctctgtaagcctttgtaatttatttttggtatactcattcctttgtcttcactgcttaataccttattaagaataaggactatgcaaacttttgtgtgtgtctttcagacaccaacccagtatttggcacataatatacctgccattaattaatatttttgctgagtgagccaacttcctttggatgggcatgagataaccacttctgtataatacattctctccagggcaattaaagcagtttttcagtgtgtgaaggttgtaaatgatcaactctcaacagtccttgatcttttaaagcacaatgagtgaaggaaacaaagctgttgactcataaaaatgaattaataaaaagtaacctctcctaagtaagaaatggaatataaaggatgagtgttgagtgaccacaagggccataactggaagttgtgatggagaacacatgtgagttatttgcaagaagagtaaacatattaaagatgaaaagctctgtgcaaagaatagtcctaaccaatactgtttaaaggactatccagagtacagacgatagatggaattcttagggaaacagcctgtgcttgttcccccaattatttctctgggctttgtaaacactgcatatttagtgtttgtccattaccattcggggtcattacaaaagaactcagccttgacctggattcctgagaaataaattacagcttttcttattaccttccagtagaacttgaagcaataattcaaactctacgttaagtcatcatatatgatcacaagtgagtatgttaataacaaaatggatattcatatacagacccgagtaaatttctgatggcagtcacatcttgataggaataaatactgattcattacaaattacttaataaatgtacatctggattctcaagcattataacagatgatagaatattaatcttgtttgttttcagagcacttctttttctttaagttatacttgctgctatttacttcgccagaagactgattgcattattggccccaattcttcatcattactacctccctggatccatgcccttagacrtgtaactttataattgccttctactcagcaatgtgacacattgcaaatgagatgttggcaaatgtcacatmtacagagaaataaaaagcagttgtgcaattgggcttgctcttagggttgtcctctgacactgccatgagaaggataggcccaggctatccggccagaggaggaatcacatgggctagagctgagtatccacagttgtctcaaccaaggcaaccctagataagccaacagcaagtctaccttcacacatgtgagcaggctcagtcaaggcaagcacgaccatgcagtctacccatacaagcgtaagctaaacaactacttattgttccaagcctctacatgttgggttagttcgttacatggcattagtatgaaaatacctaactgatacaccttgatttctcaatattcaaatataattgcttcttattaatcctaagtatagaagcatatggacaatgactagaaagactttgagtaggtcccattcataggatgtgatatcaaattaaattaaaaatacaatgtatttttcccacaaaatgctgagaaagtttgaaccattctgtcttcatttttttttcctacactaagaaccaggtgactatagaagagtctagctggccttatattgggttctctaggattatgtatggagggagcatgccgtgccacaggggcccacatagggaagcaccaggatcatcaggagacagagggagcaaggggaaaaatgtgrgcaaggtcttttattgttgtttccacaggaacaaataggcaaggtaatgtaaggcaggcttaggattggcttgtttgaataatttcagcaggctctggggtgtaggagctctctctattgtctggtacctggccctgggtgatggagcagtagaatattggccctgagtatgacagcctaatgagaaggtggtgggtatgtgggctctggattggttagtttgtatatgacaggtgttgtccttgttcactgtctccaggaattagctagccctcagtggggcagtgcttccagtgtcagcgaactccaaactggggtggccccacatgtcaaagcatcaaaaatacagaaaataaaaaggcatgactaatacaaccttcccttcaaaaatacactcctaaggcaataatatattactgttcttagagagaaaagttaagggagttgcactgtacttaaagtcatgtagttacgctgtgataatgatacaatgaccacaaaaatctcaaaatatttttaaaggaatcctcagtcttatataaagtttgcagtgttaacttcttgctatactgtcctctttcgagggttttctttccaatgatcaacattgattgatgtaggaccttcttagcgttctgctaaatatgtgggaaaaatacatggcrtgtttcctgaatttgtggaatttttgcaggggaagcaataagagagaaatagaaggcaatgtgaacttaatatgctttaataatgatttactgcacaactactgggtgctaggcactatgataggtgctgggggatttcagtcaaatgccatttatgctttcaaggractcatagtttaatgagcacaaattatatgaaaacaaatgattgagctatggtgagcagtcaactctgttggaattagtcagaaagcttcagggaggagatcatcaaggtgggccttcaaggatgagtttgacacagggctgtaggtgacacttcgggcaaagggaactgtatgtgcaaaggcacagagtcaggaattaaagtgtcataagaagctacaaacatttcctttacaaccaggaactggggtgtgtgtgggaaagtggtaagacattaggctaatccagaagcaggttgtgatcaaggaggagctcaaagtctgtactaaggagttagggctttaccccactaacaataaggaacaattcatgagtcttaagcagagaaataatataaacaacctgcctgcttaaaaggttattcaggctttgctatgaaggactttaagttctctgagggtaggaattctatccatctttttcacaatctgtaccccagcacctagggcctggcacctaggatgtattcatgtagctgagaacgctgtgctacttaaatgttccaatgctcccccgtacttcctagttctctttgcagttagactggagccctgtgattagttctgtccagtggttataaccagaagtgacttggcgaccatttggatataggaggtgaaggtgaaaagtgaacctaggatgacatttgaaatcttgcttggggtggttcagaacaggttataaggaacaagtatgggacaattttggatgtcctgagttcaagatgactgtgagatgaagtttttaattagaatagagctaaatgttacaaggtttgacataggcaacagttactatgggaaatcaggaaggtaaagtattaaacatgtagcactttgtgggttctgctagagtgactcactatccaggtttgcccaggactgaggagtttcttgggatgcatgaaggactgtcaatgccaataccaagagagttccaggcaaaccaggatggttggtcatcctaagnctgctataccttaccacctgcaaagaatagctattgagtatttctactctgaattcagaagtttgtattcctccgaacctctgtatctcaactaccattcagttgtatggaaaatgaatccaaattggccagagtaggcaagaaagtataaattctgtaaaccagtgttgtgcgagaaccaattcacaccagctcacaagagctgattttactcatttcttcacaactctacatttgctgagtcatgcgaataggttgcagttggccatggtgggagaattgacactatggaaattagcaagttctacatattagagcttctctcccctatccccaaccccagaactggttgttaaacatttaccaggacacctctgccataagctgagttgaaaaggtttggaagacattatattgtggggatagcccaatgtagatgctattggtacctcaccctgcatccctttacctagggagtgcacttatcccccaggtgctgtgagtgttggcagctaacaactcacaggcacccctttttctaggaattgtcctcagccaacaggagttgccgtggctggaatacctgggaggtaacgccctacacccaatagtggcccgtagcccatgattgactcatagagtggtgtcaaaggtcaggctttttaccctaagttgggacagcaccgtggtaccrttcatactccagaactctccaggatcaggctgagaccagtctccagctgtaactacrtccttgcctagctgcctctgcttccctatattgcttcccttattccctcatctgtttcccctgagagcttctctcaatgaatccctgccttatgttcatattaataatagccaaaagtagaagcaacccaaatatccattgatggatgagtggataaacaaaatggagtatatccatacaatgtaatattatttggccttaaaaagaaaaattggctgggcgaggtggctcatgcctgtaatcccagaactttgggaggccaaggcaggcagatcacttgaggctaggagttccagaccagcctggcccacatggtgaractctttctctactaaaaatacaaaaaattagccggacatagtggcacatgcttgtaatcccagctacttgggaagcagaagcaggaggattgcttgaatccaggaggtggaagttgcagtgagccgagatcacaccgctgcactctagcctgggtgacagagtgagactccatctcaaaaaaaaaaaaaaagaaaaggaaaatgattctaacacatgctccaacattgatgaaccttacattgatgaaccttgaagatattatgctaagtaaagaaagcctgtcataaaaacacaaatactgtttgattccattcatatgatgcatatagagcagtcaaattcatagaaacagaaggtaggatggtggttgccaggggctagggagaggaaggaatgaggagtttttgtttaatgggtacagagtgtctattatgcagagtgaaaagagttctggggatggatactgtcaatgattgtacaacaacatggatgtctttaacactgctgaacttaaaaatggtaaaagtgataaattcttatgttatttctattttatcgcaattaaaaatacaaaataaaagacattaaatagtttttttaaaaaacataaaatacaaaataaataaattatttaaaaaccctcatcttaggctctgcttcaagggaatctaacctaacacagtcagcccaggagaatttctatggaatgaacatataatctccagtacatatgccatgtgctaacaaacacatgagagaactttatgatctgtgtgctttcgttgagcagagaacgtccctttgattcctgagcttactggaatatcattacgtaattctcccccatttcctgctgcatacctacaagtaatctcaaaaatgctttcaaggagagttttcaattttgcattttgaactttggatctgccttcatttaactaagtgagagaaggagaaacaaaattccagtgtattagcatgacatttaaggtggagaaatgtaggcagcaggcaatcatgtggagcagcggtttacagctgaattctaccatttgtagctacttaacatgctgaaccattcctctctgtctggaaaaatcataaaaaggggcccgtcagcactctgagtcactgctaagaagcttatgcagcctcacacctgcatttaaatgagtgtttccggggcaaaaatgaaggacctcagagaaatgaaacggagcactctagcagagaaaaacgatattggtttctgtctgcatttgtaaattaactacaagaagaacacttctagaattagtttaattattaatagaaatcgctttgaacaatttttttgcttcacattttattttaaatgaggacggtcatagaaggtttatcattaggtggcaaaatttgatcatattcaaaatgtaaagaaacagccactgataccaaggtatggtgcctcacacaaagtaggaattctgtacctatggggtgaactcatcaattacgtcaaactcaaacataggtttcaaaaccaggacttgtgcatacttcatctttagtttcttctttctcaaattttactgcttagtaaggtatagcttacatagagtacagtgagtaaattttaagtgttatgttttgactaatttacacaaacacacacacatacacacacacagacacacacacacacacacacacacgtggagcccccatccatattgmaatagagaatttctagtgccccagcaaccctccttaattacctccccaccaagagaccactactatagatcttcctaaattttcacgcttccatggaagaattgtttttccaagttggagcaggagtaatctagtcatagtatcccttgattcttatttcaagattctcttttttttttgagacagagtctcgctccgtcacccaggctggagtgcaatggcacgatctcggctcactgcaatctctgcctcccaggtttaagcgattctcctgcctcagcctccttagtagctgggactataggcgcccgccaccacacctgactaatttttgtatttttaatagagatgatgtttcaccatgttggtcaggctggtcttgatctcctgaccttgtgatccccctgcctcagcctccaaaagtgctgggatcacaggggtgagccaccacgcctggccctcaagattctctttagcccaacatgatcccaagaaatcattagtcttttactgcttaccctcagaagggatcacccttgcactgccctcattgggtgctcttgcccatgccatggccagggtctcattgtgatccttggagcttcggcttacttttggggggcaaaatgcttccaagactctcagtattatagctctaggtccatttctagatgcatgtcctaggtgctgaactaggtcttttcagacattccttacctgccagaggtaagactttctctgtgcatgtcctggagccagagccaccatgctgtcccataagctgcggtctgatggcagaggcagactccattgccaagactccagttcactgacccttaattgtgcacagctcagaagaggtcacagtttggctcagacttcttgaatagcttctrgaagaattgtttgaaatgagaagatgttggaaagaactagaaactcttctttcatgatctactccacacacatttcactccaataatactaaacagcttccagttcctggtctaccatatcggttcatgtctccctgtctttgatcacgttattaactctttttagaatatatcacgtttttacccctcttgacgtgatgctttttctttttccaagtctgagctgagatgtcatattctagaaccacaagttcagctaagtccctcttctctagggcctcatgctaatgagcttctttagcattgcttccactgtctcctaaatgtgaggtggtctctgctccttgccagctccaagtgaccaaatagtatctttttataaactcaaatgtagacactatctccatgaaatcttttcacctcttctccaatgaagcgctttgcttcttctctatgtatatttgacacttcattaatacccctcagtggtttttcatatttttatttttcccgttagattgtaaaacctccttcagaagagttttgtttgacattgaattccaatctactccagtgcccagctcattaccccagattcaataaatgctcgctgaatgaatgcatgcagagctgagtggataagcaagcctccttgattaatcacatcaattaaactgggtcaaagatgttttgttatattggttccattatctgactttyggaaaagcaatgtgacctacagagttgacatgcccttgatatggcaaaagatgagtttcatcctcaaatatcccattagcattttattttccctgcttagagtatatggttgacttattcctgtcacagacctaagtaactactaatattgagattttctctctaattcttctgacacttcttctttttcttttttatttatttattatggtttttttttttgcctaaaaagcgtcatctttctggatcacgtcaccgactctagcctttggctttctatccagggacatttttcacaaagaaacaaaactgtttagtgatggtagcagagttatcaacatggtaagtagggaaaaacgtatttgcatttaaaagcaaatcctggacctgtggcagagccaggcttgataattacgtcccttacattggccggcctgataaagcttggatattcacagtgacaagtagcaaccygctatagaccttagtggtcactcacaaataggaaaaaaatcttggaatgttaaattcgcagattagagaatccccttttcacattttctgcaaaatccattttgatgcaaattagattacagaaaatttaagattctcataaatgtacatcatatttctgttagtgacgttttacccttgcccctccacacctttgtgtttaggctcacacatttcaatttcaaaacccagaaccatggtattaattctaaartctgagctactaaagctggggccctcaagtaagtacaccatggaatctgcragatagaaattcctagcctcgcattttagtttaaaaagttttagtttgaaagtatgggggatgagctggtggcataagctrtataacaatgatatttttattaaatttgaaggcctaaaaatatcctgtagtaggggaaagtacttttacccaccataaatgttattaggtttgtgtaattgtgccaaaattgtaagggcaaaaatgatctgctttgctattgtctaaaactaacgccagcactatcaattaaaaaatatatatatatatatgatctcaaaaagggagatggtgtagaatctacttagctttgagcagtaccaacagagaattctcctaggactcatactaaatgagttgggttattattaattagtaggagttaaaacaattatcagatcatgtacagcactgttcttaatgcagcctgcctagggaccctgttaggagggtgtgtggccatttgactcttgctttctttatgtaatatcataatgacccaagctagggggattccaacaatgatatacagcagcttatacaaaaggggacttcatgtcattccaaagagtgaaagaaaaacaggaaagcagatgcgagagcaaaaccattccttactgaagacatcatgagtcctttgtttttctttttctattttctattgtcaagaatatttatattcatccaggcaagattgcatggggaggaatatcacagttgtacatttgttgccattgggttctggtttacaactgtcttgcctgagattataaattttcaggttaatgcagtactaatgcagaatttgttcatcctggaatttgtgtatatagcatattaagtaaatccaaagagacaagtagcatatgaggtaaggagtcctgggtttgagctttttctagtaaagtagccagagattgtagttagtaaacatttctgaatgttctacagtacataactgtaaaatagaatgataaatgaggtgacttaccaggccacttccaattttgaaattgtaagatttcattcagtctctcccaacccccaccaaaataaaaaacttgtgaaaccaagtctgtaccagactgacgtgtatcgaaactgtcactctggtgttgagataaatagccataactcttagttactgtaaaaaatagttgagagttatggaggatatgatttaatacatgcttattgaatatatacttcgtgtaaggctctgcactgggaattatagagaagttcaagtatatttaaaacacagcttcttacacagtacctggtctgaagaggcctccaggggaggtgggaagatgaaagaaataattttcaaaattattttggagaagggtagagtagctcaccatagtagtggtctgtctcttcaacaaatgacacttttaaattgctttgatttttgtttctaacttcttaaaaaatgtgtatgcaaccaggattcatattttattacttatatagccaatgttaggaactaaattgtgctcaccccatattcatatgttgaagccctaacccctaatgtgactttatttggagatagggactttaaagaggtcattaatgttaaatgaggtcataagggcaggaccctaatccaatgagactggtgtccttataagaggaaggacaccagtccctcatctaagaggaagaaacatctgagaagcatgtgcacagaaatgaggctgtgtgaggacacagcaagaaagcagctatctgcagaacaaggagagaggctgcaggagagaccaaacctgtccacaccttgatttttgacttccagcctccaaaactgaaagaaaatacaattctcctgtttcagctaccaagyatggtgttatggtgtggcagcccaagcaaactcatgtagctgatttcatgaactttcatgttttctgcactgtggcttttctgatgtttgtaattttccccattccctctccagtcacaaaactagaacacaatcttgggaaaggacacttgttcccacctcccatccccagcacaaaaatctwcaaacacatatcggacaagacaacccacattgggccagtgtcttgtgaggggtgtccgacatcatggtaagtcagcaagggggagagactgcacttctaaagtgtccagtacaggctccaagagcaggtggcatttgagctaggccaggttaattcccatcactgttttgtctttgggcttagttgtgcacttctctcattttatcagggtagacagaacgaagacatgaacaatgttttgaaactcactccttcattcattcaaccaataattgaacactgggcacagttctaggtgactgagttacatcggtgaccaaaacagactcatattctacctttggaatttacactctagtagcatgtggagaattagacagtccttgcctttgaaaaattcagcatcttgtggggagatggtccctgtcttaatctgtttgggctggtataacaaattactgtagattgggtggcttacaaacaacacaaatttatttcttacagtactagaggctgggaagtctaagatcaaggtgccagcagatttggggtctgatgagagcccacttcctggttcgtagacagaagrccatcttcttattgtgtcctcacatggtggaaggggtgaaggctctctctggggtcaatctctctcttttttttttttttttttttttgagacagagtcttgctctgtcacccagactggagtgcaatgatgcaatcacagctcatgcagcctcaaccttctgggctcaagcaatcctcccacctcagccttccaagtgactggggctacagatgtgtgccaccatgccaggctaatattttaatttttttgtaaggatgagaagtctcattatgttgcttaggttggtctcaaactcttggcctcaagtgatcctcccacctcagcctcccaaagggcagggattacaggcatgagccaccacagctggcccttgtggtctcttttacaagggtactaatcccattcatcaaggctctacccttatgacctaatcagctccccaaggcccctcctcctaatatcatcactttggtggttagaatttcaaaatatgaatttcgggtggggacataaacattcagttcattgtagtcccacttaaactgatggtttcaataatataataaatgtagagaaaaggaagcctgaacacggaactttgaaagggcctggtaggagcctgggaatgactcaactgagacatccttgaagaattcctgtttgttttttgtccagagagtgccaaggaaattcccagcacaatgtacctatgacaaattcggaagtcgtatgttgggaattaatcctgctttattttcatctcattatatgaatgtaaaatatataagaaatatcagttgggttaattttagctccttttatggaaatttaattatttatacaataaatttagttccttaaaatataaaatcgatgtcacctttttctttgctctttggtagtttttttttgttgttgttgttgctatttctattgctgctgtgacaaattaccacaaactcagtgacttaaaacaacacacatttattattttacagttttataggtcagaagtctgacgtagaggttacttggctaagatcaaggtgccagcaggtgcatttcttcctggaggccctgggggaaaatctgtttcctcaccttttccagcttcatagrccccttcctccaacttcaaaggcagcaagattaggctgagtccttctcatgctgacatgtctctggttctttcttcaaattccctcttccactctaaagggccctcttgattccattaggcctacctggataatccagaataatcctactttaattttttttttaagttctggggtccatgtgcaggacgtgcaggtttgttacataggtaaacatgtgccatggtcatttgctgcacctatcaacccatcacctaggtattaagcccagcatgcattagctatgtttcctaatgttctccctccccctccccgaccttccaacaggccccagtgtgttgttcccctccctgtgtccatgtgttctcattgttcagctcccacttataagcgagaacatgaggcgtttggttttctgttcctgcgttagtttgctgaggataatggcttccagctccatccatgtccctgcaaaggacatgatcttgttcctttttatggctgcatagtattccatggtgtataagatcagctgctagcatgcttaatttcatcttcaaccttaatactcacttgccatgtaacctaacacatccacaggtttccaggattaagacatagacaactttggggagccattattctgcctaccacatgggtttacttaatcaccagggagacaaagtagataataagcacaaagtagataataagcaaaagaagccaaaaaaacttctgtgtgtcctgcaacactaaagaacataaagaatcaaagagctttatttttcatctaactcagtttggtaagattccaatttagaagctaaggtaaaggaaaactgacttcctatggtacaatttaaattcagtataaattcagtgcttgcccaagtagaatgtccagctgtgggtacggagcaaaggtgtcagtaaactgtattcacacccagggcacttaagagacgttattttttgagacttgcaattgatatgctttgcactgtaggggccacgtgggaatttccacctgagaagcatttgttgttaagcacttttttcccctgtctttgcttcagattgtataccttccagggacagatatcagtattatacatagctctttgtatattttggggggtgactgagaaacatatttcattacatgtaacttgctggccatcccaaatattacagtaacaataaccggtacagcttgggtatcccatatctgaaatgctcaggaccagaagtgttttgaatttcaaatgttttcaggttttggaatacttgcatatacatcgtgagatatctcggaggatggaacccaagcccaaacaagaaattcacttatgttccatatacaccttatacatgtagcctgaaggtaattttatacactattttaaatagttttgtgcatgaaataaaggttttgtacattaaacaatcagaaagcaaatgtgtcactacactatctcaagcccatgtggccaatctttgaccactatcatccctgtctctgaatttatatgttactgatgagcaatcatcttcttacacttattcacacctaagtacytagtaaaaaaattgacaaaccattaatacagtaaaaaaaataatgtgttcaggataactaagcagcaaagtagcatcaccagattacttgtattttatcactattacccatagaggtatctgtaggcctttttgacattttcaacaatatctttacagagcagagaataagcaaaaagtaatgcatgcaggtcttggcttcatgtgggacatcatggggaacctattgttggcatttctggccagcatacgtgccattttattaattgttctgggcaatgcttacaggagggagtctggataagggcagaaaatatatattgcaactgaaggggcctgagagggtctttttttccccttggagaagccgaataaactgtgtgttgtgcacctgcattttgacggtgactcgtcacatgtgatcaggagtggaattttccactgtggcatcacatcatcactcaaaaagtttcagattttgaagcattcagattttggagttttggattcaggatgctcaatttgtatttctgtttttaatctarcagttacactgagggccaagactctatgttaaatgcccaccatatattatctgatttaaacatcacagtgatgctgcagggaaggccctgcagtggccattctcaatgctggctgcacattagggccccctgagcagctcatgagattccggaaacccaggctgcacccagtccagttaatcagaatctctgagggtgggatccaggcccctcattttttaaagcttccaggattttctatcacacagccagggttgagcctagattcatctgattccaagcccagatatttttgcctgctgagtaagtagtatagcccaggcctttccccatcttttgccccaactctctcactcacaggccctgccccccatatcttacacgcatacttagtttttaagagacagagtcttgctccgtcacccaggctggactgcagtggcaagatcatggctcactgcagcctcaacctcccaggttcaagcgatccttctgcttcagtctcccaagtagccaggactacctgcacaagccaccatgcccatctaatttgtgtgtgcgcgtgtgtgtgtgtgtgtgtatgtgtgaagacagggtcttgctctgtttcccaggctggccttcaactcctggcttcaagcaattctcctgacttagtctctcaaagtgctgggattacaagtgtgagccaccacacccagccccatgtaggcttttattcccagttacatttttgcccacaaaatgaaaattataaatttttgaagtccttagtataataccaatgataatctgacattgtttctactgaaaataaacattactgttattggcattttacttttgtttttattagattttttatttttatttttttaatggggtgagggaggtgtctttataagtaacagtgatagtaattttgcaatactaattttgataactaagaatgtatcattttatataccaggaattttatggactttgccttgcatgttttgtgacattttttcggggaagattctattatcaggaggaaactgaggcttactttctgcaaagacacagccctgacatttaagcccaaatctgtgttattttattttattttagaggcagaatcttgctctgttacccaggctagaatgcagtggtacaaacatagctcactgcagcctcaacctcctgggctcaagtgatcctccaccctcagcctcctaagtagctgagagtagagctgtgcaccaccattcccagttaatttaattttttgttatagacagggtcttgctatattgcccacgctggtcttgaacaccctgcctcaagcaatacttctggcctcaagcaatcctccacctcaacctcccgaagtgctaggactacaggcatgaaccctcatgcctagcccagatccatgttattttaggacatcagtttatagcttctgtttgatgtattctaaactcgaccgaaaataaaactctcttgagaaacttgttgccctcctgaaaattctgtctggaatgggacttagcaataggatttttaagtttggtccatggtgttcctgggctactccaccacgctacaatacattgccttcaatcagggcttctcaaacactcatgtgcttgcaagtcattggggatctggttaaaatgcagaacctgatgaagtaggttaggggcggtcctgagattctgcatccctacctagttcccaggagatgtgatgcttctggtccacaaaccacattttgagtagccacttagtgcctggtaacttaagttttctgagagcaaagttctgagagcactgttgattctccactcattgtagtgtctttttgcacattgacttgcaaaagctccttagtatatctttgaggaaaccaaaaaaaaaaaagcacttttaagacaatgacatcaatatgaactcagtgctttaagtgcattttataaatagcacagcagataaatcacctcttttagaaagaaaatatttaaccaagtgtaccttgtctccattagacactaagcacatctctaattcattcttagataacagagttccttacccaaattaggtgtttaaaaaggcatttcttaaaggaataaatcattttacaaacttttgaattgtttttaaattttgcatcccatattctaacaccgaggtgcctttttaaagatgcatctgtgaattttcattcaaaagtatatatagactacataacatatgcatcttaggtgtaatacaaagacatagaatatttaaaggcaattaatatgtctatacaaaatatttatttatttttttattatactttaagttttagggtacatgtgcacattgtgcaggttagttacatatgtatacatgtgccatgctggtacgctgcacccactaacttgtcatctagcattaggtatatctcccagtgctatccctcccccctccccccaccccacaacagtccccagagtgtgatattccgcttcctgtgtccatgtgatctcattgttcaattcccacctatgagcgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggagtcgccacactgacttccacaacggttgaactagtttacagtcccaccaacagtgtaaaagtgttcctatttctccacatcctctccagcacctgttgttccctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcacactgatggtagtttcttttgctgtgcagaagctctttagtttaattagatcccatttgtcaattttgtcttttgttgccattgcttttggtgttttggacatgaagtccttgcccatgcctatatcccgaatggtaatgcctaggttttcttctagggttttatggttttaggtctaacgtttaagtctttaatccatcttgaattgatttttgtataaggtgtaagaaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcttaggattgccttggcgatgcgggctctttttttggttccatatgaactttaaagtagttttttccaattctgtgaagaaagtcattggtagctttatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacgttgattttgtatcctgagactttgctgaagttgcttatcagcttaaggagattttgggctgagacaatggggttttctagatatacagtcatgtcgtctgcgaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggctttggtattagaatgatgctagcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgtcatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggcgtggagacttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtttaattgatccctttaccattatgtaatggccttctttgtctcttttgatctttgttggtttaaagtctgttttatcagaggttaggattgcaacccctgcctttttttgttttccatggcttggtagatcttcctccatccttttattttgagcctatgtgtgtctctgcacgtgagatgggtttcctgaatacagcacactgatgggccttgactctttatccaatttgccagtctgtgtcttttaattggagcatttagtccatttacatttaaagttaatattgttatgtgtgaatttgatcctgtcattatgatgttagctcgttattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgcagggtttctgctgagagatccgctgatagtctgataggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacggagatttggtcttttcacatagtcccatatttcttggaggctttgctcatttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtcagttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctctcagacagggacatttaagtctgcagaggttactgctgtctttttgtttgtctgtgccctgcccccagaggtggagcctacagaggcaggcaggcctccttgagctgtggtgggctccacccagttcgcgcttcccggctgctttgtttacctaakcaagcctgggcaatggcgggcgcccctcccccagcctcgctgccgccttgcagtttgatctcagactgctgtgctagcaaycagcgagactccgtgggcgtaggaccctccgagccaggtaagggatgtaatctcctggtgcgccgttttttaagcccgttggaaaagcgcagtattcgggtgggagtgacccgattttccaggtgccgtctgtcacccctttctttgactcagaaagggaactccctgaccccttgcgcttcccaagtgaggcaatgcctcgccctgcttcagctcgcgcacggtgcgcgcacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctccccctgtctatacaaaatataaggagcaaaagaagactgttaagaggctaaaaataacctaaacatgccaaagaagtagagagaaaattgagggtgtttttaacatttattttaagttcaggggtatatgcgcaggtttgttacataggtaaacttgtgtcatgggggtttgttaatacagatgatttcatctccgaggtattaagcctagtacccattagttatttttcttgatcctctttctcctcccaccctgcaccctctgataggtcccagtgtgtgttgtttccctctatgtgtctatgtgttctcattatttagctcccacttataagtgagaacgtgtgagttggtttttaatttatttccctgacttgtgatacccattgtgaaaatgtatattatgggtttaaaaataataatggtaataacagaaatgttaaaagctaacatttcttgagcactttctatgtgctaatttgtactgatcactgactgagcccttgtgtagatgaggaagtggaagagttgagtgactgcccccactagcatggctgtgatgtgcaaagccaggactcacccaggttattcattcctaaactagaacacctctgagcaagttttctttgcacttgagtaaagcagatggattaatgtttgctagaaagctaccagacattgatagagagccaagtttgcaatggaaaatttgtctaaacctgctagtgttaactggtatgatctccccttgttttgagaccaggcttgttctggaagtgttgcggctgttttcttctacagctctatcaatcccttcctctttccctcccttgcagcaccaacaccttcaccatcatcacccttttatctcttaggtcttgatggcttccacattttaggatatctgatggtcctccaatgtcacttaatgtattttccattgggcagcatcttctctagcctcagataagaattaaagttctctcatgagactagtttgaaaagctgaacctatgagacaaagtataattttccaatacccataatgatggatattctaaataaagaagagtatatgacaccaacaccaagttttttttttaatcaaaagcaaggttgactcttggtattcctagaatagaggcttttataacagaccttaaactgccttaatttaaagcaggtgtataaaatacaaaatggtatttaaagaggtgtagagatattaattaaaataggcttgctgaaatgccagggatatcatcacttctgaaaattgaattaagccctgaatgtcaatggtgaattaacatgaatagacttatctatccctgtccaaatatattttatccacaagctgtgtaatacacgatgattaaccagaggttacagattctagctgaaacccaatcaaattcttcagaatcctaattgaggaatgcattcaggtcaaagaatattaacagaaaagcctctgtcatttaaagggcaagcagagtgagtgcttaaaagtgttcaaaattttgcttaattgttctcttcttgagctattgttcttgatgatttagaaaacctgtgtgctgcaagtttaactgctttaattacagtgatgtcaaatacataggcctttctatttaaagggaktttaatttctgtggcttatgaaagagaaactgaaagcatagttaaaagtgaatatgttagttgagaaagttcctgttcttaccaagcaataaaattttcctaaatggatgtttgaaggagagctggtgttcagaggtgtggttcagttgaagctcctctggtagaagcccagcattttgtctgtctagtttttttgtccttagcattgcttacttttgtaaagccccagatatatataactcattgttaaagtatcacatggtttgtacagcaggatgatttgcattatatgaaggacaccgaaacacagaaaatgaaaggtctacggtgtatgacaaacaggacaaatgctctagcaaaaataaattctactttctctcaraattagcatacttgttatttaaagaaatgtgccagaagagaaatacaagattttcttttcttttttctcattgactttaactctctctgaatggcacctataactaaaaatacatctcgggaatcaagtaaccctcttttatatacatccctctaaatctatggctaagttcaatgtttaaggttgtcaaagtggctcccatccaaaatcgggttaacatttgcactttgcctaaagtgggactcctagataaaattcaaacgacctttctggtaatcccagcgtgtgggttttagcatcaccagctggctccaaatgggccactgctctctctacaaagaggagggagccttcaacacaggggccatgcttgtccattcaactgtgtctaaattcacagatcagtgtttctctcagtccctagaccagcaacatcagcatcccttgggaacttgttagaaatgcagagtctcaggccttgcctcaccgaatcagcacctctggggttggacctagcaatgtgtgttttaacaaatcctccaggtaattctgatgcacacctaagtttgagaaccacttttgtaaatgtgtgtttcaacttgacactaaccaataattctaccacttaacattaacagctttcaattttatgatcctttgtgttggacaggtcaaagtgggtgatttcaactgcttaatgggtacagaattttattttggggtgttaataatattttggaactagatagaggtggtggttgcacaaccttgtgaatgtactaaatgccactggattcttcactttaacaatgagtactattggccgggtgtggtggctcacgcctgtgatcccagcactttggaaggctgaggtaggtgtatcacatgaggccaggagtttgagatcaacctggccaacatggcgaaactctgtctctattgaaaacacaaaaattagctaggtatggtggcatgtgcctgtaatcctagctacttgggtggctgaggcatgagaatcccctgaacccgggaagtggaggttgcagtgagccaagatcataccactgcactccagcctgagtaacagagtgaggccctgtctcaaaaaaaaaaaaaaaaaaaaaaaaaaggttactttgatattttatgttatgtaaatttcaccttgtttttaaaaatatgtaatataaatgaaactcaagtgttttagatatgccagtctaaagaaatctgcaaattaaacaatttccaattcttaatcattcttattttgagtacatcctaattctttttttacacatatgatatgatgcattctaattatacaattactaaggtttcccaagtaaacatataaaacagagtatctgtaaagctgtgatttgagtgcttttcatggaaagtttctcattagaatttcttgatcagccaaacaacagttttcaactacaagcaaaacaagggaaagcattatttggttgtctgtcattgctagggtgaagactataaaagaggcaggaagagtaaaaaccaggcttttaaaattaaatttcaggcaatatcttatagtacctccaccctcatgttgggcaattcaagaggtctattcacattgcattgtatgaatagaattttatttcttttgaaatgtaatatagaatattttattttataatatgatctgaggatgcctcctggaattgtgcaacacaaaggtcttgggtgttgtcctttctgggtagagggtttgttagctactgaatatatttgttataaatatcactggggatttttttaagtaaatttattttttaaaaaaccctaatcctatgaagtttcactaaatgtaaaaaacataaatcaattaaggcttgaagtaacattttattttactgtataaccctgtaatcccacacacacacatctattatagacataatacattactatatagaatactggaaaatatcgtaaaatacattaaaaaaacartttcccttactctcagaactgagaagtaaaatctgttgtatcttgtgagagtatatatgtatgtgtgaacacatatcacacatatatagagtacagttaataacaaacagcatattccattttaaaacctattttcccttaccatatcagattttttttcttaacgagaaatattcttctacaatatcaatatcatttgaaggccatatagtatttccacttatagacgtagttcacttgattaattttgaattccccttaattgaacacacttaatacttcatttttctttaaaatataacaaccttacccctatattttgtgcttttgctgattacttgtcaaatatatttatttgtggtatctctttttatactagaaacatcaacctctttgtcaaattgttcttccagtttattgtatttttgttaattttgattttaacatgtattttatgtttggtgttttcttttttttttttttttttaaagaaaaaagctctcattcttttttaaaaaatagattcagggtatatgtgcagatttgttacatggacaagtttcataatgctgaggtttaggcttctagtgtacccaccacccaaaaagtgaatatcatatccaataggtaatttttcaacgttcactctcctctcatcctccccacatgaggagtccccagtgtctattattgtcatctttctgtccatgtgtacccatggtttarctctcgcttgtaagtgagaacatgtggtatatgattttctgtttctgagttatttcttttaggataatggcctccagcttcatccatttcatccattttactgcacaagacatgatttcattcttttcatggctgtgtagtattccacagtgcacatatagtacattttctttattcagttatccattgatgggcacttggcttgattccatgactttgctattgtaaacattttatgttcagtgttctctttcatagtgttgccttcctattccaatattatgtacaaattttcctatagtttcatcatcatggttttgttgtttacatttaacgctttatttgaacatcaatgtgatctgtgagatagtaaaaagacctaagtcaatttttccaaacagttaaaacatgtttttatcatttattaaataacacagtactttctccatggatttgcaaaataagattatccaaccaggagcataaacagagcaagttatttaacctctctgtgccttcatttcctcctctaaaagaagaaagccagtaacagcatctccctcaaaaaactgataaaaaaaaatccacaaggtgcctgacacggaataaacttcatcaatattatatgacaaccactagtatgattacaattattattagtgccctaatgctaccactagtatgattacaattattattagtgccctatctacccaactcaatatgctagtgtcttttttaggatatttacaattatatttgtaagtgagatggcctatgttgtctgtgcttacatcaattctgtcaggctttgaatgagggacttgatggcttcataaaattaaaaagttctgcatctgtttattttattactaaatgtagaatttatccttgttgtgatagattgacagaatttctctcaaacctttatgagccctaaacatttctttaaaacaacacttggaaaagtatttcaaggtctttcttaatttttgatctgttgttaaaaatttccctttcttttggatcagttttggtaattgctacaattctagaatgaattgttggggagcatgcctaaaagtagacaccaataagggagttgctctaacagtttaggcaggagatggttcccaattctaaatccatagctttccctaatatcgggcttgataaataacaacacagtaccccccatttataatgccaaaaccagggaattctcctgaatttctttctttcccttagcaccatttaccacagtcccacatcccattcctcagccaggcctgttgcctccatatccaaattacatccaacgcatccacttctctccatctccatagacctcacattagtccaacctccatgaaatagactcagttgaaatagcatcttaattggcttcctgcctccagttttgcacattggcagacaaagtgatcttccaaaaatataaattaaatcatttcactcccctgcattaaacctaatggacttcttttgtgtttcaaatagaaatctaaactccatccctctaagagcccttgtgacttggattagaatttgccctttgccccaaccacctcatcacagatcactgtgccgctctcttgctatgttccagcctctctggactctgtgttcctggagcaagccaatccgttcccaccccaaggtatcagcacctcctggaactttcttctcttctccagactttggtgtagcccctttttcttttatctaatgttcctaccccaatccactcattattttaccttaccccattttattttcatcattracttcttctctgaaatgttcttgttcattacagttgtgtgtttattgctcttctacctgtaagcattatatgcattatttacatgtgcctgacacatgttttgccttcattaaatatgtattgcatgaatgagtgagtgaatgaatggatatagtcagaatgattttaaaaatgaatagactgaggaatttaagaattagaatttttaaaagttagatataaaaatgatcccccaaactgatatgaggtaatgcttatgttaaatagcttgatttagccattccacagtgaatacatgtatcaagacatcatgttgtacaccatatatatatacaatttttactcgtccaacaatttttttaatgactagaatatacagggagctgggagtgtgtgctctatctctatgtacttgggtgtgattacaggatgtgtaaaatgtaragatcatcaagttgtgtacttaaaattaatgcattctgtgctctttaatgcatgcatgttatttctttaaaaaataaaaccataaatacatgtttaaaatagccagagagagcacaaaatttaaataatatgtgtaacttaaaagcttccatttttacatagtctaggacctaatatcacaggcaaatttaaaatttctttgaaaatgagctttgggattctgtaaagatttggggctctaccatgtggttgataaacaaaattactctctttactcaaggacctaaatggactttaaaatgagctggaaatcaactctggcttcaaggaaaagggtatacccacagggcaaacttgttttgcctcaaaacatactttatcatgtaacgtcccattcctcacccaaattagatagccttacattatcatgtgacatctgttaaataactcaaataagaaaatagttcctgatatttagataaggatacttagatttatagggtattttcctgcataagacactaatgacttttataaaatgtttcataaatgtgttttgtgaaaacacaaatatgagtcagctggcatagcaacatgcacagtgtagcaactcaaacattttctgaataaataaatgaaggaatgaggataagaaataaaaatattagaggtaattatttgggttccagatagagctttattttaattatagtttcttaaatttgaatgaattcactattttaccataatcagaagactgcagcaatcatcaattgcacaacagtgatggcctctgtaatttggcactattagctcctgaaatgtattgagatgtataaatataagcatcttaatcttttcaatataccctagcaaactggccctagcatccctagggctttcggagctaaggggaagttaaatgcccttctcttattccctgccaaaataagaaaaactttattgatttgaaagtgttaatttcctccaacttttcatatatgcagtaggcatgtcaacagagcaaaaatagtcttagctattggaaatgaggctacagattttattaggttggtgcaaaagtaattgcggtttttgtcattactttcaatggcagaagctgcaattacttttacatcaacctaatagattgacttatgtcataactatacatttcccaaaaatacaagacatggttcaaacattaatatttgtgacttagagcatcagaatgaggagattaaaagtttgaaaatgctccagcacttggatgaggcaagaatagtgaggtacagtttaagagagttaagaattaaaagtctttatgccaagctaaatgtgtccttcaaaagctgtgcatgttatgactgctggctccaacgcatctatctagtcagtctctgctattttaaccatcttttttctcttcaatttaccacctattattaggccaagaaaacttgagcatctgtcaagagtaaaaatattttgaagttttcttcaaacacactgaattccatgatttacacatggttctttttttaagagatgggagtcgtgctgtgtcaaccaggcttaagtgcagtggtgcgatcatagttcactgaaatctcaatctcctgggctcaagcaatcctcctgcctcggcccactatgtaggtggtcagccacctacaggtgtcagccaccatggccagcttcatacatgtgttctgaagcaacttttttgaaagcatggtatacacatcacaaagggtgcacaggtactttagggtgaatatctgtatttgcacaccaataaattaacccttctaatgtaaacaattcagtggtttttagtatatttagtatattcatagatgtaaaatgagcatcagtatataattttggaatgttttcatcactccaaaaagaaaccccctacccattaataagcattcttccctccttcctcttcccagaccctggtaaccatttacctttctgtctctatgtgtttaactattctagaaatttcatataaatggaatcatataaaattatgttggtgcaaaagtaattgatgtttttgcttgtgaaagtaatggccaaaactgcaatcacttttgcaccaacctaatacctggtatgtagtgactggcttctttcacttagcataatgttttcaaggttaatccatgttgtagcatataacagtacttcattgctgttaattgtcaaatattactcaattgcatgtatataccatatttgattttccattcatcagttgatagacatttggattgtttttattttttggctattatgaaaaatgctgctatgaactttcaggtataagcttttgtgtggacatgttttcatttctcrtaggtatatacctaagaatgtaattgctgggtcatatgatggctgtgtttaacatcttaaggarttgcaaactgttttccaaattggctatgacattttaccttcccaccagcagtttatttgataaattcctttcagatagaattcataaatattttctcccattctctttgttgtctttttaccttcttgatagtgtcctttgtagcacgaagtttttgttttttataaagttcaatttatctatattttattttgttacttgtcctcttggttatgtaagaaaccattgcctaacccaagatctcaatgacttatacctaggttttcttctaagatctttagagttttagctcttacatttaggtctatgataaatttcaagttgatttttgcatatagtgtgaggtaagggtccaagctcattatgataatgatgagaagttttattttaaataaacatattttaatgtatgaaatttgctaatttaaagaaaaatcttaaataaatggtaaactataaatatctaagaaatgtatctcttttcaggttttctaggaaaatcaacctaggatttatattagtaaggaaatttatacttaaaattttacttttatttattttactttttatttatagaaggtaaggatgaaatgatgaagtgggatagaggttgacacctatatatgtgccaagctctttgtgaatgtaaaattctattttaaggaaaaaaatattgtgttttgaaggctaagaaaacatgtatacaagaaactaaaatggtgccattgggcaccatcttctttaattcttagttttaaaattcagggaaatactttggttttgataagcttaagcctaagtgttgaaaaattcttaagtaaggtttaaaattaaaacgacatcagtaattgttaataaagggatcaccaaaaaaggcttcactatagtcagttcattcacatcaagttacctagtcagtctgggttgattaccttaaaatgtaagaagcctgtattatgactttattttaataataaaaaggtcctttcagttctaaaaacatggctatatcatgttttttacttcttgagcctataaaaacaatttctttataaggactaggataaccaggaggcctagtaatatcaactaaaaaacattttattgatgaaatagtttacagagttttattgaccgtgcaggaaacattcagggactcttcaatcaattctcttagtatttccagtggtagtttgagaacattcccttggcactgtttctatatctgcaaacttttaagagacgtattagctgggcatggtggttcatgcctgcagtcctagctactcgggaggctgaggcaggaagattgcttgagcccgggggatagagtctacagtgagctgtgatggtgccactgtactccagcttggatgatggagggagattctgtctctaaaaggataaataaaacaaactagagatatattcacctcaagttttctctgttgaaaaaccaactagcttttaaggaagtttgtaacttccttaaaaacagttagttggcctttctctgtgctccaaaagcatttatccctttgtcctaaaaggatctacgtattttcctcttctaccagatcattagaagcttgagggcaaagactgtgccacattcataaacataaccctggtatagaaaatggcaataaaggcataaagtttgttgaatgaataaaaaacacaaatgaaaaagtatgtttatggtattggtagagctcctggaacattcatttgcatataggtgaatcaattattgtaggagaggtcgcttcagtaaatgttcagagttttcctgggattctatgacrtaaagatccacaagtcagctttgaagaaggcagctctcaagccctcatctttgccgtccattggatggaggaagggtggcatagcaacaatggttgtttcactgcttaacccaactccctgtagtaaaattccagaggtttcaccaggaagtccaactacactctggtttacatattccatagggattaaatgtcctgtgctccataggtgcattggattatcgcgcatccactaaaccccatagatctgtagattaccttagacctttctgccccagttactgattgagccacatgtatcaggttgtttaggtttccatagcctcccctgtgctcttgagagcttaaagccccttccctagcagagcttcattacacaaaaatggaactaccaacctaattaatgacacagccatacttctttctataagaaggacattttctgaagtcaaatactctacccctgagctgtacccgcaagaaggacattttctgagacaatctgaagaaagtcaccatctgttaatgacttttcaggaagaatttggggttctaactagataaccacatttcagtgttacccttagacatggcccagcttaacacatgagtgagcagagacagatctggatgtgagatgtgtgggtgggtacaagcccattctgtttgctttatttttaatgataaagcagtagagcttggaactgtggatattggctctattgcatacatgaaatgtgtaaatgctcgtctctttatttatttaaaagaaaaaataatatgttgaaaggcaccacaagaagtgcccaatactgtccaataccatgctgaattcataatttcttctatgtataaggaattgtgtgccacacacttagcctaaacagcaatcatataaaatgacatcaatgaccacaactatcaattatgatatttttattcaagtgctcaggtattagagcataacaattgcagagccatttcagggttttctgggggtgatgagtttaacaatggacaacatttgggtactgaacttcagggacattagccgtgtctgttagcaactctgcaagttgcttttgctgtatttgaacttacaaggtacaaaatatacctcacaaggggaaattcagaagacagtctaataggtggctcccttctgtgctaatatgtgactttcaatccatgtcataagattcttataaaaggtttagcatttgtaagtcctcatgtatagattgaaaagaaactatcagcacaaattcccactgaaaagaaaacttgattcttagttgttttgaaaaatgattttatttttatatttttctcaatattatagtaaggaaatgagttcatggtcttgtaagcatttataaagtatataaaatgatgaagagaaaataaattcctgtaaattgaatatttttataatctcaaggtaaggaaagcttttttatacatggcaataaatcagaaaaattacagtgaaaatattgatagaaccaaatataaaaaaattaaatttctataggagaaaatgccacatcatttgacattaaaccaaatgatacatttgaaaaaaatattacaacatatatatcaggcaaagggtcaataaacacttaagcagcccaaaaaaaggttgtttataaatcaataagaaaataaatcctacttgaatagggggattatagccttaacaaactctttctactctaaaagacatgtgaatggccaataaataagaagatatatttccaataactagtcattttaaaacacaaataaaaacagtaacaagatattctattatttttcagcagactatcaaagataaaaaaaaattgtcaataacccatgttggtgatctcacatgctgtaggtacgataagttgaaatatcaatacctttggccctgcaattacacaccaggaatttatcctaagtaaattatcattcaagtattcaattatatatatatatacacacacatatacacatacacacacacccacacacagatgctcattgaagcattgtttataataataaaacctgtccaatgatgagaaatatgttaaataaattatggtgcatctatatagtagaatactacagaaccaaattaagagggaaatatatttctatatttataaatattttatcagtatatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaattaaaaattgtgttagccacatttcaagtattcaatagccatgtgtatctagtggctaccatattggacagctcagatttggaatagtcccagcatcaccaaaaatttctgttgacagcactggtctggaaagatgttctccaccatgtttttaatggttgcttctggctagtgggatctggagttaatttcatttaattttctaaattgcttgaactttttatgagcatgcaattaattcatattcagaaggttctgtcatctggaaaaaactcacctatgattccaccatgtagaaataagcattgttaatattatgttgtatttccttgcagtctttgttctaaatgctcatagttgcacagaatgacaatatgtacatgtttttaatgttgtatttatatctaatacaccataagcattgtatcttattctttaaagctcttcataaacattactttaaaaagctgcatactgttctgtctaatgtccttaaatgatttttgttatatatgttgccttgaatgtactaaaatatttaagaattttgcaaatcagttgggtttgggaaaatcaaatttatagggaagacagtgatttatagttcttttgttatatgtagaggaccatctaatacatcacgctttggagatgctttttttgttccaaatcactattcaaaaccaccttcacaaaacataatagctttagaaatcaatgtttttgataaagtgcctttattttcaagtatccactttccctactgaatgcaacaatgcacagacatctttgttattatccaccttctgagatttatccaaaatgtgtcacctctctttgaatccctttagaaaccattctttgatgaacatactttatttggctctcctggacaacattttgataaatataaaatgactttaacacaagaatcaaagggaaaaaaatttcagawttaaagaacaatgacctgaaatccatggaagaggagcacgtgtaacaaatttacttgacatcttgctctgcaagttgcttttgctgtatttgaacttctctccggaataaaactgaaatcaggggctttgtgttctataccataccctggtacataaaacctttccaattacatttatgttctcctaggagggatggccccaaaggcacctcagactttgcatatcaaaaaccaaactcataatcataatcataccctgtactcctccccaacagggtccttctccagatctccctgcctctcttgactacaactcctttctctcagttacgcagttcagaaaccgagggttgttactgacacctccatttcttcaaccccaaaactgaatccaacatcaagtcaagctgattttgcctcttacatatctctccaaatctgtcccccatattctagcaagtcacattccatccttcccccgtttaaagccatttggtggcttccccttgcttgagggcttagaatgccttgacaagaacaaaccttacttccttgcagaatctggctccttacctatacagcttcatttcacccaaccttctctactagcttttaattttctcatccttgctgctcttcctcctaccacaagaaatttgcataacatgctactccactgcctgaagtgcttcttactaaaccctccttcatctaagactcttctccatctttcaaatttcaactcatcatatgcttgtttagggaagccctctctgatttcattaattatgttagactcacctactaaactcttttgcacacattaatgaggctgtttgattaatttaatgcccgtttccttgccagaatgtaagcaccaccagggtgtaagcatctgtttttgttcactgatgtagctccattaactagcacagtgccagataaatagtaggtgctcaataaatatttgtttactggatgaataaagaccatgagacagatgcccccaagcacaaggaaaatgctgagtcttctacaaaagaatcttggagcactggtcaacagcagagcctctctaaagaaacagattcccccatgaggagaaagctgcataagtcatcaaactttatagtgaaatatcctaattacatttccctttgagttggactgtactgtatgtactgcactcagtattccccaagaatagtttgtatctgagatatagagcccaggaggctaggcccaacaggactattcttggggaatactcagagtggattctatttatgtatcccagagaaggcctaaggagagagatcttgaaagcattcatgatgcaatctcctgctgggaagaagaaagccagatgggagctaaaaattgatgccaataagagatttggagcaatgctgttcaaactgaggccttttcctgtttcccaggagcatagagtcatccttctactaagttttaagacttacagaccacctgtaaatgtaactggcagtgtgctgaagccagcttgtaccagttcatgagagccaattgttaaatgtttgctaaatttgctacagattgatacacacagccattatgataaattaaataatttaaacttaaagctaaataaattatactaaaaatgcaggtaatgaatactcaaaactcatcactttctaattattttattaaatgttatgattaagtatgattttgaggctatttatagtcttgtagctctatggtgaaattgtgtgctacttgatctttttttcaattctgaattcagtgagatcatcagggtggcttgaaattggctatgttgggagtatttacaccatggaaaacagtaaatgctaacattcggggatttggaggcttttgttgttgttgttttgggttttttggttttgttatttattgtttgttttgatttgttaaaagcctgttgttgaacatttaccggcataccacaagaggcaaccaattcatggcccaatgtaatctgtctttttgtacttcattgttgaaattacctagcaatactaggaaatcttaggtcgaagtggaattgtgaatcttccaatcgtctaaaccacatttcttctaaactacatttcacaaaaacatattgggtgggactcgtttgagaaaaaaaggytatatatatatctttttaatcccatatcatatactgctattttttaagtacctaagatagtgtttggtataaattaaccatatagaaaatatttgaataaattaattataggagtcaagaagtataataatttgagttaattcttgacaataggatgatttgaattctcttcatataaaatgggtggcattataattcatttcaaaatatttcatgcattaaatatcttcttaggaagatgcaagaacacttgacttcccagttttcaaaggattttaaaaatcctctgggaaaatattggttggggagagaaatgatggctgtgaagagggagatgaagagaaaaatgtgaaaaaagtgaacgagatttgagaacaaaaggaaaaaataattgcctaaaaattaatcagtgcaggccaacaactaaaagaagtgactaatgtcctgggaatatttactgcttttttgtaaaatttttttaaaattaagagagctttacactccttaaatttcctttctattccctatttagaattgtactggctgggtgcagtgtgtcacacctgtaatcccaacaccttaggcaggcagaggtgggaagatagcttgagcccagtggttcaagccctgcctgagcaacacagtgagaccccattttccacaaaaaggaaaaaaaaaaagttagaattgcactaacaattctggtgatagcttttacaatcatataacataactaacaatagacacaatcacataactcacaagacaatttttttcttattgaaaattgaggtcttagagatgacaactttggtcttcatgtataatgtgttttgatggatcaatagtaaggcattttagaagacattttcttactttcacctcaaaagaagcacacacacacacacaaaggcatattgaagacggggcttatttaaatgcaactagttattccttataaaagtagacatcaaaccttatcaaggctttgaattgttaagatctttatatccctgtgtttctgatggtatattattgatttttatgtattatagaatatagttaacccatgtgtatctagagtaacacaaaaggtatataaataaaacaaaggaaataaatctgaaaatcaaatagtatttactcttagaatatttttataactttcagcaaatacgtattcacatctatatttagctttatagataaattacccatttacttcaaactccttcagttacctgtagtgaactggtgggaaattttctcgctccttttaactcctacaatcatttataattttaagaagaaaaagaggccgggtgcggtggctcatgcctgggaagctgaggcagatggatcatgaggtcaggagtttgagaccagcctgaccaacatggtgaaaccccgtctctactaaaaatacaaaaattagccgggcgtggtggcatgtgcctgtaatcccagctactcaggaggctgaggcaggagaattgcttgaatccgggaggcggaggttgcagtgagccaagattgcaccacggcactccagcctgggcgacagagcaagactctgtctaaaaagaaaaaaaaaaagaaaaaaagaaaaagataagtatmagctaacatttatttcactgcattttttcatagcattcttaaaataagtaatcatgtcagactccacaaaaatgtattaattctttatgtacatgtgatacattagagtttgaggatttaattttgatcaccacactaatgatataaggtgaacagacattgctattatcattgttaaagctttgagaatatgagttgcctaatttacaaagctagttaaatggaagaaccaggaactgaaaagatctagaaatgacttgtcctttagcactctttaaattaagcttcccatggaaaaatgaattaagggaaaaacaaaattaaagtgcaaatgtttagaatataggtagtcaagtatacacaaaccatgaatatattcctaaatgtgcacacaaatatacatactgatcgacaaatctcaaagtaagtaaatggatatacatacatatactaaaatgttcttgtctctataagagattaaagtattcagtatgttccccccatattgtgtttcattttcatttgtagaacttttcagtgtctggttcttccatttaactagctttgaaaattaggcaacttgtattccctgagcttcaacttagttttccctcaaggtggatgataatagcaatgcctggtcaccttacagcattagtgtggtgatcaaaatcaaatctgcaaactctaatgtgtcacatgtacataaagaattaatatatttttgtggtgactgacatgattgattacttattttaagtatactaccagctattaattttttttcaagtactcacaacttgttatgtgcggctctcagcccttaacatataatgattcatttatttcccataataacctttttaaggggacactactattatcctcatcccacagtttggaaaactgaggcacagaatgattaacaaaattttttaagttcacatttcttcaaacgacagagccggaactcaaagccagacagaatgcaggctgtctggctgggcacggtggctcacacttgcaatcctagcattctgggaggcagagatggacagatcacttgaggccaggagtttgagaccagcctggccaacatagcaaaaactcaactctactaaaaatacaaaaattagccaggtctggtggtgtgcacctgtggtcccagctatttgggggctgaggcctaagaatcgcatgagcccaggaggtagaggctgcagtgaactcagattgcaccactgcactccagcctgggtgacagagaaactctgtcccctgcccccaccaaaaaaaaaaaaaaaaaaaaaagaaaagaaaagaaacagaatacaggctgtctgctgttttcctccatgtgtcaaaagctcacagcatagatgatggattttcttaacaaagggaacatcgtgtttgtcattattaataaattgtcatcctccttttttgatatgtttgattttaaattatgctctgaggttttagaagcccctttgacacatctaactatagcacagtaccatggaaggaagtagatatcattacaaaataggaaaacttaaatctcaccaataaagaactcatcaactagggagatgctgyggactcattgtaaaagtgtctgtgcattctattaacaaacaggcgtcattatgatagctagaagcattgaccttggatgaaagttgaggggaatataatgcttttcatgctttgtcgggggtttaaacaggaaggcacataggatcctaattgtctgctttgcacacaccattacccctcagggcatgtggattttttatgcattgcagtggtaagggctgtgcatacaaattttgctggcagacaggtggtagcatatgtcaaaaagactggggggatagtttaaaacatggctgaaaagttgtctatactttagaatttttaagtttgacaaatactgactcaatgaggaggaaaaagctaactactttttccattgactagttttcaaattgctatagttcatgcacttttattttcagcaaggatgattgtacaaataatgattaaaattgaccatttagcttcgactctttgctaggaaggcaagcacttccatgagaccacctttctttcctattttgatttctcatatgcattattttatatttttaacaaactgcctaaaatatcgctaaacaaggtaacttgaatgagtgctatttaagttttattctgccaattgaactatttgcactattttatataaactgcatcaaattggatatactttgtaacacggtgtgatatggagagggcttagagtttaccatcaggtgtacttggattcaaatctccctttacaccattttataaaactgagcaaattacttcatctttcagcacctcatgtgaaattggaataacaatagctatttctctgtgttagtttgcagattaaataggtggaagaagatacagaacagctggtgtggtagttgacacagtcactaattagaagaacttgttgttatatgtatcatttttatagagaactgaacagagtcagcactttgggaggccgaggcaggcggatcacgaggtcaagagatggagaccaccctagccaacatggtgaaaccgtctctactcaaaatacaaatttagggggtggttggtggcgcgtgcctgtagtcccagctactcgggaggctgaggcaggagaatcgcttgaaccagggaggaagaggttgcagtgagccaagatcacgccactgcattccagcctggtgacagagcaagactctgcctcaggaaaaaaaaaaaaaaagaatcttagtagcctatctgatgaaattctttcaattatagatcccatagaatacatgaagattaatcaatattgagataacatttccttatttcctataatcacttctttaatgttgtaacaggtgtattcaatccattgatattctattggctcactcacagaggttacctaaagagagttcccatatagtcctaagaatgttttccggctatggaaatgcaagagagcacaccaggaatgactgtccaccagtgatggatgagactgaacagataaatgctgcagtttccaggctacttagggacatcctaagatgtgttcttcattctgtctccaaatggcactagtgttttgagcctcagttgcccaaaatggtaaaccgctaaattaacacagtctttaaagaccttcttccctccttgtcttacttccccactcctcactgtgctttctgcaatcatctccaaaataaattacttgtcctcagatctttgacttgggtcagcttctggggcatccagacaaagatcctgtctgccaagcatgtgtattgcaacctgggaaactattagattggtgcaaaagtaattggggttttgccattacttttgcaccaacctaatagctcaggcaatgcaactttttgaaataggtaatagcagcattttcccagctctgaagctgtctctccacattctgagcccaattttcttggtccaaggactgtggatactttatttcaatcccattttctgcttcttctatggtcagcctgcctgaatgccctccagcagccccttatctttccttccttcctagctctcgaaactgcattaaaccagaccctgagcttgttcctggagatgaggaaaatctaggatgctatttagggatgctcctttaactttatttatctcttctctctgactgcttccaagaacaaccaaacttttagctccatgggaactccagggaacttttagcttctctgtttgtgaaccaggagaatattatctggatgatcgccttcgtgtttcttctaatttttttttgttttagacttaaatagtgtgttcactttagctcaatcaattcaagcctgacagcttcaaaccgctttatttcagatgaagatgcatggctaagctaattatattttctcttcttcatcaacagttttctatacttatacagwgactttataaattcatcattattccatcccaaaacaaatatgaatactcttgttatggtaatgccaytgcgggatatgaaagggcagtcctctaccagctcgtttttttcctagtatgtacccatagttgcttttctttgacatagtcagtctgttctccttctactccctctagttaaaaaaaaatagctaaaaaatatttaaagattttccatctgttacttgtgggaaagaaatacttaaacaagtaacatcctccgagtcttttgctctatttagaagaatattcacagcaccatatttcagagccatcattgatgcaagtggataggtgtttcctctataaaggcttgctggctgtgtgagccgcctaagccactggtacaccctggtgaacagaatgatagccttcatcacactcatatataaaagaaagaaaccttgaaaatgagaggtatgaggataagcattgattcaargggaatttgttagtctgtgttttattttctgagatgcaaatgttgaattcaagggtttgatgggaaaccagcctggacgtaaatttatacatttcctccacaatgaaatttgaataaagcatagcaagtcggctctgccttcaaagaaaaggtagctttatcactatgaagctgaatcacacgaatctcacttaagtataaggaatccatctctttcatttccaactgttgtactgagtgctactggaaagcctcttatatgcttgatgattgataggaatggatttgagttccatccatataactgtaattcagattgagaatattgcattaagtgcagggaatcaaattaacctacacaaatcattggataagcctacaatccaataaagatacatttcatgagtatgaaaaaatgagtaaggtatatcttctgcacgaaaaatgtttctggtatcaaaaataaaatctaaaggtcatgaagagatgttttattttstagatacttggcatgcaaataaaataacctttttaaaaagtggtattaaaaagtaaggattcaaaccagcatttaactctttttttaaatcatcctttagcctgtgtttattccttccattaattttgaatattttaaatgatataatgcagtaacacatgctgtaattgagtccttgcttcttaggtgtagaacagtctttactttcttcagtggccaattacctgaaaatgggaatcattaacatgagctttaacaagagcaaaactcaactttctttgcaacagacatgaagtaatttaatcacaaatcctgatgattgagagaaaatgaatttacttagtcagacagtctttatttggtagcacttatgggaacagaaatgatctagatttaactttaaaagtggaattcaattatagctgccaggattctgagttggtctggttaatttcagctrtggagatacatctaggatattctgcaggtatttacctacttgagtaggtaaatccttctctggaaacttcttaggaagttgagtctataagaaatactcagacataaagctccttggtagaataggtttgggagataaggtggtttgcatgcaagttgtctatcagtttgtgttattgttgctattttgattttatttgtttgtttctgaaacacagccacccatttcccaagaactgagaatgtcatactctggaaaacaaccactttttacacatctgttttcatcaaattccttctacctataaagtcctctaaaaacttgatgcatttgcagtttgtccgtccagacaatcccctctttgtgtattctctgaaagtctgaaaacaactgaggacaacttgaaggtacaagtgtctttctcggtctaccccttgcgtatcaatatgctcaacaaagagctgcattcaaaaatagatacgttattgagtacaggtcaaataaagagtgaacttgtttcttaaaggagaattctaacataatcaaggttagtgttgataaaaatgaaataaatgaagaaaagatacagttttaaagataaaatgaccagtgctggaaaagaaagcaaagcatagtttaaatcaatgtgctccatcaccgaaaaagsacgttagtaagaaacttggcttgttacatactttaaattctctgtttacattcagaactatayggttttaaaatattgtggtttcttctgagtaagtgtttctcaaatctaagtgttcctttagttcatacacagaaacctttttaaatttttttttcccaaatgttaaccatccagatgtagaatcatgtggtgagtcctcaaatacttacccttcagattcaatcagcagcatcattttaccagcctgtttcatccacctaattccagacatcacttctaaatacttcattataaatttctaattatataaagaccaatagtcttttaaaaaatataaaacacctgtaatcccagcactttgggaggctgaggtaggtgcattagctgaggtcaggagttcgagatcagcctggccaacatggagaaatcccgtctccactaaaaatacaaaacttagccgggcgtggtggcacacccctatagtcccagctactcgggaggctgaggcaggagaatcgcttgaacccaggaggtggaggttgcagtgagctgagatcacaccactgcacaccagcctgagcaacaaagcaagactccatctcaaaaaaaaaaaaaaaagaaaagatatatgagcaacaattactggggaaacttttcaaacaaagatttcagagagttggtcatgtttcttataaattcttagtggaaatcccagaagctcttttccagaattgttttctactctgagcacctactctgggtggtctttacttgcctygagttcctttatcytaaggatgattcaagagaatccctgacccccaaacctagtatctgcaattctgagaggtggcgatctttaaccaatcatctgtttatcaagttttgagcaaaagtattttgaatggacatgagaattaggcagtaaaataatgtagactgaacaaaaaatgcttgggggagaaaaaagccggagaatgagttgtgtggctatcactggaaggaaagaaagggtccaatgtatagatctgattcatctccaaatattttcccactaaagactgtggaagtaaatatattgatggactctgtaatcactgatttaaaangtgtgatttataattacaagtttcaggtgatttctgagaatgctttttctcttctgagtrtaccaaaaagaaccccacaaaattacaagtackaatatgttttctctttgaaccttgtctcaatggtgttcaaaaactttgatgcaattaatcaattcataaaacaccttgttatcaagtttaattagccttcacaaaacattcattcttcccgaacattctcctttaatctttcgttaatggtagagtgctaaatgtttcccttttttgctattattgtttatttaataaaacttttgatatagacctctccttttctgggtcatgcaaattgatgttttagtgatagcatttgatctttctaggaggcttgatgtacttgataaggtttcaacttgttagtgaaagtgagatttcagttatattaggcagagctttgaaatggggttttctttcttcataactttcctgaaaaggtgacttttcatgcagccaaacagagaaagttttattaactaaagagagaattaatggcaccaagtaaagtaactcagctggaaaggttttgtttgttttctttcttggttgtgtgtggtttatttaaacatctactatttttttaaacatctactatttagattttttttaaacatctactatttcttcataaggatgctgtatatcaaaacctccaaaaaggtcagaatagccagtctaagtaatcaggacctgttggcccagtatttagctaaataaataagaatgtaagtgtactcctggctcagaagctggccagcaaatttgctaagtgattgatttgatgctaattttctgcatggacttctcatttccttcagggcctgtcctatgggaggaaataacttcagccaagctgactgagccctattttaggtttcactttgagctttgaatgtttggaaaactccctttcccagcaggactacatctccaaaggatttccatttatgatgacccaaagaatgcaacttgctctaaaaagactgcagaagttccctatgtccaaatcccagtacattccgaggacagaactgaaatcaacatatgcatggcaggcactacgattttgctcacgctaattctgtgtctctttgcatcagtactgactgttggagcaggtctacgctgagagccagggctgtgtttcttccctagtcctacgtaggcattgtcatattttaatttcagaataaccaccttctttgtcttagtgcattcaggaattaaggagaagaatagagatttttcattgcaatacacaatttatgggatgattgaaggaaatagagaaccatgacacataaaaatgtgtgataggatcacagaaagagcacttaactgcaggctatagtcttgagccagaaattgtctctccactacctctgggcaagttgcttcatctctctaggccatttgtggaatgggagccttaaactcctacaattttctagtaagaataaaagcaactttgttttgaaatcattctaactcaacagaagttgaagttatgctatcacgttggaatctctagttatagactaattattttcaatatttattacccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggtatggtggatggaaattgctaaagcttatcatcatgatctgaatccttgagctatcatactaatgcctgcaaaagactgaatttttgtcatatttagcatgtgttaaaatttcacctaaaaataattcagctgccaagtataagtgcaattaaaatacttctaaataatggcatcaacttaagaattatggagatttttttcataaagaataagccatttggcygggcacggtggctcatgcctataatcccagcactttgggaggccgaggcggacagatcacttgaggtcaggagtttgagatgagcctggccaacatggtgaatccctgtctctactaaaaatacaaaattagctgggtgtggtggcgggcacctctaatcccagctaattgggaggctaaggcaggagaatcgcttgaacccaggaggtggaggttgcagtgagccaagatttgccactgcactccagcctgggtgacagagtgagactgtatctcaaaaaaaawaaawaaataaataaagagaataaggcatttgatatagtttctttgcataacaaaatacaaataaaaccacattctatttcatctaaacactttctcccaagtcattctctcttagcctcatccctatgccacttctaagtccgtgtcatttccagctctctcctaggggacagacatcttcagccctctttaaacttcttaatccctgggcagcaactagcccaccataatccatgtagtagttactcagttaatatgtagactaatgaaaaactaacagtttaaaataaaaattttagataataatgaaaataatattaagtaagaacaaataatatttattcaattacggattagaaagatgaattagatatggcccacccactgaggagctgccatttcactaggagcaagcctttcagatatttacaaaaatagctagaaaacaggtataatgtagcaaacaagaagctgtgaacatctaggacccctggattcaagtgcaatgctttctctagaaacgtccaattgtcattgaaagaatactgaaatgaacatatttaaagaagagctttctttttccatttttatagtttataaaatactagtgatagtccttctccttcatataacttccttcaagagttgagaatatgaatctaagaawactttgagttctgcrtataatatatgtgccttacagagcttctcatgtcatgcatcacaactacagggtcacttcatgtcagtgtgcattgtctaagtattgtgatctacaattttttaaccctcagtgctctggtgattttctgagctacaccagatgtgttggcctggttcctttctttcttttctttcttttctttcttttctttctttctttctttctttctttctttctttctttctttctctctctttcttttctttctttctttctctttcctttctttcctctcttctttcctttctttctctctttcttttctttctttcttctttctttctttctttctttctttctttctttctttctttctttctctttcttctttcctttctttcctctcttctttcctttctttcctttctttctttttctctctctctctttcttgtttttttttttgatggagtctcactctgtcgccaggttggagtgcaggtagtggctcctgcactccacttggctcacttcaacctctgcctcctgggttcaagccattctcctgcctcagcctgccgaatagctgggactacaggcgcatgccaccatgcccagytaatttttgtgtttttagtagagacggggtttcaccatattgaccaggatggtcttgattgtcctggtttctgtgtcattagtgattattggcagggatttatttctaacacttatgtaatattgactttaattcttataatgggatgcataaaatgccaaccagttttaatattctaatgtctttagaaactactctttccaagtatgttgtaaacagaatctactttctctctttataagccaagttacccatttatttctatagtatcatttatacttggagagatttcagttcaatgaacattgtctgtgtgacatatactttattttgctgtatatgaatggatagttggatggataaattaatacagaaaaaacagattctaagtgtttgcaaaatatttttaaaatatgtttccmcaaatgaactatattccttttataaaaagtgaccaatttatgggatgcactaaatctcaattaaaaacatgcaataaatggcagtggctttcagggaagcttttgctaagagtaaatatatttatattacacatcaatctgcatatcttaagttgcattaagcctttgtgcagtcctatctaaaatatatttaatttcctcttctctgtgggttcctagccactaattttccttagggatttttatctccaatccctgtaatattccctctcaggagtgcatctgtagagattttcccaggggctacttgatgttcccagtataattaatgaagctatggagaatattttgccttccctggctgtgatgttctatagagtattttcccccacactgaaagtgctcagccagaaacttaagatttgcaagtaccactgttaccttggagcatcacgtatcacagtcacacagggagcctgttaaaacacagattgttgggccccagccccagcaggtctgggatggagcctgagcatcttcatttctaactggtcccaggtgatgctaatgctgctggtccaggcaccacactttgacaatctcttccttagagaagcttgggcacagtgttgccagatcttgaattttcttctaaaaggagctgcaaaatccatgaaagrtgttaaatattggcaacagttgtttaaaaacaccatgtgaaccaaaaaaacattaactatggtctgagtaagacttgggagcttccatttggcagctttttggtctagattcacattaagtaagaaaaacattgtgctaaataaaacctcaggtcctgaccactgaatacaatgggggaagcacgtaacattatcttgcagagcagaatcagcactctccaccacatttgttcattctctaacttccaaaccattcctagagccctctgggtgcctaagaaatgtgaccttttagcacagcatttttcagtagacagagaaccatctgcccccttaatggtcattgtggaaatttttcagaagttttataataggccacttttttgtgacttagattggatcctattcttaaccacagcatctctcatcccctataaaggaaagagagacagaataatataaaaagaaaatnttttggatgtctccaggttccatttttaaacatgtaacttgaaaattagagaataagggagacaaatcatgcctttgggccaaatttaaaagtcaagaagaacacaatcactacacaatgtccttacaacactcaacccattaattcaacaaatgaaaaccaagcaaatgagaaattactcctggaggagacaaatatgggttttttttgttttttkttttttkttttttttttttttgcctgctgaaaaaggtaagactttgttgcaaataaaatatgttcccctgaaaggccataattttgactctttttgagaaggaactaagtggcacagaactcatactcatgagttctgtaatttgggccccaggaaggaacacagtaaacgggagagagcactagagaagatgtctataaatgagaaatgttagcaatactcttctgccaaatggatatgagccttcaagcccgttgacagtttgggtacattcttcatccataaaatgaagaacttggattcgttcactcatttattcaacaacattttgttaagccttctgcaatgtgccaagtcctattctagatactggagatcaagcagtgaagaaaacagataaagacccttgccgatgtggagcatacattctagtgtgggagacacaataagtaaaataaagaagtcagccacgcagtgtattaggaagagagtgatattgacaaaaatgagatagggatggagagtgcagtggaaaagggcattaaatagggtggtcagtgtagccatctctaggaagtgacacttaagcaaagactggaaggaggtgagggaataagtcaggaggatgtctggagagacagcactgcgcttgcactacagcaggtgcaaaagccctgaggcaaaagatagtctggtgtactttaggaacagccaagggcaagcgtgacagcagctgggtaagcaagattgagggaaggtagtagcagagggaactgaggaggcaactgcaactgattttgctgtaggatggcataggcttttgaaggactttggcttttactgtgagtgagatggaagccccgagagggtttcagctgaggacagatgtgatttgacttaacatttaatccataatggaccgcatgggggaggggaaataatggaagcaagcagattcgttaccaaactattgaaatatttaggtgagttgctaatgacttagaccaacgtggaatgtggaggaaataaaaaggaatccaaatttgcatgtatgtacacacacacacacacacacamacacacacacacacacacatattataaagaaggaagtgatggcatgtgtttatggattttatgttgcatgtgaaagaaagatgcatggaatcaaagacgatgttaaagttctggcccaagaggaaaagatagaaatatcatttactgacatagggaaaatataaaatagaatataattttttgtttagaagtatatagcagaagttcagttttggttacgttcagtttgagattattattaaatactcaaytgggtgattttgagtaggtagttggatatatgagcctggaggtgagtgccaaatataacacgtaaatttgggggtcattgggtatttgattgtattaaaaagtcatcatactttttaatgaagctggatgagatcagccaggaagtgactgtagatagagatgtccaagggctgaatcatggacagtccaacataaaaagaatcagaaaaacagaagctgagaggaggcagccagttaatgccatgctcatgggaactgagccagattatttaatgttttactgaaatgtagcatacacagaaaagtgcacagtttcttactccataccctgatggagttttgaaaaaggaatatatccacctaatcaacatccagatcaagaaacagagcataaccagcaccctagatatccaccctactaacacctctatatcggcagttaacatgatagattagtcttacctgtttttaaaatatctgtaaatgaaatcatacaataaagtctttttggtctgacttctattattcaacattatattatgagatttatgagattcttctatattttctgtgtaattgtagtttgtccattctctttgctaagtagtagccagtaatttacttacagttcatgggcattcttgtagttgtaagtttagggctgctacaaataatgatgctgcaaacatctgcctttcagagagctagatattggagtgtaatgactggtcatagatctttgtgtgtactgctttgatagatactgtccttttctcaaacttgttgagccattttgattttttaatattatttcacacataaaagaaaaatttatcagaggatctctgtaggttaaattattacattttgaagtagctgtcatgtcacagaagaaatgcgctctctaaaaatatgttatataaagtgaacattagtctttaatgtttgtaattttagattcttccccctctgtagctgtgagtatcttggagagtctaattcacttatttcaaggatatgagtgagattttctggaagttttcgttaacttcgtctatatcagtttcttgtgcacaatctagataacacaccagctctctgaatttcctaactagctctcacatctctttcctgctccccattcttcctgccatcttgttaagcccttgacaggtctcatggatagtcattacctacctatttcctgaaattctctcacactttgctctacaaatctgcctgctcatctgcataagaatggccttttaaaacaacaaactcattcctgatcatattttaaatcattttcattctctattacctgcaaaatgaagtttctgtgcatttagtgaacaaacatttattgagggcctagtatgtgccaagcacctcgctgggcactgaggattcatcagtgacccaacatagtccctaccctcaggtactgatgayccaccactttgactgttgcaccattctgttctagcagctcctaactacttgtgattcttctacctttacaattgtaatattaatgcctttataatatggtagtttcctagactgcctttctctcttttgtccaccaagaaaagtcctaggcctcccgagggactcagcatcaactcagttcatccatctctcgctctatctcatgacttccatgcatagcccattgttctttcatctgttgttctgtgaaccttgaacatattttcaattacagtcattacactgtaattatcaatcagtgtgtcttataatctatcctgtatttgcgagctgatgaaagtcaaaaacagtagtttagtctgttttgtgttcccaggatctagcttagtgcttggctcaataaatgcgagaggtgtgagagaggaaaggaagggaaaggaaaggaaggaaaggggaaggagaagggaaaggaaaaggaaaaggaaaaggggaggcttttgaactcttgaaaataagtgataggtcacgtacaatcttagagtcatagtggcttttaacaccatgtgctgcaatcttttcatttagagttgggagaaattaaggccccttagcagattggttgcttaaggcttttcctagaataattctctctccagcttgccaggattctcagtaggaggacccaggtggcattcattacgatggcttccatttycctaatcttttttcccaaagctaaccttattcccactcagagttactgtgactgtcacttccctacccagcagttactccacgctttcttaagcaaatgaaaaatagcttctatttaccaaatagttgacacctttcaggataaggaaatgagagaagatgtcacggagaggggaatttcttttaagcaaaagaaattatagtctatgggataaaggtgggaaatagaaaagaaagagggacaagtgaagggttctgctaaggccacctccgggccattcatcaaaaacttcaggaattttcttagagttgccctaaaataatagtattagctatttaaaagtgacctcaagagacatgaggttcttatatttatttttattctgggaacatrtgcattgaggtaagaattttgaaacacttgcgtatattctgtacaaaatgtgygctttatctcgtttctattttgaatttcaaacaaatttatgatgagtaagcagtagctgtaagtttgactttaaatgaaaaatgattaagaaaaaagaaaaggtggtgccataaattgtgttcagcaatttgttttgggacataatggaaaactgtgcatgacttccttgcaggtagaatacatgtgccaaaaagatcactgtttgcaaacatgaaaagttagatccatgttattgtgttttgtgagatcatcattacctgctattcctgaccttattatattaaaaaaaatgcctgtgtcatcttaggctattcttccacccaatcataaaaaggaccaaattcttactgtgtcaatacattgcactatttgtcttggaattttatactggtaggtgtcctttgttggagaatgagatttactctacattctgcacattttggatatgtgtcaggcaaatgaaggatgcacaacttaaacttttatattgtgaaaacatcgtctatctggaacatttgtttaaaagctcataagtcaaaagaaagacattcgtattaaaaagatttttattaaaaaaggggcaacttggatttcagtctctcccttacacacacagaagcagcagcaattgctattctggtgactgtggaagaaagcacccctgccttctgtctcctgggtgtcttttctgcatttgctagacaagaacttttttggagccagagagtgctcaatggtgcccacataaaaacaattaatgtcaaactgaagggaaaatgtcaacgctgagacatagaaatgactgtgatttcagactgtgggttactgttagtacaagcccacctctcccctgaaagagaaaacagaaaactgcatcarcaatagcatctcttctttccttccatccrctccattgcagagacaagctactcttctgcatacctccatctgcctaccttctgatgcctggcagctaagtaagccctgattgcattaccggtgtgcctagcctggaagcaagaacatgagcaccacaaaaaaaaaaaaaaaatcaccgtgactttttggaaggaagargagttctaagaaaatctggcttcyttgtttaaatttctccctccacatataaaatattggtgttggcaggggaatactgacatactttgagaaaggcargttgatctgtttcacctactaccttgatattggttgtcatctttagtagttaagccaaatgatgcccaatgaaaagctggcactaaggattaaaaatactttttgaaaataccttgctagtaattttcctgataactatattataattttcattcattcaacaaatatttacaggcataatcagccaatgaaaaggtgaaatcagaagagggaaattaaggaagatattacaagaaaatatctgagagctaaacaaaagtactggtcttaaagtctaaatagcaagtacaggaatggagtagattcaggtaatgagtaggaaactggaagatgacagataaatgaaaaagacttaatttttttctctccaaaaaaaagttaaagtagaagggtggggataaatgtaccagaaatgtattatccaaatataaaccatgctaaaacatgtaagattttcaaaaactgaaaaaagaacttaaaaagatamatatatacttgttattaggaatgttcccttcggaaagccatgtgggttatggtgttggaactgaaacaaataatctgatatattctaatatatggcctagcagaaaattatagttgcaatttcatactcatgtaaatttttattatatttgttttaaactttcagaatcaatttatatgcaaataaagtcataattatgaatgcggaacaagataaaaactgaccatttattttatttattgatttatttttgagacggagtctcgctctgtcgcccaggctggagtgcagtggcgccatctcggctcactgcaagctctgcctcctgggctcacccgccattctcctgcctcagcctcccgagtagctgggactacaggcacccgccaccatgcccggctaatttttgtatttttagtagagacggggtttcaccatgttagccaagatggtctcgatctcctgacctcacaatccgcccacctcggcctcccaaagtgctgggattacaggcgtgagccaccgcacccagccaaaaactgacaatttaaaagtgagtttaagctaacgagagttggaagtaaaaggaatggcaggtaaatgtcctcctatcataaaggagccaagggatactatttttaatgagtggatcaagagagtttgagtatgttgcttgagattgtagaggtgacagggaggaaagggcacaagtgatagaactctatcacaagcaaggagaaagggcaggtgagagatggaatcagagatttaaagcctcctcaatcagagcaggatattatagtcaaattctaaaatcagtcaaggaaaaacattatacacgcacacacgcacacacacatgaaaaaagcattacacacccatatatataaatagaaatgtgtaagtaaaccccagaaatttaagaatagaaatgctgaaaatwgttgtcaagaaacagaactaggacgtagaagtgatcattgcctttccaacccctctgaacaacttttaagaaactctgtctctgtttcatcgataaataatagttttttaggttactatcatttaacaagcatatattacacctgtcactggtctaacatgaattatcccaattctctcaaaagccctatgaaataaattctattattgcttccattttataagatatatgaatattggaggacaaatttaaaaagacttgtccaacatgattctgtctttgcatttggcctggagtaacagaaaaccaaatcaaacaatagctgagacaaattaaggatttttaatttgtgttttgttcagtttttcttttcttttctttttttctcatgtagccggaaccctgaaggtagtgttgtgggtgccactgcctggggtgggcattgtgggtggtaagagaatttaccaagacagtgataggtaaagaaaggcagatttattagagaaagtttgaagatatgttgcaaaggtgcagtgggcagcacagcagagaaggggctgtctgcaaagaggcagggattggagggaagtttcatagggtcatgatggaggggttatgtgcagaatgaggtcatgcttctggagttactgggactacgtgctgaaggagctatttgggaacagagtgttgtgccagcgggttgtctgtgattagccatctcagattgttctccccaacctagggccctttcctcattgttgcttacttatcttattaggactccacaggtggtttctggcactgattcaggagctcagggataacaaggctgagtgaggcccctatgattctcgtggcctttttctcatagatcgagatgcctctgtagctctagcctttccatttacattccctacagtaaaaggaaaagagatctatatcaggaaacacattttcccagaaccctccagcaggcatctgcttacatgtgatttgccatgtggcacatgttggtcacccagctgctaaggacattggaaaatggatatttttttttcagttgaacatattattggcctgagcactgttgggcctctgttaggcaagaaggataaaatagatatgagatagcatttggcagaaggtcccagctagaaaatggtagaattgtgttctgaaatccaataaattataaccatgataagctagaacaaggatctgcaatatgaaagtcaggaagagccattaaataaactgatatcaatattttacttttaaattagaagacaagaaaaaaaaaaaaaactgtgtttaagagtcactattccaaggccttcacaggcagtgagaatggtcaaagatggaacaatcaaggccaaagacaaagaatcgttcttatagcagaggaagaactaacgggattgagttaccaagggcaaaataccctcttcatttgaagagaagaatctagcttgcaaaaaggtttaaaataaagttggaaggtataattaaggtaatttaaaacaaatttatttccaaatgagaaaattatatttcagcagaattctgtcattaaattataagttaatgaggaactacctgtgcctcgttcactaatcagttttcaagtaatgcagttttaagwttgtcgaactgctttcataataagcagataagcagcatgcttaatgcccaagaattgcgattgctcccctttttctgtttcacatacatcttactaaggaaattagcagtgcttttttcttttaaaatccttttttatgtgatctcttcaaatggaattatttttgtaatgaacaacgatatcaattataattacagaccccgcttacatttattgtctatggtacacagcaccgaggcagatacaaccaaagtaataattaacactgagactgctaggattcaaaggcataatagcaagtgttttcataagaatgacatgagactgttggaagaatcatttcaggaatgtgagggattgacatgaaatccacaaaaatgaaactttgggggttctgtatatgagcacacaattagcattttctcagttgtacaaatgaataatgactcaggaaactaggaggagggaagggaggaggtctccccagtggatgctaagaatacacctgagactcccagtgatacagctgcagtcgtctcattgtgaaaacttcaacagaaacaaacatctctccgttcttctactctgtgccatggacgttgctctttgggggagttttaatttttcccgtggaagaattttctttaagttcattttcatttcatttcaccacgttaaacttttcccatttggcagaggaatgtcaagargactgggacatactagaactggcagcctgaactcttccttagagtatcaggataccatttagaasaatattgcttcacttacctgaaaaaaagatacttgaacaacagttcttcagaatacagcccaaaacatcaaccaaagcataataagtatgtctacatagccaacatagatgcccaaacccttacacaaaagcttctgtactttattaattggagagcttgctagtcccatgttatatccaggactcctaatgtttgtaaactattccagtatagttcacattacaacagaaatgcataaagccagtattacaagccctctagccaagaatggttattgaaacttataacaatagaggagatataaaaattaatttcaaaagacataaatcataaagcatggaagtcagtctctttcatttacacattcacttatgcagtcaactcagtgattatgaatctattacctattttataaaaaagaatgcgaggcagaactatgagatcccacataagttatgaaacaacacacaccctttccttccgtctgctttcccacaggactcctaggtaatgggcatatgccatgtttgctatactctcccctcttctggtcattgcttccttcccagatccaattacttggttgtcgtggacactgctaggttcttacctgattgattgttcaagaggtagaccaatcagacctttcccagcattcttgttactgaaaatggaggaattagccagaccttctctggtggtgaaagataccatatgtgacaactcttggtgaagttggtggccatggggaagaacccgtcagtaaggaaaagaaaaatgccctcaggaagagagcagagtaatagcaaycaagaaagcccttttgcattcagtctccaaattcctgatgatcatgtatttattataaatgcattttttggctgcagtttgtccagtttttccttcaattacaggaaacgacccattgcacttgatactttctcctatttcttaagttagtttgagttgtgcttttgtcagatgtagcttaaagacatttgaataacatgatctgaaaataattatgcatctttccttgatttgagtaatattattatgctagttgtcctaatcatgacaatattgagtcctaatatgtttcctagctttttgttagttgggtttttttgtaattatgtatgattggcaatcatttctcttttggtataagataaaaacgagagcactttgactatgatataagatccacagagaaactataccagaattttttccaaaattctagatgttcagtatagtatcaaaagtgcagtcagttatcagatagtcctttctgattttaacaaaaggctttccagctcctgtaccatctttcaccatgaaaagattcttcactgcgtcattaagacattaaatgctcagcaggatgaattctgatgcatgccagtagtgacagaaatgtgttcagccaggtgaggcaacactgactgaatcacacaatgttcctccttactcacatcacacactgccacccccttatgagtagaggtaatcagaatgacaccattatcaatgacagcaataggagtttgccaataaataaaaaacaaatataaaayattaaaaaataggacctttacatgtctcaccaatattaaaatatcttgtttaaaattattatatrtcccagtaacttttaaatattaattcaatagaggacgagataaatagtgaaacacagagaatttttagggcaatgaaactactctgtgtagttaaatctccccaactctttctaatgctgtacctttttctggcgtgaaactagcctctggtaaacatacaaaactgtatcttgccctcagttatagatacttttaccaatgcagaaagttggcatggagctagaaatgtctaaagcttggccatgagcctacaaaatattataccagaaacatatttttgaaaccagtggttattattcttagtttaaaattatctattttaaggaaaattgatttttaatttgttagatagttactgtgaaatgctcttctgtgtcggcataaagcttggtgagcaataattttgcttctctcttgcagctattctgtactgtctttttaagtcctcctccaacatatagagttcaaggtctcagtatttctcacctggactactggactattacagcttcctaactgagttacccttctttggattctcagcctcaaatccatccttgacctggctgccagataatctgtctgatatgcagcctagccctggcatcacattttttactaatttatctccagacacctaaatgctctttatcctctgaccacaactctagtttgttgtcgcaaccccctccctcttttctaattcctattagactactttttgtttgctctaactcctgccatgttagctcacctctagttcttttcccagttttctctgctcrggattccctcttttcttccccatcactctatgttccctgctcctccagttccatcytgaatgttactgtacacatgacagcgtattatcggtgccttaagtcaggaagcaaaaaaaagacaaatcaaacaaaagtagaaacaacaaaaaaacaggtggcaaagcaattaaactaaaagacattatttcactttgggaggctgaggcgggtggatcacgaggtcgggagatcgagaccatcctggctaacatggtgaaaccccgtctctactaaaaatacaaaaaatagccctctccctctccctctccctctccctctccctctccctttccctctccctctccctctccctctttctccctctccctctccccacggtctccctctccctctctttccacggtctccctctgatgccgagccaaagctggactgtactgccgccatctcggctcactgcaacctccctgcctgattctcctgcctcagcctgcccagtgcctgcgattgcaggcgcgtgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatktgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagtgaggagcccctctgcccggcagccaacctgtctgggaagtgaggagcgtctccgcccggcagccgccccgtccgggagggaggtgggggggtcagccccccgccctgccagccgccccgcccgggaggtgaggggcgcctctgcccggccgcccctactgggaagtgaggggcccctctgctcggccaccaccccgtctgggaggtgtacccaacagctcattgagaacgggccaggatgacaatggcggttttgtggaatagaaaggggggaaaggtggggaaaagattgagaaatcagatggttgccctgtctgtgtagaaagaggtagacatgggagacttttcattttgttctgtactaagaaaaattcttatcctgttgatctgtaaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacataaacactgcagggtcctctgcctaggaaaaccagagacctttgttcacttgtttatctgctgaccttccctccactattgtcctatgaccctgccaaatccccctctgtgagaaacacccaagaatgatcaataaaaaaaaataaaaaaaataaagacattatttcattgaagagggagccaagtcaactacaacaatatcagatgatgacctaggtcttgtgtcatcttctcttggagaattttgtaggggtttcagcccagaatgtgttgtgtgtttcaaataatcacgcagaatggaacttctatatttttttgtagacttgctcttttccattatcttggaagcctagtgagatcattgctttctggtatgaggtagggattatgattaggagattagtgagatattgacagtgttgggagaagggagaatattgcatattatgtggccttgtgactacatggtatggagaatttctagaactgtagttaacagttaaagataccagatatagctgctttggcatgagtagtagagcaggaagattatgtttgcatgttctgctggaaacatatttgatcatattttaaatttttaatgactctttatctgtttataattcaaggaaatagtaaaatgtgcttagttattgaagggaaacagagcaattttctatttatacaaattttaaaaagcagaaaaacctttatgtacaaagaacatctcctttggaaaagagtagtctctcagggacttgaatttacttatgtcatttttacccaaaaaagggataataatacaaaacaaaacaaaaaacctttggcatgcacattgaactaatgtgtcttcctggaagccaagctaaaagcatgtgtctaatgactgtgcagtatttaagctaatgcaagtgttatttacatttttcaggaatggacaaatgaggttttcagtttggcaacaaacctgctggcccaaaacatgtccagggatgcatttctggaaaaagcgtaagtcactctaattttattrctaagggckttgcttcttctgagtcagtttcctttctcctttgtgagtcttcygtttatgccatactgacttctcacattgataaacacaaattttcctttgggatttattagagaactgatacctcccctgttcagaattggaagacttccaagaaagattgctctttcctccaagctgcacatctgtgttacacctgggctaagttcgcatgaatgtcagtgcttttgacacacaacaaagagacacttccaaatcctggcagctgtgctcagaactaaaaattattaatttcagataatcctctgcttctacatctgtgtgtgtcctctcaattattaatctgaggaacagcatatgttcctcatttctgtagagttatagatagatgctacaatacctttcctgactacttaaatcaataggctgacatcctgattccatcccatgtagatgatcccagcaagtattagtaagaaaagagaaaggatctaaaggaaagagaagaaggaaaataaggaaagaaaagcaaaacaaattgccagatcactctggaattgccacagcccttctaaaaattgtttgaccaaggaaaataatgacttaggcaagatgagcagcaaggaaagctggttgtgttcattttggaagctgtggttggtcaggaggttaggaagtctttaaatcaaaaccacaagtagaaacattaataggtggtcctctattttgtttaacagagttctgtcttccctcttcttatgtaagacatacccatcattccagacctaatayctcagccacattcctttattttactcttctatgaattccttttgcttttagtcaatacctcaggtcttcatttaagggcttttttatgggatcgcctcctctcctgagtttgttaacttaaggactcttccttcatgcctccacctcttcccttcctttcttcctctatgtttttaccttgtctttgattttatcatccttcttctagaatatgttttccagacaatgtttctagaacattcattcttccatgaaatgttagtgaaaggggacacagaggtaaataacatgttttatctgaaacatagcatgttattgctagttggctaatcaatctctactacaaatgtctattccagaaagatgtctccctatgaatagctactatggacatgtcttttagtgaacatattgttaatatttttgttgcacacatctagctttgggattgctgggccttagygtgtgcagcttcctgaagtagaattcccaatgtatgcatccatcaacagtgacctagagttctcattctgagaatgaatatataagcaaacaataagyaaaatatggttarttctcagaaacatgctattgagtgaaagaagccaaacacaagagtatgattccttcatgtaaggtgcaaaaacaggcaaaagtaatctatgctatttgtagtcaggataacagttccctttggcagggcgtttgggaagggcttctggaatgctgctaaagtgacaatgttctatttcttaatctgggtgccaactgtggagacttgggcagtttgtggaaattcagcaaaatgtacaaaggcatgggcttttttgagtgtattttattgttcaagaaaaaaaagcttttttaaaaaaatcaaacccttgtttttctgcttctccaacagctatactaaacttaagctgcaagtcactccagaagggcgtattcctctcaaaaagtaagctttgtgagcatttctcattattcattttattttcctcaaagatctgaatccatgccatggctctgttttgtttctccagcagcctaagtgggagtgtggaaatgcgtggtagccctgtcctccctcacacatgtctcatgtcagtgcagctgctttcctcatagacgtctccccggggcttccctttcctctggcattattttcaagaaataccaaagcaggaagtgggtggaggaagtggagggacccttgctactaaggccgaaaggccatctgagattcagatctgttctaggagtggaaattggccgacctcagtgcctctttctaccaagatggctgtagccctcaagcagggtttgcaacctcagatgctaactggagccaggcagggaatgtaaatgatgaaacaggtcaggaggaggaggaaaaactaaagagcaaaccctgtctaaaggagacaacagctcatctccaccatatatcctgtgggactggtgagcacctgacactagattgtctaatgtctttatagaacccataaacctaaattagtatattaaattgtccagtacttaagttctatttttaaatcaaattagtaacgaaaaaaagtccatctctaggtcatatccagccaaaagtctttaacttttgacttacaagctactagaaagcttctgcgaatacacaaattaagccaagcacagtggctcatgcctgtaatcccagcactttgaaaggccaaggcagaaggattgcttaaggccaggattttgagagcagcctaggcaacatagtgagactctatctttgcaaaaatttttaaaaattagccaggtgtggtggcacatgcctgtagttctaactactagggaggctgaggtgggaggatcacttgagcatgggaagtggagactgcagtaagctgggatcatgccactgcactccagcctgggcaacaatgtgagaccctgtctctaaaaaaaaaaaagaaagaaagaaagaaaagaaaagaaattaatttaaaagtaaacaaattaaaaattaaatttatwaatgcaatgtacaccttggggcaatgggtagtagcagcaaggggacagaattaataaggatgtttattttagtgcttaatattagagattatttaatgcaatattttttaattgggtcagcaccataatcctaaaataytgattttatactagacaccttaattttaaaagcacncagttgatctttcagaagacagatgcaaatgcatggaggaatggttatcttttagttctttaaatatgaataataaatagatttgactgaatggaatattttgagttggcatcatctgttagtgctgtgatccatgtgccatttaaacctctctcctttgttgtgttcacttcacagcatatatcgcttgttttcagcagatcggaagcgagttgaaactgctttagaggcttgtagtcttccatcttcaagggtgagcatgtgtgttatgctatagtttgaatgttcagcccctccaaaactcatgttgaaacttaatccccaatatgacagttttgagaggtagggcctttaagaggaaattaagagcttccatgattaatgggttaatgaattaatggattatcatsggagaggaactggtggctttataagaagagaaaaacagacctgagctagcatgttcttccccctcaccatctgattccctgtgccacctctgccaaagtggagagtccccactagcaagaagacttttgccagatgtgccctctccaccttggacttcccagcctttgtaactgtaggaaatacattttgattcctatatattatacagtttcaagtattctgctatatgcrtcagaaaacagagtaagactgaaaattggtaccaagaggtggggtttttgctgataacaaatatctgaaaatgtagaagcagctttggaactgggtaatgaacagaggctgaaaaaartttatagagctagctagaaacagccaagacttggtgaggcctcttttcactcctataaccccagtatttcaatctagaatgacccttgmtttttgtagataaaaaagtcacctaatcaggtaatatttttaaaatagtcaaaaaaggctaacattatcaagatgacaatttgaaatgtggtttcaaacttattaacaataaacccttcttgatgttttttttaagatattagctaatgatagtgttgagttaggaggcgagactcaactctggtggtggggtatgaacaccggaccaaattaaggaccagctaaaacagggggagcggaagcagctttccmtaagatatgtccatgtcagtttaccattgccagggcaacaccgaggaattaccaccgctttccacggtaatgatccaatgacccaaaaattgccactcctatcatagaaatttctgtattaaccaccccttaatctacatgtgattaaaagtaagtataaatacaacctcaaaactgcctgagctgctactctgagcacactrcctatggagtagccctgctctgcgggaacaggcatggagctgtaacactgctgcctcagtaaagttattttcttctaccctaccactggctcgtccttgaattctttcctgagtgaagccaagaaccctcgcaggctaagccctactttggggctttccagccctggatcagtgtgaagccgttatgtttaggaagatatttgaaatattaatttcatctcaccttagcattttaaaatgtttagttttaagatgtataagctatgtaagcaattagtatgctgctatgtgcttataaataaatatatttacatactttacagagctgtgctcagaaagtttttactgagggggtgcaggatctaaacagtttggatctaaacacctactttgctcatacggtggtaaagtaggtgagaggacaagcatgtaacatgctttcatttttatgcctgacacacacaaggtacatcatatacrttaaccacctcaaataaaataatttgctttcattttgattcatttctacatgactggctctaaaatgatttgttactattgtttctggaagtccattgcataaaatttttttctcgtgcagagctctcctttcattatttttatctgagtatctaagcaacaaggaagcctttacctaagggtaacatgactttataggaagaacctttgagcccctcaaaatgtgccagcaatgttcaagttgcactgaataagtttgcaaagccattcttagacttatgattgaattataaaagtattgagtgctatggttaaatttatcagccaattattgttgtgaagacttttcaaaacagcaaagttcattaacaactttggtgggtcacaagaaagaaataagagcacctcttcactatcacctttcttctataggtggaaaaagctaatgaggctgcgaaaagtgagcagagctgtggaaaggctcccccaaaacattttcaccttcattttataaagcaaaataaaatgcttgaacctgcttgctattgcttttttgttagatgctttggaataggaaaaatataacaattaaggtcctgtccccgacttcaacaaatatttcttgagctcttactatgtgcccataggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatttaacttatgaatctagctaagggaaagaaggaatagaaaattaaatgtatgaaccaattccccgtaaattgtaattttctaaacaactggattctgagcagtcaataaatacacattgagtaatctactatgtttattatatgttcaaactttcagaccaatgtcaaytgcaggcaaatttaaaaggaaaatgagattcaaataacatgagttatgtttaaattagaaaaaattatctctaacaaattaaatgtaatgataattatctgaagttggagaaaactttaaaaaacctctatgctaaaactttgaaaaattattattcatagtaaagtataatttacttggatgacttatagaattagaatgctttttaaaaatctaaaaaccaaagactgtttcagagctaggaaataaatgtttctgtgaactgactatgaygtatcaaaactctgttttaaatctctgtgataatttcattcctacataacaatgactctagaaaatatccactaattagcaaaaaattttggccatattcacaagaggtattttaaacaagccacggaagaaaagggttatataaatcatagttggttctgcrtaaatgggagcatattttgtagccaagtcatttaagctagatttaattgtgctctgtaaatagatatattaccagaaacacagtggatgtcctgttgagatttctttttaaaacatgatattactgcacattgttrgggataaataaggcacttgaacttgtatcctggcygacgtgatccactagaataacatattcctttagaagatgctactctttagaaatcacagttgctagcctgaagttaccctaattgttaaaaggtagtactgtatccaaagagagagacaaagcaattactgtccttctgttaacaacccaagcatattttccagtgagacccttgaaaactgttccgtgttcaaaaaattaccactttacccacaaactttctgagaactgaaaatagtttatttgcaccaaattcccttgatttaaggcttattaacttgaaaagagctcagtgacatytggaattgtataatagtcttgccacagcactggcatacggagttgcattttaacgaagaagatcaggaataaacccatgtatttgtttcaaataataaagtttactgtagttgrtgggcacacatgtaatacaaagagaaattaattattttaaatttgaagaattgtataaattttactaaatactatgaataaaatgtataaaataacttctgtgtgtaacttattagtatgttgcctttcttctgtgccttacatcctgaatataaatcagaagcaatcacttttgtagttgtgattcttaatatgactaatatcaaaattctactttaaaaccaaattaagtattccgttcattatgagtgatttacttgtagttatttcatgtattccatggctaattcaatgttttatttatagtttcagaataaaaatattgacagtatattgaatttctgaatttactgggaaattgtccatcaacttgtcaagaaaaacaagtctatatgtggactttattcattagagtctgcttcagtgaattaatatattttaaaataacattttttctgatttttttccraaatttaagtacccatttctcatataattattttttaaatcaagaaatatataacgaagaaaatgcagaccaccgtcccaaaactaataggaatatttagtgtactggtttacagtataaggtatagaattaagcaactcagattcaaaatatagtcattgtgacctcatcacacccatttgctcaacccaggaccttagacaagttttgtaacctcctagcacttgtgtgttcctatctataaaagtagtacagtaataatgccaactgcatagagttgatgggattacatgaaaatattcaagtaaagctcatagaactatgtttgatatactgtaaatgctaattattattctcattttgagtatttttcatatgcatatattggggggatcttgtttttatttttaatttggcatttggatatgacattaccaggtctatggaatctagaaatgcaaatgccaccagtactaccaccaagattgttaaaatcttttcccttttgagattccttgtatataagcatggtattgaaacacttccattttttcaagtttgccagtactttgcagtttctaaaataaatgggcctcattcagattactaatttagattatactagccttcttaagtcatccttcaaaaaggccaaacaacaacaagtcatcactgacagtgcgttttgtattgggtgcctgatgtgatggaccacgtcctggattaaaacagaagacccaaggtctggtatcatctcctgggttcatccagcaaacactgattaggtatctattatataccaggcaccatgctgggaacacaaaggaattaaataagagattgtcatgtcactcaaaagctcatagttcagtagaaaataagaaatataaaaaataaaggaaaagctgtgaaatggatgcaatgatgaagatagataaagggagactgtgaacacaaagaaaaagtagtgtcatgtctagctgatgtggtcaggaagggttcacggaggaatatttgaacattgggcaggatctttagagtattagaccttggatttcctcctagacaaacaggaaaaatgaatccgtgccattcacttcaccaagctgtgagattgagaaagagaaagtctgtgaattagctttgtgaatttcagtcttgtttaagatgcaaggaattagggattatccatagcttttacctaaacatctcccctatagcctttcatctcagcatttaatgatgcttacttattttaactcctctttatggaacattttttcttccattttcacctactaaccccaaagactttggggtatcctcatcagtcaagttgggcaagagaaaaatgagacaaagaaaatcagctgtattgaaatattttctttcttcaatatgctatcatccaactcgcaatgaaaataatgttgtgtttattcagattatctctttaatttgactcctcctaattcatagctggtacataaacaatgctaagattttagtaaagcatattgttctatcaaattatgtgtcaggactcttacgtaaatgatgttagttaaatttgatatttcaaaggaaataacagcacatgcgtgctcgctatccatttctccacacttctcaataaattacatccattcatttagtaaatatttatttatacctactgtatgtggcacactggaaatagagccattaacagacaagacacatatcctagctcgtgtacatctgcagattagcaaagactagacagaattgtatagctgggagcacaatacattgagtgttgaaatgtgagacatgcaaggtgtgatgtgtgcacaactggaagacaaaatccagttcaaggggaaggcaaggctttccagaaaaagaagttataaatagacgggaaggaaaagagaggtcagtaagtgaaggatgacaattattgctatccttagatcaaattaatttatgtgtacgttgagtgaagttggtgaaagggggaatgaggtgaactctttttagtagggaaaataggagaacacccttggggttcataaaatccagtaaagctggaggcacttgagttggccagcagtgccattgagcatgttcttgcaattgattttaaatatttctcttccttgtgtctaacagccaatgagtatggtagatagggtcattttcatctattaaaaccatttacagagctcctggtgtccacttagagagagggtggtactgaaaagtgagcactctccggctaaagagatttctctctttctataaatcaagaggacttttggaaacctgcttgcaggttatacttgttccctttttatgaatggcaaaatactaataaaacaattcacaagaagtccccactgctcttggatttgaccgcttgtgcttatttcaaagtttgtgcccaagtagcccaagttataatgatacaacacatctatgtataatgattcatgtattgttcggttgtctcaaaattctgttttgcaaaatagattttttctatctctgtaaatggatttagcaaaggaaatattacttcattcattcaatccacaaatacgggtcttctgctgtctgccaagtggtgagctaagttctcctatctgtttgcaagtggtgaacaacttcagacaataatttttagacatttgtataactgtacatttcaaaacctatgaaaatagtcaaaggaagggtgtgttcttttgtttaagggcttgaaaaataaaaataatcacattaacacatacctgaaataggaagactgcatgaaaaatgtctttcctgttaacaaaggcttgaatacatgcttccggtttccatggcagcccaaccaaacagaaaaataagtcatagaagtggccttttatatcaatgacttgcttcctaaacaataggaccaggagcagtcagtgaaaaaataatgactggtgctgtcctacttatgaaaactgttttacaacttatcagattatttaaaccagagggaacatagtttgaaaataattgacacaaaattggaatttatgttttcattttgactatgtctgtctctagggtcattacttaaaaaaagaaaaaaaaagattcaagtaggaaaaaaaaaaaaacctaaaaataattctgtcaaacagactatctttcctagatctaacttgctttagaaaatgtatataggaaattgcattaacatccctttagcaggagacaattcttaaacttaaattaaactgaaaaagccacagaaaaaagggtttgacaccctaaagccagtgtccaaatgaacgctacggttgacmtcataggtgtgttatgaatgtttaccctgacctcctagaagaaaaggaaaaagaaaggaaagagagagggagaaggtrwgggaagggrggaagaaaagaaaggagagaaaagaagacagagraaaaacagggagggaggaagctggggaaggaaaaagaccatttgctgactccgttgttttatttcccagaatgattcaatacctcaagaagatttcactccagaagtgtacagagttttcctcaacaacctttgccctcgacctgaaattgataacatcttttcagaattgtaagagtacacattttaagccatatctttttcagcttgcattgattctcaggtggctagagcaggacttggagtggtaattggagatggaagaacatcatacactgtgtctaaaagcaatattcctgtgtgatgttttggataggatcacacaatcttgcccctgaggtgcaaccactgcttttaatgagtacaagtttgctgtgatatattgctggaggtagttgtttttgtatgctcagataactttgtatggttgaaggattatgggtagaacagggagtcatcttggcttagcagaaatagactcatgtcgcaggaagaactctggattgggaaccagttattttatctctctgagccacattagcgacatgagaagtttggattactaagaaccctctcagctgaagaattatttgcttttctgttagaaattataaacttatatcaaggcattacctttttttgaaagattagaagaaaaaaggaaaaaaaagaaagaaaccaaagcactaaggcaaatgtggggaaagtagcagtttacctttcttaaaatactgaaatccacatgacagaaaatcaatacaaaatgtggtaaacaaaataaggatttcttcaaatggaagacaggtaaacagtactgctgaaaatgacattgcatattcttgctttgtgctgttcattgccatcatatatttactgaacatctgcaacatttgtaccactgaatttgtctttagatggtcaatacaattgaaatgggaagtttgaacaatatgttgaggaattatactctcttgttgaagcctaactgtaacttttaaaaacrctcaaacgggttgtttactttaagtaatgacaataaatacatctttaaatgatyacagatatatggagttggatgattaaatcaaaaatttactgtcataataaaaaaacctctgtgttcggtttagagtggtgcacccttatgcacatgatgcagtgttttcccactgtgggttttcttacccatttggtattttgcaagagcattgggttttagcggtagcaattgcacaagatatttgtagcccatagaggtatagaaattatggtggagaagcacagtgttttcagggcaagataggagtttcaatatagcattttcttatcaagtataagattttatttccctagagttaaatgcaaatattagaatgaaacttagtttaaaaaattcttattgcttggtttttcattgtttttagtggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggtcagtactttctttcacaccaaagggaagctcttgtttctgattgggggtagtcacacgctgggagttaggaacaccagtgatcgttaggytagtttcctctgtttacaaggcattcctttmggtctgaaatcacttggtggttcagtgcactaggtttttctttaaactttggtgtgtgatttttttgtcattgttgttatatgtatagatgcatgtaacatatttttaaaatgtctaatcctttattttgtttcaaattcacgcagtgactgaatgcatatttcatacaggaaatcactatctttaggttacccttttgtctttttctagtaagttctgtgaagtggcccacaagtttttctaacgttctaaaactgaagggaatatttagtctgtgagacccttatctttttccagtatatactatctgataaatactatctgataaatttttctacttggggaaatagtctaaaatttggctgtctgtgtaaaaaagcctagtgttgtaaatacaaaacaatccaaaaattgatagcccaaagacagctctaagttacctggaagtttttaagaaatttatatttttgattctgggaaaatgaattgccaaaataagatcatgaagatgtaattactgcaaattttcaactatatgtggcagcactgtccctgaacaagatcttccactgagaagactaactctcatctggattgaaatatcttcaccaagaaaattagtgtgttatcactgatgttattgcagattgcctagatattccatagggaggaaaataaagtacaattaaccaattattgaaaagaaatcaattatatattaatatgcaggcattttctaaagtaacagaaatagctctagcaagcttatggtcatcaataagaatgattatcataaaagtaaatttaaaagtcttttaatccattgtgtttaatctggaactggtcctctaaattgaaaatgaaatcatgaagtataaatgggcccaggcactgtggctcacgtctgtaatcccaacactttgggaggccaaggcgggtggatcactttaggtcaggagttcaagatcagcctggccaacatggcgaaatcctgtctctattaaaaatacaaaaattagtctggcatgatggcgcatgcctgtagtcccggctactcaaaagactgaggtaggagaattgctttaacccaggaggcagaggttgcagtgagccgagattacaccactgccctccagcctgggtgacagaggaagactctgtctcaaaaaaaaaaaaaaaaaagaagaagaagaagtataaatgtaaaatctaaaaatctattaatcatattctacatgctactagttgggaatttttagatgcaattttttagttttcatttgttttcttggtgaagaactttgcctttgttgttgttatcattttcactgatgctgtgaaggtgagattagttaaaggaaacaactagcccaacagtatgtcttggcatggccaggcctgcccctccaaacctacttaaataggttgcccttccttccctagtacacaagagatgagatttccccttatcatgaagcagggaacatcttggaggttttgcccatgtagcttaggagttctcttctaaaatccaaacttctccaaaaataacgaacacattgttataacaaatccaacaacacttctaaaaatcagttagcccacgacactaggaaaacaaaaagcttttctgaaaccagtgaagcactccaaagtgtaagccttttccttttctccttccttcacaccacactgctgatggcacaggcttcagctggtatccaatgcctccatacatcatcctctgatgacttgcacgatgtagagggtacaaagagaaaaaattgtgatagattactgtaaaaccccataatcctagaaaaactgattttgattctaatggaaattaagatgatgtctcctagcatttgcaaaattatttagtgccattttatgaatttcaaatcgaaagaggcacacaagatatttaaaaatttaaatatttttaaaggcaactttatctgtttttctataccttaatatgacattgatcacaaaacctctgtgtcaaccttaatagcagtataaagaagcaacatagaataatggttccacttttgagtttcaaagctgagatccacctcactagtttcatagccttatgcttaacttctctatgccttaattatttcatcttcaaaattaaggacagaagaattcttgatatgcttttcatagatttgaattaaataatacctgcaaagcatttggaaagaagaatctgggcctgtgtaatgtgataaataagtgttaactcttctcaatgttttgaagtgtagtatgttggttttcattcctcaggtgtcgttgtccattttttctaggagatcccatgatttctgggccttaaactttcttctgttttccccagcacctagaagatgcacctgctcatgatgaaatccttaatgtagacttgtagttgtgatctaatcagtgacccaaagcatttgtgccccaacttatcacttaagaatattgcctagtggtctctgtacagaaaaattttggctaatgctgtctctacctaaagccttatctagcacgtgggaaggacagaggctttggagtccaacggytagaatatggctaaagggccagccacctgctaccrtataacgtgcatcctcagtcaccccaggggactccagcacccgttcagaagttctggctggctgtatttgtagctccttcttctctagaatccatatgaaagaaattcaactcttgaggagttaaaagtcaaattacaaagaccttagtagggtcacttcagctttaaggcatgtacacaaaaacggactcatgatagctgccttgttttaggataaagggagattgtgcctgtttatgtttagttcagcgcacactagtcattcagtaaatggcctaaattgttattatcactgtttaaagcaggccaaatagtactagaggaagcacacagtctctggtattctagtcttacaaactcaaacttacaagccaacctacgttaagtaattcataacttcagtattcaataaatcttcagtgaaaggcaagaggctacacacagtgacagacccagagataaaccctgtgcccctagagatttgcactcctcttaaaagtgtatatatatataattatataattatttattatataattatatataattatataattatttattatataattatatataatatacaattatttattatataattatatataattatatatttattatatttattatacagttatataataaataattatataattatatataattatatattatttattatctaattctatattaaatataattatttattatctaattctatattatatataattatttattatataattctatattatatataattattatataattctatatataattatttattatataattctatacataagtatttattatataattatgtatataattatttattatataattatgtataatatgtaattatttattatataattatgtataatatataattgtttattatataattatgtataatatataattatttattatataattatgtataatatataattatttattatataattatgtgttatgtataattatttattatataattatgtataatatatatataattttttattatataattatgtataatatataattttttataattatgtgtaatatataattatttatcatataattacaatatatattattaacataatatctaaayatattaataatctaatatctataattaatataatatataaatattacttcttgaaatccaacgtgcacctgaatcacctgagccgttgttaaaatgcagattcgagatcctgcatttctaacaagttactgggtgaggcagaagatgcttagcaaaggcccacaccgagtagcaaagctctaagaagtaaagagaaggcgcattaagcatgaagataatgagatttcttcctgtaggggacagttcatggaagagataacatttgggctgaattgattttaacacagatgagctacagactttaaaactttaaacttttagtcaagtagttaatacatttggatcaataaacacataagaaaataagtagggaagtttagtattacattataatttattcttctgctgctttcattttaactgttttcagatgtgcccaggtgttagttaaattggtgttgatctcagtgctgatgtggaaattgagtcttatttacctgagaaaggcacttccatatagcctatacttgttataaaatgctaagcataagatacacacataatatacataatagaatataaacatatatataacatatatatacacacaacatagatatacacacaacatatagttgtgtgtgtatacacatacacagagacacacacacagtctctgatatcaataaacatatcttaaagtaggtgttaagcaaataaataatatacaaacctgacatatgctgtttagcttttatgtacattttacataatttttacataaaagatagacttgaaattaaatgaaaaatttttagtgtcaccaaaagcccaaatgccaaagccgaccatagtttagctgactaaaagtgtgacacatggaagtatgaaatgaaactccagaagagacaatagactttgatcttctgaggacctgctgtaattagcatgtcagccacatctccatgctggaatttctgttttgggagatgtgtatattggttataaataatcagaggatttctgtgcagtctaaggccaaatgggtcatgtatgtgggttccagaaagagagaatttgaagcttgtcacagaggatactattctcctgggagtgtggtttatttttactatttaaaaattacacattgaaaaatgccatggcctctggtcagcaaaagttttttcctttccatcttgtttgcactgtagacttaaatattcctggcacaggaatatgcaatgacccctgcctcttccaaacaaaatgttcatgaatatcgtactttcaagatcagtgtctccaaaacagttattttttatcacttaaactcttcagatgaaagacagtgagtaaaattagcatgaaaaatagaatagctctataggtacctttggtaacagaatgcagacttcaactgatatatctataaatgaagtccaaattttacttaaataaactgccaaaccaaaagaaagcagtaatttttttcatgcttttattctgtggagatcaggtgttcatgagtgtttgttaaataattgaattaatgtagcagattataatagcagatgtttcaaactacattccttttatcatcagttcttcctcctaaatttttataaggtatactatacaaaagcgtccccactttgttgtaattaagtcataaaaatgaagctctataatcccttttagtgatcactactcgctgagttaatagtttaatagttgaaatgaactcaagattataatggcgaagcaatttggttttaggcaaagttcagatacagcaagtgctttagctttttttcctttaaatagacctaagccaataatgattgtatcagtaggaaaaaaaaaccctattgcattttcaatatagttttatttaaagtattatacaattaagctatattctctcactgtcaacaccaagaaataggctgagagtgatagaaagagactggacttgggaaacttgaaaactgtagttttagttgagactccttcagttgaaaaacggcagaaacttaactcaaactaaagcactgaataaatttgcttgtgcatataagcaaaaagtcaaggtgttaatggtttcaggcatgactatatccaggagctcaagtcatgttatcgataattgtcttttttcatctctcatcattttctcatactggctctagttcttgggcagattttcctgaatgataagacagccaccagcagcgccaagcctatagctcaccagtcctagtatacagaaatcctttttactcatggttcctgtgaaagtcccagaatccagggcatggcttcggtcactcaaggccacttctaaattagaatcacagtgtcctgaaggatgggataaaaataaatggacaggcttaagtcatatgactccccctagagcccataaggggtcaactacctaaagcacaaaccacacggaccgacaattggagagagatggttccctaaaattcaaccaggatgtgcttcctaaaggaaggaatagtggtctcttggcaaatgaaaagagtagatcacactaaaactagttcagaaatcattcattcattatgactttttatttggccttataaagccatttaacttctttgactagccctgctccctagttttctcaactttgaaattatttcctgacagaattactggaagaattaaataagatgcttttgttaaagaggttacatatatttattgttgttggctaaattgtcatttacctgaactaatgaaaagtgatcattggcatttatgccaaattattttaaaacatttatgagtctagaagtgagactcagagccttgggctgaggcattcctgaacattgctgtttctcatctaacagccttatttaatgtactgcaattaaggataagtataataatttattaatgaaacttgaaaaaaatatggcatgtcacatctgtgcacaaatggtcctttctgactcaatcattcttttctatacctttttattaaaatggaattataattatagtcataagtgtaaggatgtacacttgactcttactatttacttcattatcacttcaatttcctagtaaattttttgaatcatatttttccagcaccatttcgctttactaggtagamgttataaaaactaatgatggtgatgattataatctctattctccatccttgaaagwtcaaacatgccctaattaaagaaayaggctggcatagtgtcatgatgaagccagtaaacctcaggcaagagacttgacttgtgtgagcttcaggttcttcatctgtaaaatgggatgagaccagcaatgtagcagacacctgtgctattcccatgtcccttggcaatcatggttccaacccagccacctacacacttggcaactcttcagggccttctatcagtccatccacagccaggctacaattcccagggactgcatgcctcaggagtagttgaagaataaataccttatcttccatgccccttgggttgcaaagttctgatgtgtgtyctctgctttctcccagagttcctcggtgagactgagccctaactgcccacagctgtaacctgcctgatacccttctccttcttagctgcctttccttcttgtctcacttctcttctctactgttgtttcatagggtcaactcccaaaaaaggtgcttgcactcaaatccttgtctcagatcctgtttttggaagaacccaaactaagacaagcacttttctataaatggccttaagggaatcaaaagtgaaagatgggtaaggtcagagttgctgagcattgagagaaaaaaaaatggaaagaggctgtgcctcatcattcctgccaacctatcacgttattgtcttcgttgtttccaatcacgaagccctggccagtggcctccaatcatagatttccagtctacaaaggacttagccatttagcttagtcaaactgtcagtttattagaagaggcagtttgcagaaatggcaatgttgggaccaagaccatgttttctttgtcccgctactccagacatccacctaggcactccaacaggacttgcttagaaaaaagttgcaacacagaccatttagaagttagtgatcgatgtctrtagcagtggtttccaagctggtcctagacatagcaccctttgtttgtttcttctaacaaagtctcgtgagaaaggccaatrtgtagggaaaagctttaaaggtgctgtcttggtggaatagaggggagcctggagtacaggtgatggtggctgttgccctatcactctttctcctcctgacctaccccattctctgcagggatgtctgcccaaaccctgggatattcaggatactcagtttaaaaaccactcctctgaaggaaatactgactagtttaaagatctgcctcacaattaaggtggcatccatttaagtcattttatatagattacctacaaagtagttgaggaaacagaaccgacgtgaatcaacaaagtcaacacaaataagatcaattttctcccaaaagacaaaaacagaggaaaactatatgatgtagccaatgctttcatgccttaattaagttactacactgaaaaagctgctgaaaagctactctaggattttattgatcgaaatctcatttaaattcctcctattgactctctaacctctgcggaaggttacagaaaaatggcattgtcgtccccgagtgcrttccaagttcttcttaacttcatgtttggtatgttcatagacttctctgaaatatttcagattgcctaagaatgaaaaaaaaatttttcaagatcgtcattgtggatctattgttcattggttgacttggcaactccctttgctttcctttccgttattacatttcctttattcccagaaggcagggcctgggcctgaggaaaggcaaaggcctggcctaggaattctgtttcttttctcctttatttcagtgacctcagtgtctgctcaggcccacagctctggccagaaagtcacagccctgtctactcacagctgaaatgtcctttgttcagaaaataaccagacaggaaaaatataaacagtaaaaggcaaaatcaaatgccagtccacaggatagataagtgagcttggtagcctcatcaaccccatagtctgctgagtcttgttaaaacttctttccttcatcayacctttcagaggtgccttgccatttcatgggagagctattgggacagagcagagaatggcttctttccccctagatgtgacctcccagcagaacacagcattgacaattgttggctagtatagctttccccttgtcagcagggtctaggagcaggttgcagtgcgtgtggggtggggtggaggggactctggctcagtcaaaactgcctggcaggttgtactgtgttgggagggagagaggccacaggcgtttggctcctaacttcggcattatccagggtcttgtcaatagtcaatgtgatacaacagataagtgggagggaaataggtcgaatgcagaaaaaaaaaaagcaaaccacagggaaaccagattaagtgagggatggaccttccaccctaacccttaatagaaaagctgaaaaatgtaccatagtagggaatcctgccaggaagtggacagtgaccaaggatttcaaaaatctcttatggagattctggaaggtctgtcttaactctgaatcactacagtctctaggatgccagctgtgacagcaaagattatctccaagctagggatagcattattttaacaggagagttaattgagaatgatggacaaaatcaagcttcttacctaagcattctaccttatatgtagaaaatgagcccaaaaaatgcttctgaacaatgtggctatatgtctttgttgagggttttcccagaagccaactttgaaagaagattcaagtccatagagtttggaaggtgattccaggaagtactagtagggcagtagggagtgtgaacgaggaagagaaagcagcttacaaaaaaatgtgttgtcaaggcagtcattcccaaccacagccattgttggaggatgctcttagaaagtgttaattcttaggcctttccagcctgcaccacataaagtcagccatcaggcagagatgcagatacaagtccagcccagctgtatctcctggagcaccagtacagtctgctatgatattattaccagcaaaacactattcacgatactataaaaaggatattcccacctcactttgcagctttaacaagaatctccagcatatcaaaaaagagatccttcaaagtacctgatgcttattgaacgcatttctttattctaacatatacctaatgcagttgcgtggacactttaacaatcatgtattacccatctaacttatgaactgctagaaaggggaacaaaatccagataagatatttgctctcaaggagcctataattacaaggagaaaattctaatatcacaaataattataaaacaagttataatgtgattcacttccatttcttcatctagctaatattcattcattcgtaaatatacttccattcattcatctagcaaatatctattgaataactatgtgcgagggaagcttgaaggtaaaggaaagttttgtttattgacattgtggggagtttccggaattgctctaagctctttacctgcaaattgccatggtacatttttcagcttttctatttcttgtacaaaacctcagacaagtcttcaagtgcatattattattcccattttacaatgaggaaagcgagtctttggatggtccagacatttgacttgttatactgtttgggaatgagttgagaggtaagtctaaaaatgtaacatttgtgacctgaatggaagccttcatgctattcttgacttactcgttggtttatttactcagcacacagttttttgagtcttgctacctgtgtcaacccttgagtaagacaatgaaaaggcaccattcttcacctatctgggctctcaatgtagtagaacctcctctgtagtcagtacagtggggaaggatgtgctgaaggcatctgaagaggaaactggcattccatgctgtgctttatgctgcagagcagagggccaaatgagagacaagaggcacttagggcactaaaagataacatgttttaagtagctcatcagaaagcattaatgagaacataattatgttctgggtctgcatttatgctagactatggaagagatgtaaataaagtgaaggccatggtccttgctcatacaacgccaatgtccaatttgatcaaggaacataacattctggtgaaggagctagaacatttttcctcccttgcattacggtcaggaaccactgtggagggtctcctctcataaagcactgtgacagtgtactcataaaaggcaatggaattggtttcctaccctctgagaacctctaattttaaatgataaatcagtacttatacaaatccatgttccaaacacagctctaaagctgtacttaagagagacaggttctaatctggattctgttcttatctttctatgtcattttaaaggggctatttaatctctcttgggacaactttgcttatctgtcatgttaaataataaaactgtcttctgcctaccaaatagaatgatgaggagtaaataaactcacagatgtgagaatactttgaaaaacggaaagtgctaaatcaaagtaaggtgttattattgagaattttcacacaaaaccacatcaaatagtacaacttaatacagggaaactgcaagcacacagaaagctgtgagcactgcgtgaagagctaatctgcaggagcttttgagaagagtacatagccatttaggggccattatcacaccatatcttggagctgtatttgcacatagttatggtaatagcacagtttttgcaatcaagatggaataacaatatatgacacttttcaacttaagataaaataataacacatgaaaacaggtgcagaacatactgactccagatttaggggaaaaatggtaaaataatgaaagaagccagtgaagttcatgtaatgtacaaaagcacagttagctggccagtgtgataggaaagtttgtgcccgggcaaagataactgagaagggaacatttagattatttcttaaaataggcaaatagactttggtgagccatgggatattaatgccatctgcacttactttctctgagctgatctagcagaattcgcaagggccaaagcaccaggaaaaaacgtgagccgagaaattgcttttcagtgctgtgcttagaagtgatttaaggaggtgctaaaccactgggctggtagctttccagtatgctctggtattattgcattaagagtgaagattgagcaatgatgaatggattctcaaccacctaatcccagtgacatccaaacatctgagtgccagatcctgcctaattggcatttggcacagtagaaggaggctggtgtccatgcaagctggcagacacattgtccagttttcccatcttgactgtgattattctacgtggatttatgggccatctgtcttccaaggcaaaatttgtagatttttctgtgctgcagagctctgaagatgttatttgcatgtgtttagctgtttttattttttaaagctaacctgcatattttttgcaaagcccacaaaacaatgtcacttcttgtgttcagcatttctcttgtcctcatgttggcatgayaagttttctgttatatttcatttttcttcctaaaattcagattcatgggttgagggataaaaatgctagaggacatctttaaattacttgcagagattagaatgtaaattaagtcgggaaaagaatttggaccttgatagacaaattcaaatcaaagagctaatcctcacgcctctgccagatgggtcatttgtccaccggagctcagcttctttacacagaaagattaaagtaacacgttttagagagataagtaaatcatgggaaaactctgccttggtcacatttaggattatttttaggaccaatgcagagtgcccagattgaagccaactgccaagaaggcaggatacctttccttcccatcatccatgccccctatccaggccagtgttaggaaagttatgtggataagcaccatcaaccacacccaccactatctgtctttccattgcccaggcatgatatccagatccatttcacaccaaataaccccgtgccctcagacaagttgctaacatctctaagcctccgtgtactcaactgaaaatggtaatttaaaagtacgtctctcataggatttctatgcctggcatgtggtcaatgctcagtaatagtagctcccattattatgataattattgttatttaccttcttctatcactagatgatgtgtgatgtctacagcaagcagcatagcatcatgtttaatggcatgaaacacaaagactgactgcctgggctcaaatcccaacttactcacttatgaattgtataaccttgagcaaccttatctttgcttgggcacaaaccttgagcaagctacttgcctcaggtttcccatctataaaatagtcataaaagtacccacttacagagttactgtgaggataaaatgagttaatacttgcatatagcaagtagcatatcataaaagattgttaaacaatatgctggaaatattttaaatcatgaaactcttctaaggctctcttcttccttgcactttcctgttatactcttttttttttttttttagtactgcatgtgtaagcatggcctgccacatgttctttccttgatcctttttcctttagcacttggctactgctgccttaaactgcttttgggactagctcaggagcagttccatgctagttctttgatgccatgatgtgggcatttcctagctaaccatccagatatgcataccgagcagggaagagcctcagtgggggcccttccagagaccttagcaatgtgccatgagttgtatttagggattagtttttgactatgccctatgtacttttttcttgccctgattcacagagctcatgcaaagtgtaatgagagaattacgtgctgaggacttgctactgagctcagaaatttcagttaaatgaggggcatcagcttgtgttaccagaccttatttaaagttacattcagctgggcacggtggctcacgtctgtaatcccagcactttgggaggttgaggtggatggataacttgagatcaggagttcaagatcagcctggccaacatggtgaagccctatctctactaaaaatataaaaattagcctagcatggtgatgcgcgcctgtaatcccagctactcaggaggctgaggcaggagaatcgcttgaacctgggaggcagaggttgcagtgagccgagatcgtgccactgcactccagcctgggcgacagagccagagtccatcccaaaaataaataaataaataaataaataaataaataaagtcacattcatgaactcagtggaaagtgagagcctattaaattatttcagatactttacttgtgaacctaataggaaattctaccagggctgagcaaattcggaagctaagaagagatggcactgatggagcaggtggctcgcaatgtgcaataccttgaagtacagccaactctgctgtcacttaaggattgatttggcttattctgaattattctagtccccttttccagtctattttgatagctttgagcatttaatgctgtctggttagcacttcttctaggcagaggtagggtgtaaggataaaactttcaatctctctaagactttgttaggactcagccccccaaatccctgtctttcttccgcatatttgttggacttcagggtaccgttagtcagtgccagcgaggcctcttggttctgttctgtgagctgttcattgcatttcttcgatgttttcttcttagtccttcctttgtagtgtcatttacggctgaatttggaattgccgtttttagttgtctatgatacaatatcgtttgagatatctggttgccaagatgaagcacaaaaccactcacaatataaattaatacataaatgttaatatttggggacaaaataatcattttttcaattaatatttgttgagcatttacaagccaggcactgttgtgagttctaaagatcagcagtgaactagagaaacactgcctgtctgctggacttcccactgagtgcctgcatctctttgctgacagctctctttagctgccagagccccctcttcccaagggcgcagttggccaaagagtattggggaattatcccccggaagcagtcctcaaacaatgactgatgggacttggtataaatactccagctccctccccccttaaatgggatcaccttcaagtacatgttttgtctcatttccttcaagggaaacacaaactaagacactccatcctcatgaaactcacaatccctggatgaagagaccaaaactagcataccagcaaatatatctattagtacaatgacagatggtgataaatgctatggagaaatataaacagcatatgagacaggagtgccagcaggagagattgctatttgtatgggctactcaagaaagacttcatgttgtggtaatatttgaggagactctcagtgcactcaaaacaagtctctctctctcactctcaatttctattttgaaataacctagagtggtggctaagcactaagagccttccctagtgcctgggcatcagagagggaatctggtccaagctggtagcgctgcattacctcattcttttctggtcttggtcattgaccatccttttcataaccacagactcagctccatctttgccacccttgagtggaccgaggaggaactctctaaggctcaggcccatctacttagacacttctgcttcaataggttctggctgcttgggaataccagcagcaactttctggaacaccttctgggaaaggagccacagagcttctctcttcaggacatcaggcttgtctgcggtttctcctagacttgaggacaaggaagcctcggtatgagaatgtcctcaggaccaagcagaagaatgtaccttttcattcttctttctctgccatccctttcttccctaaagcaaaaggtcaaatgctttgttgctgcttgttttggaaaagagtaagagggactggtgaaggataaaggaggaaatatgtcaactctcaaatatgacaggattgaacacatgatttattttatcaccttagaatttagttctagaagtctccttattttttttagatttgatggtataatttctatggcagtgttttgaattcaaattgcaactttacatgacagacttagggtacagaattacaaatctggacataatttcctggcgattgaatcaagtatcaacatatctgatgaccaccatgacgggagttggacaagtcaccagcactcagaaaatcaaaggtcagcttgactcaatgttcactcctttagaaacgtagggagttgactgcttcttgcacgcaccaccgcacctgttccacaaaagcggccttgtgagattggcaagagaagccaagatatccaagctatttcccacctaataagtacctgggagctcaagcttcctctgtggctctgatggcactctacctgggagaagatatagcaaggagaacctgacagatcatccatatggtgccatctgtggtaagagattagtcactgcatacttctcattagaaaaaatataaagaaagccagggaatcccatgataagtcccagccaggcaaagcagaagaccttctgctcttcccatctgattcaccattacctacaaatacaagatcaaagataaggaacgtaagatctgacttttaaacttaatcaacaaaaatatctgcagtatggtatagtagaaccatggaacttcaggataaatatggtagattgaacatattcaactaactgaactttcttgaaaccacaccaaaactccattaaaagagacttttaagggcataatctggcaagggtgagggataatagataagaaatgaccattacataatttaggtatctggctatatgtttacagcagttgacagatctgagaacctgatcattgatcatccgtgtgaaaacctggaaccaatccaagttattttataaaaaaccttaaaagtctcagaaattgatgatgtttgtttcctctggaagtgggattcaagataaggcataaaacaaagaggagagttgacagctacttaaggaacaatcagaactcccaccttagagggactatttatgtatttattctttggagtcaggaaaacagagagtgtgaggatgacacaaagcccagatgaaagcaggctacaggccgggcgcggcggctcccgcctgcgatgccaacactttgggaggcttaaacaggcggatcacctgaagtcaggtgttagagaccagcctggtgaaaccctgtctctacgaaaaatacaaaaattagccgggcgtggtggcatgtgcctatagtccctgctactcaggaggctgaggcaggggaatcacttgaacccaggaggcagaggttgcagtgaggcaagataacaccactgcactccagcctgtgtgacagagcaagactctgtctcaagaagagagaaaaagaaagaagaaagagagacaaagaaagaaagaaagaaagagaagaaagaaagaaagaaagagagaaagagtaccattttgaaagcaagaagataaagtaattgtaagcatatgaaaaaatgctgagacctcctgcattcttctccaatcttgctctagaatgctggcatccaggccttcactctatcctggcaagagattagatagaagttctcccaagaatctaatctgcctaagaggaaagacctaaagatatcaatattagggattactccgaaagatacaaaggaagatccctctgcagtgatgccttaccaactctcatacttttcaagcacagcaaacacatccagaaatccaatcagctttttagtctgccaacttgaaatatgaacagataattaagtgttactagacatatgaggaaaacttccttaaaaacaggaaaaagcagggaaaaaagtaactttgtaggaaataatgactatatagtgagaattcgttaagtatacacatatcattaatgtccatagaaaaataaccaaatatattatgtccatgaaaaagaacagaatgctaattttttcaataaatgtcagagaacataaactggctgttaaacacaaaaacaaagcactccaaaaaaaggtggaaatacagttgaggaaatcttttagagagtaaagcaaaaaaattagatggaagattggagagaaaatgtataaaagtttaaaatccggtcaggcatgttggctcaggcctgtaatcccagcaatttgggaggctgaggtgggtggatcacctgaggtcgggagtttgagaccagcttgaccaacacagagaaaccccatctctactaaaaatacaaaattagccgggtggggtatggtggtgcatgcctgtaatcccagctacttgggaggctgaggcaggaggatcgcttgatcacctccacctggaggtggaggttgtggtaagccgagatcgcaccattgcactccagcctgggcaacaagagcgaaactcagtctcaaaacaaagtttaaaatctggacaaataatattccagaatgaaaaaacagaggaaattatcataataattcatgtttttttccaaacaagacaacagctttcagactgaaaggtttcaaagagtgcccagcataggggatagataaacctatgccaaagcacatcattgtgaaattttaagaaacggggaccaaaagtgctagaaattgccagagggacaaaaaccaaaacaaaacaggccacacacctgtttttaggatggtgaatcacaaagtcttcaaacctcttaacagagctaaaagacagtggagcaaatttttcccacaaaaatcttttaaaaaaaaatccaacccaaaatactgtgtccagcaaaactagcaatcaagtgtgcaggtgtaaagaagtcatttttagacatgcaagcctcaagaaacttaacattcatgaatgctttctctggaagctactgaccaatgtgctctaactaaaattaaaaaattaacaattaaaggggaagacatggcataaataaaagagatttagcacagaatagaagtgaagaaaacagaaattaatcaatctagattggagcagataaaaggctccagaaaagacttcaagagaatctaaccaagagaacacttgttatatttgtacatattgcaaaaacatttagctaaccgggggatactttggagttggactggagatatatgcaaaaaattaagcaaatgataaaacaagataattaactatagggaaaattttaaaaaattgtgcatgaagataaaaataattgttaggttactgtatgactcaaccctgaacacactgtgtagtcatgataacataaagactgaacactgtaactaaattatagtattactgtctctgaaagaatgagagtaatgtatacatgtgctacaggagtagagataagaaagagcaatattctcatctttcatggtggtaagtcaaaaatagcaatacatgcrtattattttgagatacagaagtaaataccaaaagcttctgctaaaagatttgaaggtgtttgcttctaagtaaggagacatgaggaagcgtgtttctattaaccatcctagtaaaagtggtgctggatggcagccatagaataattctaaatttagcagataacccttggcttctcgaccatgttgtttttcctnttcttgtctcctgaagtggtatctgcacatcaagagcaaatcacacaggtggcttcttagctccccttggtgactccacacactggagacattcagcccctccctactccttccttctaaacttagcccatcggcaatcaacgctgactgatttttcttcatcttcaaccagacttgggcagcagaatggtagaaaggaaactggagcagagctggatcaaaatgaattgcttctttcagaagagtcctgaaatttacatccccaagaaggttcctatctggccaacatgaaattagtgtgtccactaactgattgcatgggctgcaactccaaactctttcgtgttatatgcactaagaactacactaaatgaatagaaacctgaactgatcagcaacaggaatcaaggatgaattttatgtgccatgtttttaagttcttgaaaggcaatgctctgatggacacatccttggttatttccaacccttgacacatagagatgcaccctcagtaaaaacgtgttcattggtaaccaccagtaaggaataccctagctccagggtgcgttcaaaacattttgctgttgctggagaaatatgaactgaaaacatcttttcccatgtacctgaaacaagagagtcaacccagaatgtctccttaaaagtaggtttttagaagctaatagataaagggatccgaacctgagaagatgagagaaccactccacaatgctcttctagaccattcttcctttctgttctccagggctcccttttctggatacagatcttcctcattcttaattgttgcaaggccaatgggatggccctgagtgtagaggaggcatcagagtagcccatagcccagtaaatactcaagggcctttgtatgcatttgcaagcatgatggcatccagctgagtgtcactggatacacttcagggttttaaagcatgattttaaagcatccctggaaggtatcattacgtcatagcagaattttgaattgatgtctttctgacatctttaggagcattgttttttccattccttgagggatttacatgttttgtacttcagctggaagtggtacaaacactatgtttgtttatgaagacttttaaatgccattatatgagtgacatgtccaatggcatactgatttattattaacaaaatatataaggtaatttatttttagcctttgtcaactaactttatccttctgaactcaatttctctttctggtgattttatttcagaaaacagtagcattgcttttactgtttcataatctcactcaaatgtgggacattttgttttaatttagctagaaataattcctaatatattagcctgattgaattcatagacttttagagctagaggagactgaggcatccatatagtttactcatcctataattaaggaatttgtccctgaccagtgaccactggcaagaatggaagaaaactggatttcttgtgctgttactaagttttttagaaaagcaatgtgttttgttatcttaattctcaaggtttttcattcttctatgtgcctcagtggaccagagtggatcagaaaaaaaaattgtaaatttttcacaaacagtgcaagtttgatagaaaagggctaatgcattttagtcaatggcgacaataatattccagctgaaggttatatggaagggatatcctcagagtttgttctctgccccaagtctttactagtcagaactattttttaggctaattcattatgacaaaacatctgtatttttgcaaatactcttgaccccttagctgacacctacaagattacaaactgactgctctttatctttacattttattggctttccttgactttgacatatctctgcctaatcatttaatgtatcaaaaatcttcagcatttgctccttttgttagcaaggcaaagctttgggattgaaaagttgatccctggttcacagttacagttccctgattgcacagttattttattgctatgatatgcatgtgtttacaagaagctcactggtagtctacaatcatattctacccaaactacccttcaaactcaatctttgttcttattcaagtttaggtaaattccttcaccagggatttttaaattctttaatataattataaattatcctcacactcactcaccaaactattgttgtttgttgattttaatgtatactaaaaattctgttaaaatattttattccaatgagataataaaggtagagaaaataaccaaaaaggttatggtttaattgacctgtagggtattaactagtctgtattcaatttagtaatatctgtctagtttgtgtttttggtttttggtttatttgcttggtttttgttgacaaaaatatacaaatacatacatacaaacacatacacatacaaacacatacatatatttgtgtatatatacttatatgtatatatgtgtgtatatgtgtgtgtgtatatatatatatatatatatatatatatatataatatatataaaatcagtgtctcatagcctcctttgacctggctttgacaacttccggattaaataaaacttggatacacattctttgcatgttccaaattataccttgaccttgattataatatcttcatttgagtatgacaaatatatgaagtgtacaccttcacttttctatcctgtacccaaggcagacatcaaaattaatcacaggcatggttcagaatctttctcaacacaagcacccagaagacattaacaataaatggaatttggagctaaagttaaaatccatttgtcatttctgccctattggcctatgttgttgttttttcttgcttttaaaagttgctgatcaaaccaaaggatgtttattcttgcatttcattcttgttcttctttcatgttcaataaaccattgtattagattgcacagttattttattgctatgatatgcatgtgtatacaagaagcatacacttgccagttttccataccctgtgactcccccagtatgcacactcatccagcagttacattactttcctttcctggcccctgaagatacttgcatttattgcctgtcttttaaggaattgttatagttagagattgggttgtgtgaaattgccttttgcataggtgraaaacagcaaatattacaaatttcatatcatttgacctaatcagaacataagaatcaaacaaaatgctgctgtctttggtgatcttccagtttcaaaacaatttattttctattttgaatcccaataatcatccaaaagaagtagtgatttagcacccactgtgcacaaagcatctagtagacaccagggacgacaaagatacatgcacattcagcttttaaaggtgctcgtgcctgggtttcaaggggtgaatggccttattttctattagacggtgagctctttgaaggcagaggctgtgttttactgtgctttatttttctgtgcatttatcgtatggtagatgttcaataaacctttgtgaaattagtgaaaggaaaagagataggggagaaggaaaggaaatagagagaaagggagaaatagagattctggtgtgaaaagcacgtgcccaggcccagctcagcggctcacgcctgtaacctcaggactttgggaggctgtggtgggaggatcgcttgagtacaggtgttcaagaccagcctggggaacataggaagacccctgtctctacacagagaaaaaaaattacctgggcatggtggtgcatgcctatggtcccagctactcgggaggctgaggcaggaggattgcccgagcccaggaggaaggtttttcttttgcgaaacagctcctctcatcaaaagagccaaaacaaactttccttcttattttttattcttggacaatagtaaaagcaatttagctattgagtttccagaacttgggaaaagcagtcatcggtcaccttgagaaatgtattgaatgtgaaaagatttttactgtggtaaataatcagtgctagctttgccatttacaaatggcacatctcttagcaatcaagaataaataatgtttaaatcagtaaaaattagaattgttaaatgttgtcattttactgataggtttggcagtaggggagaagagaaggaaaacagatacttttatatamcattggtgaaagtcaattgctaggactttaacagaaagaaaattggttatgtgtattaaaatcctcaaaagtatgcgaagtctttgaatcagaaattctatttctgggaattcatcctgaagaaataattaagtatttatacaaagatgtaaccatcagagcagtcaatgcaatgtcatttatactagtgaaaaaattagaaacaactttaatgatcaatgataatagaatattatttcatattatactgctatattttatgatataaaaatatagatagttgcatattttatgctatagttaaatatccgcatagaatttatttttacattaaaaatgttcataatatattgctcagttaatacaaaggttactaaattatatatataattatatgtatgtgtgtatatgcatgattacagcttcataaaagaattatacacacacacgggtatttttctgggaggatacacaccaatgttttagcagtagttatctctgaaagaaaagttagggatgttcaaaacaagttttattttttctctctgtttatctcatttcccaatttttctttaatgaacatattccacttttatagtaataaaaactgtttcaacaagaaaaaaaaaaagaaatgctaccctccgacatttgttggcaacatatttactacccgcaaatatgttgtttgaagctttgattgtcaagattgaagaaacaaattgtagtgatagaccaaaatacttaagatgatcctatgtatctatgaagattatgacaaaaaattgtctcaatacgtgtatcaaaacatccagttgtacaccttaaatatgtagttttttaaattatacctcaataaagttgacaaaagaattttgtcaatatttagtattagtcaactcagaaaggttacaacatagaaaaatttctaaatagaatctgagtaaactaaattacctgtgtcatatttctgccatctgaagtaaaataattcttaatatgagatttaaagatcttttttcatgagcattcaaatttttattttcaggaaagactcatttgtgggcatctttattttctgtttcagagaaaaatatcattatttgaaaacacctttttttttttgagacagagtctcgctctgtcacccaggctggagtgtagtggtgcgatctcagctcactgcaaactccacctcctgggttcaaacaattctcctgcctcagcctcccgagtagctgggactgcaggcacccgccaccacacccggctaatttttctgtatttttagtagagacgaggtttcaccgtgttagccaggatggtctcgatctcctgaccttgtgatctgcccaccttggcctcccaaagtgctgggattacaggcgtgagccaccgcgcccagccccaaaaacactttaacattattttaaataataaaaccacttgtaaattatttatttatttatttatttatttatttatttttattttgagaaggagtctcgctctgtcgcccaggctggagtgcagtggcgccatctcggctcaatgcaacctccacctcctgggtgcaagcgattctcctgcctcagcctcctgagtagctggattacaggcgcccaccatgcccgggttaatttttgtgttttgggtagagaggagacttcgccatattggccaggctgatctcgagctcctgacctcaagtgatccacccgcctcagcctcccaaagtgctgggattacaggccacttgtacataattttgattataaagtaacatacattaataagaaaaaaaattgaaaaattaccccaaattctattacacagagataagcactgataacattttagtgccgatccataaagttaataccagtcttatattggaaaacaggaggttggtgtttatttaaatcctctgaaaatttggtggggctcatgtaactacatgttttctctattgtctgtgacatttggaaataattgtagtgaaacagaataatcctacactcttatttatccatactaaaatgtcttctaccttggacactacaagatatttytggaaaaaaaaaaaaaaagaggcgacttgacacccataaaagaatgcattcacatcctttctaacttcatttcctccaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacaggtatgaattttctagttctttgttastttagccagtctcaccaaatttcaccaacctctactttctgttgttcggaagctgaagtgtgttttcttccatttcctgcgaagtgcctctgagaactctggggttccaccactaaagcctcccgcctcccataagcagtcatgtccacatgtgtatgaagcaatagcatcatttctccacagcctaagtttttaagtcttctaaaatgcaaccacggctgacattttcagatcaatgggatttttgtgtaactgaactcattcttcagtgtacttgaagccatgtccagtcctacccggttctctgggctgtgttcatctacatgacagctccgaagttcttaagtggtggctcatgcttgtaatcccagcactttgggacggcgaggcgggcggatcacctgaggtcaggagttcgagaccagcctgttcaatatggcgaaacccctgtctctactaaaaatacaaaaaaaaaaaaaaaaatcagccaggcgtggtggtgcgtgcctgtaaacccagctacttgggaggctgaggcaggagaatcacctgaacccaagaggtggaggttacagtgagccgagatcacaccactgcaccccaacctgggtgacaagaatgaaactttgtctcaaaagaaaaaaaaaagaattaagtaattgctttttgttcaaggtaggacagggctttagacaaaaacaaattgacctgtgaatgacaacttatactttattgtaaatattataataaagtaggataaaacatcaatgtgtttctaatctgatcttaaattaagccttgacctatttggcagtctggtgaagtgtatgcacccttctcagaatgctaaatgcataaattaagtacctagaattaaagaggaaataaatttcattgaaatatttttataaaatgttatgatatataaccttgtgtatctcagtattaacacaatttaaataagtataagtaaaatgttgtgataatttgcaacaattggaatataatacacagatcttgctagtgacttgtaaactacatacttaactgaagagaatgttaaattttgtgtagaggttaaaattaaaactgtaaccattctttctcatccaagttcaaggaggttcayggaatatcactttaacagtctagatctttgacatgataaaattcaaagaagtataatttttaaaatctgagcacattatagaatcttacatttatcctatatttaggaccacaaaactcaaaaatacttaaatatatgtccggttgaattttgggtattgtgtgtgattttgtttaagtggaagtcacaatataragtagattttttacgaataatcttttgagtccaaaataccttccaactgatatatttatattcattacattctattttatttgtcatataataaatgagtcagtaataccaaaatgattgaatgacaagactgattggatatacattttattttttcaccttctttcagagtatattaatttttccctttctgactatcactagggttttcagattttatgtatgttcattcaatcgcggctgccattctccttttgagagaccaaattgtctcaactttggttagtaggagacatttttaggctatcatctgtgtcctcttgacatgacctattaatctttgaaagtgttctggcacatagagatcttccagactcaccttattcctttctgctycagagatggaaacagactattctccagtgagccctggttctttttgatgggaaagaaaaagtatgagtaacagcaatttggaccctgaacattgcctggactgtttcagtgaacaaaggaagaaaagataatttttttttgtctttttaaggcacgagttcacataaatatttctacttctacctaccaatttaaattattattattattattatwcttgagacagggcctcactctgttgcccaggctggagcacagtggcatgatgatagctcactgtagtcccgatctcctgggctcaagcaatcctcccacctcagcctcctgagtagctgaaactacaggcacgtgccaccacacctggctaattttttatttcttgtaaagacaaggtctcactatgttgcccaggctggactcagactcctgagctcaagcaatccttctgcctcagcctcccaaagtcctgggattaacgacatgagccactgtgcctgtccccaatttaaattatttttttaaattatttttccataagttataagggtataggtggtatttggttacatgagtaagttctttagtggagatttgtaagatgagatcctggtgcacccatcacccgagcagtatacactgaaccatattggttgtcttttatccctcaccccctgccccaagtccccaaagtctattatatcattcttatgcctttgcgtcctcatagcttagctcccacatatcagagagaacatacgatgtttggttttccattcctgagttacttcacttagaaaaatcgtctctaatctcatccaagtcattggaaatgctgttaattcattcctttttgtggatgagtagtgttctatcatgtatacataccacagtttctatatcyactcattgactgatgggcatttcagttggttccacgattttgctattgtgaattgtgctgctgtaaacatgcgtgtgcaagtatctttttcaaatagtgacttattttcctctgggtagatacccattagtgggacggctggatcaaatggtagttctacttttagttctttaaggaatctccacactgttttccatagtggctgtactagtttacattcccaccagcagtgtagaagtgttccctgattgctgcatccatgccaacttctactgttttttgattcttggattatggccattgttgcaagagtraggtggtatcgcattgtggttttgatttgcatttccctgatcaytagtgatgttgagcattttttcatatgtgtgttggtcatttgtacatcttcttttgagagttgtctattcatgtccttagcccactttttgatggaattgattgttttctccttgctgatttgtttgagttcattgtagattctggatattagtcctttgtcagatgtatagattgtgaatattttctcccactctgtgggttgtctgtttattctgctgactgttccttttgctgtgcaaaagctctttagtttaattaggtcccagccatgtatctttgtttttatgcaattgcttttacccaaaagcaatttttggtcatgaaatccttgcctaagccaatgtctagaagggtttttctaatgttatcttctagaatttttatagtttcaggtcttagatttaggtccttaatccatcttgagttgatttttgtataaggtgagagatgaggatccagtttcattttcctacatgtggctagccaattaccccagcacactttgttgaaaagggtgtttttcccccactttatgtttttgtttgctttgtcraagatcagttggctrtaagtatttgggtttatttctgggttctctattctgtcccattgttctgwgtgcctatttttatgccagtaccayactgttttggtgactatgcccttagagtatagtttgaaatcaggtagtgtgatgcttccagatttgttctttttgcttagtcttgctttggctatgcgggctattttttggttccrtatgaattttagaattgttttttctaactctgtgaagaatgatggtggtattttgatggagattgcattgaatttgtagattgcttttggcagtgtggccattctcacaatattgattctacccatccatgagcatgggatgtgttttcatttgtttgtcatctatgatttatttcagcagtgttttgtagttttccttgtagaagccttttgactccttttttaggtatattcctcagtatttttttttttttgcagctattgtaaaagggttgagttcttgatttgattatctgcttggtcactgttggtgtataaaagagctactgatttgaatatattaatcttgtatctgaaaactttgctgaattctcttatctgttctaggagctttctagaggcgtccttaggattttcaaggtaaacaatcatatcgtcagcagtcagggacagtttgacttcctcttcacttatttggatgccctttatttctttctcttgtctgattgctctggccaagacttccagtactatgatgaagaagggtggtgagagtgggcatccttgttttgttcccgttctcaggaagaatgctttcagcttttccccatycagtattaagttggctgtgggtttgtcataggtggcttttaattcattaaggtgtgtcccttgtatgccaattttgctgagctgtgctctttttagtaatcttgatacctaacagattatacatactaactcattttctttactgaaaaccttataatagtattaagaaaattttcaatattaatacaaataataaaactacaaaatgtagttcaaatttgtgtatgcagtttttaaattacatttcactaaaaatttacaatcaaattaatttcttcttctaaattaatttcttctgaagtcattcatatgcccttcctatgtataacttggtaaacacagatgtggtaaaaaatttggctccattgtgtcaggttagtttaaatttgagggtgttggcatattaacagctaatcagactaaaaagatgatgtgatactttcagctattaggaaagaaaagggtttaccttttttatgaagaaagaactctaatagctgtctccaaatttctgtacaatggttttgtatcaacaccatctgattcatatacctcgtttctggtcaattatctcttcaattatttaatttctagtactgttagaatccacatattttcaaatactcagtttttaaaactatattaactatgttaaattgtattctcatctaaggggttttgtttttgctgttgttttttttttttatcttgctcccttttctgagctctgtattattataccaaggtttgcattagataaatctgtaaccactcaactgggttcttcttgcctgctgcctagaaaaagccaatacactgagaacagcaggtgttacarcagagaaagtttacttattgcaaggcagtggagcagaaggatgggacatatttctcaaatcagtctctctgataatccagaagctaggatttttcaaggatagttaggcagcagggggttgggaagtggttagggaatggggaatgctgattggtgggtcaggaaagaaatgacatgggagtcaaagctgtcttcttggactgagacagtccctgggagaagttaagtctgtttcttggcatgggtcacaggatgggtggcagtagttggtccatgagaattcaaggcctgaaaaataccttaaacaccagtcttaggttttataatagtgatgttatatataggagcaattagggagkttacgaatcttgtgacttcagtcctaaaccataattccaaccttgtggttaatttgttagtcttacaaaagttgttttggtccccaggaaaggaggggattagttttggaaagggactgttatcatctttgttttaaaatcaaactatatactaatttcctcccatagttatcttggcctgtactcaggaatgagcaaggacagttartttgtgaggttagaagcaagatggagtcagctatgtcagatttctctcactgtcatgatttttgcaaaggcagtcaaatctacattctcacagtattaccttgccccagtaccagccatttattttcctgcaaggaaattaaggagaattccatataattagaaacaaaactatataaaaatataaatacaggctcttgaagttttgcctgaaatgctgttttgactcatgggtcaaaatttggttttacttcacatattattggtagaatcattgttttaattacagatgaaactaatgtagaagtcctgtttctcagaagcctttggataaactcaaatttctatgatataaacattcaagctaccccaaatcaattaagaatgttataaaataaaaatayaaccaatgcctaatccaattgaatcctattaaatttttaaattaatatctagaaaataatttagtttttatactttacagccattttcagaacaagtaaaaactgtatttatagaaacattatttcatataaagagtggtggaaaaaagaaagttttcctatttaaatgagtttaagaaatgctaggtgcaaagraaggttagcacctaccgtaatgtgttttgaatataaaataaaaggatcagagtctcacagtcatcaactcttcatcctccttgtcaccacccaacttattttcttggagcattttaaggactaatattcctgaaaaatgctatctaaatccaaataggaagaatttcaatattcaggatattttctttgagcatccaaagggactgtaaaaattaaatatacagaatgaaaccaatcagtttagcaatgcattattattatgtctatttctctgctcattattgcccctttgttgaatatcaagatgcccagaagtaaaaataaattgtatcattgagagaaatagatgcactgaatgagtggtttttaattatcatggtcactttttggatttggggtgattttggcagtaccctcagtactgattatgttttaaattattgcttttccttgaggaatctgccctatgactcaagaaaaagaaatcttcctaggaagaaacactatgcagtaaatacaacctatacttgtgcacctcttcataaaccttcccatactcccaactatttgggagataatggcttcagaaacactggaaaggcaaagcaatctatctccggacagctaatatcttcattcagataagaaagaaaccattagatttgagggttttgctatccccaataatctgatgaattaaattatctgactgaatgtttctgataattattcaactcctctcctcatgtataagttcttggctgaagaaaagttctaaaaatgatttaagacctagctgtacccttsccagtcatctgctacaaacccagactttgagcacccctcctctctttcccatctctcccactcatttagcccttagcatatgcaacgttttatcatttgtttttgctttagagcacacacagacctaaaaagtcaggtggtagaatgaaaagaagatgagcttaggaaataaacagggcccagtttaaaatggcctttaagtaaatgacatacttaactcatttgagccttggtttgtttgtaaaatgtagataaattaaaacagccagggttcttgtggctgaaagtaataggatgctattatttaatggcttaaagatttaagcagtgtattccctcacacagcaaggcacccaggagcagagtggttgaggattggttaaatcaggaattcattaatatcatggaagacccaggtggtttctgtctttttggtctccttatggtttcaagatgactgtgtaccctaagcattacctccctgtgaaccaagatccacaaaggacatggcgaaagttcttgtgacccttctaagagtgaagaaaatgttcctagaggttccctgacagccccccacctccatcccctcaatctggtaggcattctttatgccatgttatatatagctcagagtcacaccacacatcaatgcccacagtaattgctaacatgggccacagaactaccatgactgactgagaagaatcaagatttaccccaaggctgcagagaagaccctgaagcatatcagaacctagataaaatattttactggcaaggaaaaagagaaagaagagacagaaagggcaaccagaagtgtaagaatgggaagaaatttatgtttgcctccctacctggatggtaagggtaaaggaatatgtctcatatcactttcatatccccagtaaccagtattttgcctcccacagaaaatgttttggggaatatgtacaaacacataatggtgaagctcctataatcagtaaagtatatacttgaagtcattttcttaagagtggaaatgactttaggctcttacatagacactttgtctcctaagccatctcatggcaactgctctgtgttcaagaragcaccatggtttcactggggcagcaggcagataccatgtaattgagaaatcagatcaaacagatgcatctagagagggtcaagacaaataatacattctctgcattttggacagtttcctcaggtgtagccatgagattatatgccctgaatggctgtcatagcattgaaagcaaggaaatgtagtcctcatctccatctgttgaaggggacaataactattgaagaaggccactgaattaacaaatatatcacattctggaamcttcttaccctggaggttgaagggaagacaataatgataaatatgaaaacaggcaattaatcatcagccactgcaagatgaaaaattcttcagaagtttgtgttaatggaggaattgctatttttgatcttctggttttttctatcccyrgatgccttgggtaatctgagacaaagctcaagggaatgtaaccagccacccaaaatgaatgcastcaagtgagaagttgcagagctgtgacttggggcagtattatgaattactctgagaaggagcttcagctcccaagttcaatcatggacttggaatgtattccagaggatgttcagagccagggagagatgatgtcaaatactagtttcagaaataccaaaggttgaatgactcatgacctatcactaatctcaaccttcagcgatccgctagccccagaagctatatttattcaatatattcaaatggaaatataatgggtagatgagatgtaataatgagttaagaattttagggaacaaaaataaatcagctttgaggcttaaggcagaaaagagagtaacagagaatatgaatacatgtgtttgaaaaatatttccataaatgaagtaaaacatacagggaacctaatatgcattccaaggaataggataattatggataaatgtgggttttctcaaagtatgctttctttgggagggttccatttctaataaaaagtattcattttaagaatgaacaatgagtttaccttggagggattctgttggtcttaggtggacaataaactctttctcttttttattcttcagtttttttccccacattcctttgcatctcacaaacccaacctcatgccttaccatggttttcaaaacattaactgatcaacattcaaaaaatacatcaaattccttctcattgttctttgattaaaaatattcacaagaaaatctaaggaaatgtttctcaaaactttgaacctcttattacagaatgctctagtgtctgttaggtatttatctactttgatacactgttaaatctgattaaattcttcacactatccttactaaagttagtaacattcaactagtattaatgaaattgattcagaaattgtacaatatgtaattgtgttgatatagtcagtgatgtgcgtaaacaattctctaaacagtacacacaaaaatctgctctattctttaataccggtgcaattttctgcaggagcaagcattttaaattaaataacctgataatatttgaattattcacttcctttagctatagtagctcctctttaagtttagaaataacatataaatgtttgtcttttcccctttactcccactgtccccttgtccctaatgcagaaaagacctttgtaaatctttgccatgacaatgtactttgaaaaggcaattaggaatggcaatttgattatccagcatcaggaagtttctagatcattttgtcagcatttctgcttttccaaatgcatctttgtgttgaaaacatcccatttttccagtagagaaaagttattatgcagacccacttaatcagcctttcagtgcatttaccagggctctatagaactcaaaaatgtcatccttttgttatgctggtggttgagtattatgacatgcatataaaaataaaattaagctagtaggcttaatcccattttctttgtcctgtgtgtctccacggggcacatcttgtccatgtcaaagtcattttaacagtttgcatcaatatgccatcttttaactggctatttaaaaaaatgatggtaggccaaatgtggtggtttatacctgtaatctcagcacttcctgaggcagaggcaggaggatcggttgagcccaggagtttgagaccaacctgggcaacataaggagactctgtctctaaacaaaatacaaaaattagttgagcatgctcgtgcacatctgtggtcccagttacttaggaggcttaggaaggaggatgacttgagcctagggggttgaagcttcagtgagctatgatcacaccactgcactctagcctcggtgacagagtgagatcccatttcaaagaaaaacttttaaaaaaatgattggggcttatagaatataaatcaaagaaaatatttaatagggaaaaccaaagacttcaatttgtgtgttgctaatgggcctgttgcaagagctatttattattactctttcaaaaatagtttatcctgaaattagtgacttccactgacttaagtaaaataggagcttttggcttccatgccctgtgtattataatcaaggccctcagacctttcaggtgccttcattataacaattctcatcactttagtagggtatgttagttctattcacagaagtcccattctggtaaagtttatctttttcttccattgcttgtgtttttggtgttgtatctacaaaaccattgctgaatcaaggtcacaaaaatttactgctgtgttttcttctaaaggttttgtagttttagctcttatatttgtacacttgatccaatttgagtttagttctctatggtatgaggtaaggatccaagttcttctttttttatttttatgtggctatccagttgtcccaacactattgaaaagatggttctttctgcacttaattgtcttggcaattgttgaaagccagttgaccataaattgagggtttattttggaaatctcaattctatttccattaatctatatgtctgtctttatgccagtaccacatggtcttgattactgtagctttgttttaagttttgagaagtgtgattcctccatctttgttcttatttttcaagattgcttttggctgtttcaggttccttaacatttctatatgaactttggatcagtttgccaattttttccaaaaaatcctggtgagattttgataagaattgaatctttaggccaatggtggggagtagtgtcatcttagcaataccaagtcttctgctccatgaacatgagatgtatttccatttatttgggtcttctttagtttctttcaacaacattttgtaattattagagaataagttttgcgatcctttgtttaatttaaatttatttatttatttatttatttttgagacagagtctcactctgttgcccaggctggagtgcaatggcaccatctcggctcactgcaagctccgcctcccgggttcacaccattctcctgcctcagcctcctgagtagctgggactacaggcgcctgccaccacacccggctaattttttgtgtttttagcagagatggggtttcaccatgttagccaggatggtctcgatctcctgacctcgtgatccgctcgcctcagcctcccaaaatgctgggattataggcgtgagccactgtgcctggccttaaatttatttttttttaaagagcacttttaaaaacagaatgtttagcttttctcagcatttgtgcctttggcaaacatgtcagaggcagctgacttatataatagaacagtctcccaacaataaattctcatcaggaggcagtcagaattaaaagagtgagttttgatgctataatcctggatcttctacttcctagcattggaaacttgggcaaccgaactctgtgccattttattatgtgaaatgggtatttttttattaaatagttatgccacagagattttttgtgaagattaaatgtttagtatatatacagtccaaaaacctgtaattggcacatggtaaatagttaataaacatgcatcgttgttattgttacaatgccctatcttttcccaaagcactactacagattctatttgaaattgagccattaccttctggtatgttgaggcagaagaaaggcaaagaataactgstgcagctcttagactctttgttttcctgttattgaggagcctttctaagaaagcaccacggtcatccttgcttcatgggaatctggggtttgttttgttggtgttttatagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggtagagyatatgaatrttactaagagrggcagctggagacacctgattccttttggttaaagcctcctaaggtagaaagtcccagtggtcacaattaagtccaaaggctgttaatcatctttgcaatttcagaggctaaaatttggctgtttattcatgaataattggcatcaggtgaattaattcatgctaaccaaattctaaggaaactgtctcgtgaaaggaaatatcaaggtatttgtcttgtcctctttagcactcttactcctaatttcttgcattttatttttgtgaaatatccataaagaatacagacaacttatttctatgctttaactaatggctataaagtatgcatccatgtaactaccatctaaatcgagaaatagaaacttggggagtacctgaaacacttccatgtatccattcccatcagaatgtcccrtttaccctcagaggtgactaccatcctgactattacagtggtccctactttgcgcttctttagagcacaaagtacaaatttatatgcagccctaaatgatgtagcttcaccaatttttttcacttgtaaattgattcacactatagtatacattattttatgacttgcttttttcactccacattgtttagaaggttcattaatattgtttcagataactctagatttgttggctttctttatcatgatgatagtattaattattactgttaattattatrtaagattccattctgtgatgctatcttttggaatgttgacgtctatcagtcaaagacccctaggaacatacctatggtcaagttgggtttgtttgctcatacaacaaaggagaacacatgttgtagggagctggagtgtctcagtaaaagtttattagagaggacttacaggacttgggcttatagtaggtgatttgggggacggttcaaaggagaagggttttgcagtggattgggtgctgtcaggaggcacaaacaatcctatgagagggtatcttagtaaatcctatctaggaagcaggactaaagctgttactgataaagatgcatcagccattcttgttagtgagaaatgaggtgcatttggtctctctctttttccacccttagctctattttgcaccacaaggggccacacattcatgtgtatggacacccaagcccaaatatctaaagtctgtccacatgtcctgcaaagagccttccccagggggtaggggccattggagtaggggaaatctggggtcctaggtacttggagagtgactggagaaagaagttgtgggcttcagggaacatgttctctccgctgactccggctttctcacccctttaaatgggaatcagaagagaagggccagaggacaacctctcgcactaggtcccaaggcataagccctgttgcctgggatacctgggtctcagggaagtgtcactaactcttatctgaagcaaccaaggaaacagagtccaagtaagtaattaaggtgagtggagacaaggccattgaacatgggagatcagagtactgagaagcaagaatatgggatgaattcaatgttaatatcaccaaggttagtgacgaagctttggatgaagaaactgtgtgccacttgccaactcttttctgaataagggtggctcagtagatggcagaagtgaagaagaggtaaaaactcttttggctgcctcatgggaactaggatttttttttaaagaagattgaaaggtagtgttttagaagtagcattgagagcaaaaagatcccaaaccccagcttcttaatgtgaaacacttgagatgtgagaaaataaacagtgatcactgaagaaagcagctaacaagaagcaagattttcaagggacagccaagtttctgtttagacaaaaggatttttctgattgaagttgctgtattagacaataataaaaatgttttcagcagtaatatcattcacacctaaaaatatgtgtattatgttgtgcctaaggaatacgacttttcatttatgcaacttagcctacaatgcaataattagagaaaatagcacccttcacttaaattttacaacaaagtttaatacagggttgacattaattctgatcaaaatctttaaaagctgtgtctgttcctgaaattgagcatgattatgacccttgcattttcttaagtggaaaatcaatgtttaattcatttccatagtcccacttcttccctctcagaccttgctatggtcctttgtcaactacctaagatgcagtctaacagttgggctctttaagaaaaagtggagacaggttacccccatgtggaaccagtgcagcttgggctcatctgtctgttgatggatgatgatgctcctggaatggcagacagcacgccctgatggagctgagagctggtggcaccgcacactgcccatccgccaggaagacctgccccactccctccccaggccactgccctgtctaccctccagagacattgtgagaagcaattgttattttcttaataatttaaaatcctccaagttctctgagttccttgtgggagaataaacaccaagcacatcctaaggcatatttattttatgtggagcatttgcttcttggcctctgcctgccattgagtcaacttggagtgactctccttgtgcactcgatcatagaagtggttcttcaattacatctgtaatcccagagtcacgggctgattgaacatctctttctgggctctggaagcatggcttctcaaccacgtccatacacttgccagtgggtgagaggcttaaagactaaaatctaacccagaatgctgctttctctctctgcctgctggagttgggagtggggaggtgaccaggatggctaaagacaggagtgaattcatcatcccagttggtttttccagctattcctcctgctaatgcacatagcaggatagacagttctggctgagatgtggggaggtgaccaggttggctaaagacaggagtgaattcatcatcccagttggtttttccagctattcctcctgctaatgcacatagcaggatagacagttctggctgagatgtgggtaggtgacagtgggtgaggatggatgtggggagtggaaatgccaacctattttgcagactgatatgcagtagcaaggatgctttgcatcaggactgagactaggaaagacaagtaagtctcctagcaagtaaaatttaaggacgtctttgctctcagggctgtgtaagcacagagctggcactagagagtgagtgtctctttaaattttgcacatagtcgcctctcttgcctcatcctagtcccaacactgcttgcatgattatcagcatgcagtctgctttccctgaacccagcgtgtaaagtgactttgtaataagaaagagtaagaagagaaacagggcacaaggccctacataatctgcaatcccattaccttgtttcttactgctttccccctcatccactgggctccaacagtactgaccttgctgttcatgggctgtgccaggctggccccgcctcacagcctttgcacaggctcttccctctgcctggaatggtattctcataggtatctgcctggttcttcccttgcctccttgaagccttcctcaaatgtcaccttctcagtgaggcctcctgggacccatctatttaatactgtcaccagccaccactcccaatccccacactactgacgtaacccctgacacccccactttttagtaatgtattttcctaaggcacttatcatatcaccttccaacaatctgcctaatttgcttaattcctatgttccttgtttattgtcccttctactaacgcataagctccacaaagacagggctctttgttctgttccctgatctgtcccaagttctcttctttgagcagaacctgacatatagtagatgctcaataaatgtttttgaatgaattttcccttcccagagcaagtagatcaaatacagcataacctccattttcagtctttcttgcctctgctcatcagataagtgaatttgtctttctccatcctacacataatatgttggtagaggcagggaaaacattcccccaacatttgccagttttagctgccctgaacatttgggccagatattcacagtataattagactatattctatagctacactgcatagtgcagcagcaaaataaactgattgcagagttcatttttatgtcacccagtgtatctgctttcagtatgtgtgacctggaaagcttctgtgtgatagatcccaaaagcaagagatcctattggcatttgctccctgtttactgtatgggtcaaaataaaaagttacgttctgggaaaggagacattcagctcctttatgaagggctttttgttttgtagtctggctttattatttatcccatatatctgtttcaatgcctcatcaccttagccttcctggtggccatgacatagcaattcaccacttagttttttcattctctcttctcccacccaatatcctttctccttacgcttgacaccacctacccacctccttcccagggtggtttttctccctttaggcagcttccttttaaccagcaattatataagatggaaaactggataatgtaataaaatatatgaggaaaacatattaaattagagtaggttaaatccagcatttctgaaaataaagtgtcattcattccctgagaaaaacaataatttaggatgcagtttcactgctacctaaatgcacatataaaatggatatccaaatacaccctactgttgtctgtcgaggataaaggatttcaaggccagtttgtctcactggagtttagtaattgaaccatatggcttatagattattgaatctagtgttacaagtctctgaaaaacaattttggcttgataaagagcaatggagcattaccgtactttcacatccaatgtccaccaattayagcaagtatgaaagaatgtaacttaaaagctataactggttttctcatcctaactgatcacgcacaccatacaaaatatttcaaaggcacaaaagcatgaaagttctccagtggaacttctgaagttttcagttgctcccaactaaaattattagatgaaatttagtaattttttttgctttaataattggaaaattttcctaagctgctagctaaagttatggtagagatggggagaggtggacagagagaggagggagaaggatgggtgagaaagagagaaaggtgaacacagaaggtaaggatgctactctggagatgactgccaggggtccagtacaagctcttccatttagtcactgcaagaccttggagaagcttccttcccagtgcaagtctcctttgttatcagcaaactggagatgataatagtgcttacctcctagggtggttgtaagtaagcattcaataaccctacttaatacacaaatattgcttaaactatgcatggcatgcagtgcctactctataaatgttagctttggatgttatcattgaaattcataaaagccaaatgttagctttctttctgtaaatataatggttgtgtgttacataggcatggacttattaagccagagtgaaggtggggggctaaattaagtcatctgtaaggctaacatggtagaaggtgtgggcatcctctacgctcaacccatggcatccacttcacctccaggaaggtaccagaagcccaaattgtagtaaactaaacacagcccaggccttggttaggggcccagtaggagcagagaagggaacagcagatgagcttggatgctccactgcaaacatgagtcytaagccaagcacacaagatcagaagtacacaatgtcagaggcaggacaaatggaaaagcaggggaaacaacacaggaagatctaggaaccccagtggcccagctgtagttcagaccacactagcatccccactgtgggaagagagaatgaaacccagggagccaggaagatggggggcatggactccctacaagtctaagaggcccagagaaacactcacattttatcaaccaaaggaagatacgagagagatttgacctggagctaaatacccacttcytaaattagaggaggggaggaggggtcttacccaccttcagatttgactctccttggccgaaataccaatgaggtgagcctacaatccactttcattattaaaggcagctggagaagttctcaaacagacaatgaagacagccatcatcagaaaagttagcaaagatggccaggcgcagtggctcatgcctataatcccagcactttgggaggctgaagcaggcagataacttgaggtcagaagttcgaaaccagcctggtcaacatggcaaaaccccatctctactaaaaatacaaaaaattgtctgggtgtggtggtacatgcctgtagtcccagctgcctgggagctgaggcacaagaatcgcccaaaccaaggaggcagaggttacagtgagccaagatcatgctacagcactccagcctgggcaacagagcaagacttcgtttcaaaaaaaaaaaaagaaaagaaaagttagcaaagactaattacacttttatttacatgtgtatttgcaggacttttgtaatgtttattggaaatttcagccatgaagttgttaaaaagttaatctggctattaagtatgaatcaacattcaatcttctgtaatacaaaattacatttatctttggttacaatcaagttttaagctttgcttaagccaatgatcagactagtccaagggtcaacaaactatcttctgcagaccacatttatcctgtcatctgcttttgtgaattaagctttattgggacacagccacatccaattgtttacatattatctgtggctgctttggggctatgcattagtctggactgtctctatctctagagagacagagttattaaaaggaactggcttatgtggttatggaggctgagaaatcccaagatctgcagttggcaagctggagacccagctgacctaatggcacaatatcagtcccaatccaaaggcctaagaataaggagagctaatggtgtaagctgcagtccaagtccaagtctcaaggtaggagaagaccaatgtcccagctcaaaaacagtcaggcagaaacagcaaattctcctttactctttttttttttttcctattcaggcttccagtgcgttgaatgaggcccatccacattagggagggcaggctgcttaactcggtctaccaattcaaatgttaatctcatccagaaacccctcacagagacacccagaagaatgtttaacsaaatatctgggcaccccatgacccagtcaagttgacacataaaattaatcatcacgagctacaaaggcagagttgaacagttgccatagaaatagaaactatatggccagcaaagcctaaaatgctacctggtcctttatgaaaaaatgtatgctgacctctgagctagtcaatagaagaataaatgggaacacaactagataaattctgtttctcttctgtcatatattaggagttcattcattcatttgaaagtatttcctgagcatctagaatgtgccttagcagaacagtgaagaaaacaagttcttacctcaagaagtttacactgtctagtgaggaaagatagatcaaaataaacacaaagatacggtacatagaaacatgccctttaaagcaatctaaatcagtgggcaaggaaaagagagacctgaattatgctgtctggatggtagaggcaggcctttggtaaggtgatgtttaggcacaggtgctgtacttactcccaaatcaatgcagtaaatcatgctttaatgtgagtatttttgactgaaggaacaaagtgcaaagatggtgagatgaaagcatgcttgatgtattcaaggaaaagcaacaagatcaatggactgtatccaggtgacagagagggagaggaaaargagatgtatttaaagaaatggcaggtgccagatcaagttaggctgtgtagattatgataatgaatttggatttcattccatgtgaaatgggaggtcattggaaagtttatagaaaggagcgaaactgtctactcatgtttaggagcaatgactctggctatggtgtggaatacagcggcaagtactagaagccaggaaagcaataaaaagactgtcagtcagcttctcctaggttttgctgcaataagaagaaaccctaggatcacagtgatttacaaccacaacggtttacttctcacacaggttagatgtcagctgttgctctgattgctattgtttggaattcatgttgaaagaacaacccacatctatgatatcactggactcatgggagaagagaaagagaaatggctggacaacaacatgatgggtctttaagactctactcagcagcagcacatgtcattttcatacacaggcccttggccaaaataaaaccacggccaagcctatggtcaacagggtgtgtagacagaatyctcccaaaggaagggggaagcaaatacgtgggaatggtgataaaatctaccacagcagtcactgcagtggtttttgtatcaggatgatagcagtggaggtgctgacacttgactgtactcgggacctattttggacaagattgctgatgaattgaaaggtgtgagagaaggagaggaggcgagaatggctctactgtatttatcctttacctgatacactagtgccaaatttatgaaataaacaaaatccagccctttttttccacacttagcatccacatccttgatgacctctattctcagttcttttgagggctttgctcttagctggctaagattattagctgcatggaagttactgcaatggttgggtattaataagctctagagtcagacaaatcttcctggggtttaatcttggattctcttctctatgacttaaggtaagtcagttaatatctctgcaccttagttgaatcaagaatakataaccatcatgagctgagtcctttgccttctcttgctgcatcttcacaacagatctgtgaagtgaggtttattgcactttatagattagcaaaccaatacacagaggcattaagtgattttcccaaggtcacacagcttgcaaatctcagaggcaaggattcaaaagtcggtttgaatccaaagcctatactcaaataaatcaaatatagcatttaaaatctggatgttgcttgccttttatagtgcttgctttttttgacagactcaactatcgtaaaagttaaactgattatgtatgaaagataatctgtgagttcatttctaagaaacagtaaaagtgattcttctcgctccatgcaggcaaatccttcttagaggatatatgcaaatgtagtacagaattagaaagccttacttatactctggggccagggaaatagctttcaggagtggatataaagaacgctatatattgaatggggaaggtagagacgatagcagaaaaggctcaggcataaagaataggagtggaaatccctatttaaaaggagaatatgaaaaaaataaatgtaactaaaaacaagtgtatgggaatatgcaacctcactactactgaaagtgatataattaaacaataaatgagactgcactttactaccagttaaataagaaaaacatttttaagaataatgcccaaaactggtgaatatgcattgaaatctggtcctgcatgcattactctgggcaatctaaagtgaaaagtaatttgaaatacatgagggactgtaagagtattcatattcttaaatcaagaattccccttctgagaattcattcccagawaatcaatcaagatattagggaaaaaatgaagctgttctctgtagaattatttgaatgacagctctgaaaatgtagctgtccaacagttggggaatggttaaatcaattttaatacctttactttctagaattttgtacatatattgaaacttgtgacatatacatttttaaaaatgcagattgaaaattgaagtactgatacatgttacaacatggatgaactttgaaaccatgctaagtgaaaggtggtcggcacaaacaaccatatattgtatggttacatttatatgaaataattagaataggcaaatctatgaakacataaagtgatgaatgattgcctgrgactaggtgtgtggggtggggtgcaggaatgaggagtgactgctagtgggtacatggtttctttttgaggygataaaaatgttctaacttatattgggatggtgctcgcatgactctctgaatatactaaaaaccattgaactgtacactttcaatgggcagattatatctcaaaaaagtcacatctcaataacaaagctttttaaaaatacaagttgagtatatactgtaattaaaactaagctacataaatacatgagagacagactagaagtgaatataatgaaatgctaacaatggtttggttcagaaagtggatttgtgggtgaaaatttttgccttctcttactgtcccaaatgtttataatatgattagatttctttgattattaaaaaatagatacaattagcaaacaggagaatcctctcctttgcatttctctctcccctccaccaaaatccaatcttcttataactttccagaatcaagagtcagaattagcaccgtccagcagccctcaaaatcccttctagccatttcaggccattcgatacaattctctgaatggaaaagacaactatattaatagatttaatacctttcaagaatatacagatgaaaaattctggcatactgaatatacatgtgttctcatttttaggaagtgatagaagcaattgcggagtgtgcatttaagacttcaccttttccaattctcctttcgtttgagaaccatgtggattcgtaagtattcaacacattcaggaatgagtctttttcccgaayagggcatactgagtaattgtttatcagatttaagattatttgacatgattaatggtgttcttcaatcatgttgtatattaactggcatgttttcatttgtaggtgatggaattcacttaaaataatcaacattaaaattatccgttggacttgtaggatctattttcataccatagtatggtttttaaattaaaaactcttctttttgcaatgcagtggaacacatttttctacacaatacatgtctctgttatagatttggggtgctgtgggccacttttataacccttcttcattagctccttctattgcacacaatttgagtccacttcatcactttgtggcaggtggggggagagctgtgaattccattttaccaatttgcacttacacagaactcagttcagcaaatctccatattcccccttttcactggctttcccctgtttgttaatatttgtatttgccaatttcaaaatagcctgcatgtattgctgagctacacaaagaaaaggttattttgacttcactgttttatattcattttatcacacattaccaaagagagacacatttatatctaatagatgtatattagtttatcatgtagttactttaaagagcttcagaatgaaagattcttatccatattgaatgaaagcctctctttcatttcaggaacctaagccagatttttcaactaaaagccagcagcacctgtcctaatttggattacgagtttctttttaccctccttcctattgggagtctttcccaggtcactgagcctctttgtccaagtaatttgtaacatgtgcttcaattctctaattcttaaagagttcactagatcttaaagatgcagattggtcatgggcaaatttcaacttgaagaatttctaagtagttaaatgtgacaattttataattatctgtattttttcagtttgcccgccagaaatccatattatatttaccggcttgtggttctgcttcattatgcaacaatcatccaatgaatgatgtaatcctttggcacatagtttctccaacgcttctgagggtcaaaggaagagaaaggaatttattctgttccatgctatttctgttcttactcaaaggggcatctctagaagcagtatttaatacctagtttgctttgcaactaggttctgctttgcaattgactctgttaaacaatttctcatctctgtcaattcatttataattggcctgtaacaatacgtatgagtccattcttgtactgctataaagaaatgcctgggtaagagactgggtaatttatgaagaaaagaggtttaattggctcacagttccacaggctgtacaggaagcatggtggcatctgctcctggggagtcctcagagagctttttactcacgggaagacagagtgggagcaggtgtcttacatggcaggaggagaactaagagagagtggggaggtgtcacacacttttaaacaaccagatctcatgagaactcactatcgcaacaacagtaccaaggggaatggtgttacaccataagaaatctcccccatgatccaatcacctcccaccaggccccacttccaacatcgggggttacaatttgacatgagatttgggcagggatgcagattcaaaccatatcacaatacttgagcacttttctttcaggtattatagtttcgacttgaggatgctttttttttttttttttttttttttttctgaagcggagtttcactcttgttgcccaggctggagtgccatggcacaatcctggttcactgcaacctccatctcccgagttcaagcaattctcctgcctcagccttccgagtagctgggattacaggcatgcaccaccatgctcagctaattttgtatttttagtagacacggggattctccatgttggtcaggctagtctcgaactcccgacctcaggtgatccgcccacctcggcctcccaaagtgctgggattggcatacttatgttcttaaagagaagtttctatttaaattagacaaaatgaaaggctatggttccattctatattgtcacacctgctacactgagcttccccttggcatagccagaaaaatatcaaccgccaccaccaccaccaacataatagctaacctttattaatagcgaacatttattaaacattttttgtgccaagcagtttttgaaatattttacatgcctcagctcatgtaagccttaccacaaacccaggtgcttctaagagtaaatattatgattatygccattttacagatgatggaactgagtcctaaagaggatgaataacttgctcaaggccatgtaactaaaacatgacagagatgggattccaatccagttagtgtggcttcaaaatgcacacttttaaccaacacatctcctacgcctaaacagaagcatcasgagccttcaaaacatcaaattcagacaacgagagcatccaccaggcaatggccagcaaatgtttgcctctgtggcttgtaacccttaaacacaagatgtgttttgcagttcttcacactagtcatttagagatcaaaaactggacatgaaaactaatttctgcactgtgcctaaaggcaaagagactagtgccattgtactgcccttatgggcttaaaaatgataaatttagctattaaaagttcattaataatttctatgtgacaaaagaaaacaggaaaacagcctttccaggatgccatgattgtgtcccaagccactgagataatgtaatggcagtgaaatactaaaagataaaattctattgtggaggaagtgggtgggagttgcttgcttcatatttcccttgtccttcagatatcaaaattgttcagccaccattctttcctgggaggctagcacacacccaaagaaaaccgataagctttcccttcgctggtaaaaccccgtgcttgacttgtgagccacttcatctagttcctgagcccatggtaggcagtagcagcactctttcccactaaccctagaaataacctcagaatccttctcaacacagtgacctcagactagaccagcaagacatctgacacctatttgccatctctgatgaactattttatttccctgtgtgctgcatgtatggaatttcagattcagaactctggtcccagctcacttgggccacacgtccaaaacaaatttatactagaaaaaaggagaaaaggacagggcacggtggctcacgcctgtaatcccagcactttgggaggccgagactggtggatcatgaggtcaggagatcgagaccatcctggccaacattgtgaaatccagtctctactacaaatacaaaacaggtgttatggcgggtgcctacagtcccagttactcaggaggctgaggcaggagaatcgcttgaacctgggaggcagaggctgcagtgagctgagatcacgccactgcactccagcctgggtgacagagtgagactttgtctcaaaaaaactaaattaattaaaaaagaaagaaaaaatgagaaaagccactgaaacttctggttttctctcccaatatctgaagtcacctatccatagacaataaaagggaatctgctattagctgctttcaatgtatcctgttgctacatcagaatcccatgaagtgtcttcaaaatgcagattcctgagctacacccttaccctgactgagaatttctagaaataagacttgaaaatatatttttaaaagccctacttgactctgacatcctacttgtgaactaacacttttataaaaagaattctacaccaaattcaatggaagtaatctttacccatgttcagccacagaaagctgtgaaattttgaacaaggttcttaatttccatggattgcagattcctcctttatagggaaagaggttggtttagttcaaactggaggatttgctcccaagaaatcaagtgagttcctcggtcagaaaaactgacctctgccccagacgctcacaccttgggagtattttattatgctcagaaatgtctgctatgacctgaagctcaaaatgcatttgtgattttttttccctctcactttgtccccatggtagctgatattgatgctctaaacacttcaggattttgttttttgctaattgcaattttaatgccttttatttctgcagttctgacctgcaattaaagttggtttgttttcctctgactttttcaattcaatttgctctctgctctgatttagttccatcaggtgggtgtgcatgtttattgagaacatgaatagcctgattaccaaatagctcattttactttttgctaggacacctacctcttgttctgtccatctcagttgattctgaggcaggttttgtttttgtttttgtttgtttgtttggtttgagggtctcactctgtcacccaggcaggagtgcagtggtgcaatctcggcttactgcaacctccacctcccagattcaagcgattctcctgcctcctaagtagctggtattacaggcacgcaccaccacaactggcaaacttttgcatttttagtagagacaggatttcaccatgttggccaggccgatctcgaactcctgacctcaggtgatctgcctgcctcggcatcccaaagggctgggattacagacgtgagccaccatacccagccctcaggcaggttctaaacgtctacattagacatagattcttgttcttaaaagtgtggtcctcagaccagcagcatctgcatcactggagagcaagttagagctgcagctgagtcctgtaccccaccctggactctgtgttggactcttcattttaataagaccccaggtaacgtgaatgaaatagaagagctaagctgtaaccaccatggtttattaaccacctgcatcagaattatctgcagtctggcttaaaatgcatgttccggggctttggtcccagctacatgaatcaggggactgtggacttgatcctgtcacctgcagcattaacagctcaggtgattccttagtggaattgagtgataatcatggctccagtaaaatctttatctgggcctgatttggggacttcctgacagaggacacctgtttggggatatttgggacatctcccttaaattcctctaatggaaagaatatggttccctggaaaatcctgagagcagggcattcaggtaaaatgccctgctttcactccaggtgtttgatcaaagataattcggggctcccaatttccaacagtcaggaaaaatgtcatctactttggcacatgctgacttaccttaatcaatygcagtggttttcaagcttgaacacacaccagaatcaagagggcttgttatgatgcagactcctggactccactgtcccggagtctctgattcagaatctgcatttctaacaagctcctggtgtgattctgctgatggttcaggggccacacttggagaagtaaagctccatgatactgagtagcatctttctgtgaaagggaaatggagggtttggccatttctttagtgcactctggaacatgtcgtcccagcacaactgtacttcttatcagcagcagccacagagcaggctgacctggtagaacccctgtgcaagttatcactggaggaagaagacttgaacccagggatgcccggggctggccctaccaaatcagccacttctctgcctgctcccaaaggtctcatagacacagtttctaatgacttgtccttcagcaacgacctccaatgcttttcaggatcaattctctgattagcagtttttcttctctccctaatactgctgaggaatgtggcagtgtattctgatggccgcataagccatttagtaagctcccatacagaccaagagaggcctggtgagaaggggcacggttgctgtggaggactttgcaaatcctttgaatctctccttagcctctccctgcagttccaagaaagcagtgactttggggtttcatattcaaatgccagagaactcacyttccacccaaagcacacacttggttttttaaaaagaaaaaaatgaatacaaaatagtgacttttcctgtggaccatttcaatatgatttgaaccgtcaataccaaccccctaaccccagtaaaaaaaaaaacagcccatgatccaggcttaaacattcatggaaaagggaatgaaaataagaataagaatcacattttatgatcaatttgaattttcrtcaagaaggattttcatcgctgttacttattcttagtacagtcacagtcctgctaaaatgtattatcattgcagcatgtagagataactattggaaatcaagttcgacagactgtagatcaaattcaaaatccataaaacccaaaggaactggataactttgtaatgatatttaacattccacgaaatgagaaaaaaaattattgctttttgaaaggtcaagggaagcagtagcattgaaacaatatgaatgttcccctatatcagctgtgtttacaagttactgggcgtaggatttgtctagtctagctggcggacgccgccttgtaacagtggaatcatcttacatttgccctgctcttttaatgtttcaaaggcgtttgcatccattacttcatttcatcttctcagcaccctctgtccctttccaagaacggttattattctcctcattttatagacccagagtggttcagaccctgtcgctcagctcagcaaaccctgcagtgccagcctttttccattataccaggtccctactggcaatatattcagaatgataccacctttgctattctgttatgtatatatgagttgcacacacctttccccaaggtgcctgctacttttatctttcctccaggaccccctccccaagtggacacactgtttgcctgtctgcccttttctacattttgagattctctccctctctttttctctctccgttgtctctctttccctattcagctccctccctgccatccttccttatctatcctctttcatctcctcataaacactcctttgcagcagtggtttacaaatttcacttgataatttacatggaaatatgaaagggttctttctccaagtgtcttgcaattgacttggaatcagcgagttaaacaaaagggactgagcctctaactctgggaatttcaaggctccagttacagcaaatgacatgctgtcccctccacctatgtctatgcaggtctgccttgggaaccacctcacacatcagtgccttcgctgtccatctgtgtatgttattcaaattcacataagttaagataaagatccaggatgataaaaaccaatcctgatgggtgggattagagaattacttctttctgtagttaataacacaaagcaatcctgttcaggttctttggataagcctccctactttccttcttctgttcttgttctcccktagcccaaagcagcaagccaagatggcggagtactgccgactgatctttggggatgcccttctcatggagcccctggaaaaatatccagtaagcagttctgatgtttgtccttgaaggaatgtatgcattattgatgaatgaggttgagggaaaacttacttccttttcatatttatgtttcttggtaagattaatgcagttggtgatgaaatctttgacaaggaggataccagcaatgggccccactaagggtagaggaatgcctctgcactcttcctcttcccacactcttctctctcgctggctgcctgatgaaactcaatcaagagtgcagatttcccaacaattacaatcagccsatagagacagtccaagaggacaggcctctgctcactcccagggaacctcgtcacacctctttgagatgaatggattggcaaaacaggacactgcaggtggcacaatgtcttcttggcctgtccctgctggctgttctctatttccttggatgcaccttttggtgtggcacaactcaggtcgcccattgcattgatgatatctctgctttgggaaggaaagcagcagaaatatcctaaagtagcattttccttcccgcacccttttgcccaatctccatgcatttgtaagtgagtttataccagtccctccgctcattgcaagccaagaatagaggactaacttaggcattctatagattttcttaaagtaacctatcttgtggcttgcacacatgctctctgatacaatatctaatgaccccctcatgggaaattgattttcccgttagatgtacaaacttgaaacagtcaaaataaggcttgcaaatgtggtagcttgaatcttagggctgggaggaaatctgaagccacctcatccacttctgttgatgccagggacgtgcagctaaactacctagtaccaggatggggattttgctgattttaaggggcatctgaaaaaatgatttcatgggctcacctggaagcttctgcccgtctttaccaactcctcctggcagatgcctggcttccctccttcaaaaattcaggccagggccttcttatctgtcctaaatcaagatgattgggtttctatgttccattggaaaattcataaatgttcagatttagtacatcaaatctaccagtacatttctatggtcttcttcatgtagaatatgttgaaaaaaaaagtatagtaatgaaaatatatctttgatataaaaaaaaattagctcccatgtaagatacactaagagtttaatgagcagtgttgaaggtagggaagaagtctagacatttggtatccacagctgatctgggggtctggggaggggatctgaaagagggagcagtatttttaaagaatatgcctttcatttctattagctggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggtgaggggctggtgggctctccccgtcatgttttgtgttggtttaagaattgctgctctgggctgtgcgyggtggctcatgcctgtaatactactacttttggaggctgaggcaggtggattatgaggtcaggagttcgagaccatcctggccaacatggtgaaaccccgtgtctttggtggccaacatggtgaaatcctgtctcttgcaaaaatacaaaaattatctgggcatagtggcacgtacctgtagtcccagctactcgggaggctgaggcaggagaatcgcttgaacctaggaggcagatgttgcagtaagacaagatccagccactgcactccagcctggtgacagagtgagactccgtctcaaaaaaaaaagaatttgctgctctgaaattagcttagaaggactttgaacattcctatttctgcacagttttgaactactggttttctcttgctgctacaaacttagcggcttaaaccagcacaaatgtattatcctctagtcctgtaagtcaggaagccccctgggtttcactgggctacactccaggtgtcagccgggctgtgttccttcctggaggcgctaagggagaagctgtttccttgctttttccagcttctagaggccacccacattcgttggcttggggctccttccagcttcaaagccagcaaggctgcatttcactaacctttctcctgtggtcacatctccctctgaccacaggcaggaaatgtcctctgctggcaagaactcaagtcattacattggatccatccagataatccaggataattgctcccatgtcaaggtctttaactccatctcacctgcaatgtcccttttatcatgcaagctaacatattcatggagcagagacatctctgggaggtcattattctggctaccatgtaagccaaatagtcttcagagtgaccatatgactttaagcttcataatgggaaatattaactatagaactgagcactggatgcattgtcattgatgatatgctgaagagttctggrcatttcaattttttcatgttttaaagaactttttaaaatctgtgacatggcaaaattacttaaattatcttttgaagctcctagaggatgcctaatatcatttcttttccttttaaattaagggtgaaatagattgctgtggttgatgagaaaagaattcagtggcactcatttccttgggattatttgtcatttagtctgatttatcttccaagttcagtcagaagcttggcaatctgaaaatcgcattatagacatctcctgattgcagggtgattaagtggaagaaacttttaagcttgactgtaggaagtttttcagttataagttaaacataggaacaatcaattggaaaactacttagcagtgtctacaaaagctgaatatatgcactccctgtacctcgggagttccattcctaggtatatgcttgctaaagatgtgtatttaggtttaccaagagacacgtacaagaattgcttaaagcagaggtattcagaatagccaaatactggacaccaaatactcgtcaacagataaatgaattatggtatattcacacaaagaaagaatatgcagccatgagaataatctataactaaatgaaaactatggatgaatcactataaataaacataatattgagcaaaggaagtcaggtacacaaaaactacatactgtatgatttaacctatataacacacaaaaacaggcaaaactaatttatgctatttattagaagtcaggataatgggttcccttggaagaaaagcaaccagcagggagcccaagagccttctagagattggttatattttgtttcttgatctggatatcatttactcagacacgtttatttggtgaaaattctttgcactgtggacttacgacgtgtacttttctgtacgcctgttatacatcagttataagattttaaaataattaaaatataaactctaggacaatcagggttaaaaaaaagtagcctgagactctgatttatcttttcttctatttttctgtctcaawtgcctgtttttttattgtttcgattaaaatctttatcaacagacgttatataattctttgaaagggttttgtcctgtagcttttgaatgtgtactttcatcattattgtgcatgtctttcaacattttttcaaaaataatttctgtactcagtaaaaatgttctctttgaagtttggaagtgagtatcattaacaggcctttcattcacacctatttcctaacacaactctatccsttgaatgatagcaagcaaaccttgtcttcctttgcatgtgggtgcttgtgttttttaccatctgcctttcccactaccagttctctgcctcttattaacaggatgcataacacaaatgacgatttttacaggcagtgaacattattgcttaatatagagaaagggcaacaatctgttagttattcagtagatttcctaagctagccctgttgtctattatgcaatcagtggaaacttttggacattttaatatgtaggtacctgaataaagagcaccgctaatttaccatttggttcgtagatgttcacagtactgggaactcaagtaacttgaaaaacgtgacaggtattgtatttcaaagctagtttacttatcatggcccctgttggccagatgcctcttgcaggattcagccctttgctagtagacttgtcctaaggaactagggtaacctaagatattttttatagttcaacaagattcccccaacatccctccaaagatttacaggagaaaaatcaggtttctgctttttacagtaaagaaagacaaattctttctttcccacagacactaaagaatgaccygattggctatttgaaatgactgcgaattgttgggtcccatgaagtattttatagaaagctctgccaaacaattttttaattayttaattaaaagaatcccctctctgatttttttttttwwaaaaaaaaaggtaataagaacttgggacaaaaatttcattataaaaatgcttaagtggcaataccctaaaagaatgtgtctctaatattgtagtaagatacgttttctatccaaaatataatcgattcaccttattaactaacacaatatcagcattataaagtggttgtatgtggctttccttaataaacaatccaatacataaaaacccttgctggtcccagaaatcttttttcccctggagatttttaagcaatacttttttcactrctgtcattcagtaattgaactgtgtcagccaaatgaaaacttttataagcttctcagaggacagtgcagtggtactgtctccatttatataaatcgagtagggcagctaactttcagaaggctggcagtgggcaggggtgcaagttacttcattgttgaaccattattgccatctattgggctcatcgtgctattgcattgtgtgagccctgaaagatagtagttaaatcaatttagaactttcgaaccatttagaacaacctcgctgactttttacttgaaaatcttttttatataacggatatttctgggtctgactgaagcccatagctatggaagaatgtaatgcttcatactgatatgaatatttaacctagcagaaatgtccattaattcttcaggggaaaaacaattcatttaaatgagtgtatattggctacatatgaagctgaattatttctgatggagttagatttccaatcatgctgatatttaaggasttacccatgttatcctgccctcttaaaaataatatcagcattttctacgatatgcacttcgttgtgatgacaatacatccatcaaataagcttgcagacaaatcataggataaagttggcccttcacgatttttatgtagtgactttgctgccaaagccccagagttcctgccccagctcctaacttctttgacttctgcaaggtcctctctggccttgggaaaaatgtcaacacaagatcactgagctatgtgctggccacgcattgcatggaagagtcgcggcttgggaaaggagggaaagatgaaggagggatagatagtatatctgttttcggggtcatagagaccctgagagagtgtttgtatatcaaaatagaatacatgtaccatagaaagcaaactgtattaaatgccagcaaactgttttcaatgccacgtgtttaaaaacatatagagaaaaaatattgacacgcattttttaatagaattttgaaattttaagtgctatttattaacaaatccagtttaggaaaaaatctatattcaaaatgtcagtataattttctataacgaataaaatttaaatccytgaaaaaaataattttaaacagcccaacttccaaggaaatctgtaattgattttaggtaaaatatgtgttacaaatgctgtaaagctaaatgttgaaatggtgacatgatgatctgttattaaaatttgacaggagaagctgatacggaaagtgacgacgacgatgatgatgatgactgtaaaaaatcttcaatggatgaggtgggtacttagggcttctggtccctaaggcattccaccaccctgtactctcctgggtctgtctcatggtcactttstgccatctagtggcaaaaagtagatttgtgccttccaattgccagcttcaatttttgaggcaattaaatggcttatgaaatgttccacaatccggagaagatatggcgtttagaaaaatgatcagaactgtgacattcattgcattgttttaattttggaacactagagctacctatttatataaacttaggcatcccgagtaacttgattagctcaaaaatattaattgcacagaacctagaagagaatcagaagcagatcaactggaattttagaattttgtcttaccaaaagtttatactgaaacaatctgggcaacagagagagacctcacgcctttaaaaaaacaagttaaaatgaaagataaaacacatccaggtgcagtggtgtacacctgtagttccagctactagggaggctgaggcaggaggatggcttgagtccaaaaatttgaagctgcagtgagctatgatcacaccactgtgctccagcttagaaaacagagcaagacactgtctctctttaaaaatacgtattttaaagtttatattgaatctgctttcaaatttgttagatatgttctgtctcaacgcttgtagctctacaatttagtaaaaatgaaacaaaaaataagctgctcttacttgatgtccttcctcttagaattattttttaatgtctaaagttttgcttaattatgttccctcactacatttcaatttttgatttccaggaggaaaacagcttaccatgtctggcaaagtatatgttcctgagaatgatttcaattgtgtataatttctgatcagtgattctaaataatttttaaactctcttactaattggatagtccatttgcaaatgaatgtttcccagttaacatttgacccaaatattactaccagaatttttaaaagaaactcatctccatgcattctctcttctaaaaatgtgagacaatattagatcactctacagaggcccattttgtgccaacactgcattattggttttctttttcattaaaaactctatcaaagtaatatgtcatagctaataatagcaaaagcaacatgagattgtagtaccacttgccaggcactgttctaagctccttcacataaattaacttattttttaatcaaaaacccctatatgctgtaggaactgattttatcctaattttacaaatgagtcaagtgaggcacagagcaattaagtaagttgcccaaggttgcccggtttctaactagtggacttgggattcgaaatcaggcaggctggctctagaacgcgagccattaatccctgcactatgctttcctgcttgtctaagacacatcaggagccaagaagggagggagggaagaatgttgatgaaggaaagcagttgtttacccaccccygcccatttccacaaagcaatctttttattattattatcaattttcccttcatttggtggtcacctacctaacaattttcttattgtacagtgaattcttaatttacgaatccgatgagaacacatggacacataaagggacatggggcctacctgcgggtggaggtgggaggagggagaggatcaggaaaaataactaatggatgccaggcttaatacccgggtgacaaaataatctgcacaacaaaccccagtgacataagtttayttatataaaaaaaaaaacctgcacgtgtagccctgaatttaaaataaatgttaaaaaaaattactaaccttagacaacacctatggacaccctgcaatggaagatgagctatagctcagtgcttctcaaactttgatgggcattccaatgaccttagtaaaatgcaggatctgagtctgaggcctgcagaggggctaagatcaggcatttctaaatggaaaggagggggcaggggatagggagtgattatgttggggccatgctgccagccaccattcaacctcccacctcccttcctccctcccttttataaaatgaggtgttgctgttgcctttctcctgtaatgaattttcattttgtaattttcagaaagggagggatgattttctgcatgcttgaatcatgttgtcattttcctgggaaaataactgataatataatgctgactctggaaatgttttcttttttattcctacttccaggggactgctggaagtgaggctatggccacagaagaaatgtctaatctggtgaactatattcagccagtcaagtttgagtcatttgaaatttcaaaaagtaagttttccctggagaaaaacccctcttgcagcatataatgattatattttaaatacggagtaatgggaccaaagaatgttacccttaatagagmgatttatgcttttgaagtcttaaatatatgtacattttgactgccttgttactttwcacatataataaatatgcatgtattgtaatatataaaaataaccatatgagaaagtattctatggtgttctccaaaaatatttaatagggctacaggccatacatggctatcggaaagacacatgaccagagtacaactaattgggaattgtactttgctttttgttcgcaacacacagtgagatccatctgttacataagtgataatgttgaaataaactatctacctgtttcccagaagggaagcaggcagagacttgatgaaccctgataattagaaatagaaccaatttatctatattccatttgtccatcacatgtatatatttagaagaaaatgcattaacttcacatcactttgtgttttccctttattcaactatacatccatacttgtgcaaagaaaaatatcatctttacccagacaaaagggttcttttatgaaaatgccccttgtatttgcatgaagcgtaagatgctatcagattaagggaatccttgaaacttactagccacttataagggtgtacccttaaaaacagaaatttgcctaaatgtactagcttctaatcaaggatggctttgcagctatatcaaaatccaagcctctaccaaacacgcttgtttatatttgtataatcttacaaaaagtcttcacttagtggtatatgcaacctagatctctacaacaaagaattcaacttccaagagtttatatataatgatttctcaacattgaattcgatgtcctaatttctgatgtttcttacaagttgttttctttgaaacatcctagcgtagttatttttatatcactgtaatttcattggctgcaatgagtttctctaactcattagttaaaagttccaagacaagtagccaagtgtgagaaagagccaatatatttagattcttcagaacctggaaacaacagcaccagctagactcacaaacaagcacttttctccttgtgtttaatatcattttataaccttgaaaaaagaatattcaacatattttaccaagtacctattaatgttgactgaattttaattaatagttatgcttaatttaataagtcatataaaggtagatttatgatggaccaaaataagagaagccaaggtttgccttagagtggattggagaaggtgagaagatggatgacgaagcctggaaatcattaagaagaacgaggttttaatttcgaaagagaggtcaaagagggaaaatatctcaaagataactcagtttaaaaaaattcagagctatataaccaccctgtgctatacttatctaaaatactgctcataattgttggtttttagtggggatgagggtagagaaagtgattctcggtctttctaaactaagataactttgttttctttctctcactctaattggaggcttgaatttcactttcaaaatgtttctcttgtgtttagcacatcctcctctctggcctctattttattttatactttattagtccattctcgtgctgctatgaagaaatatccgagactgggtaatttgtaaagaaaagaggtttagttgactcacagttctgcatggctggggagacctcaggaaacaacaatcatgaggcggaaggcacctcttcacagggcagcaggagagagaatgagtacaggcaagggaaatgccagatgcttataaaaccatcagctctcatgagactaatgcattatcatgagaacaacacaggggaaccacgcccataattcaattacccccacttggtaacccccccktgacactgtgggtattacaattcaaggagattttgtgtggggacacacccaagccatatcatgtatctaatatgaaaatgaagccatgagactggaaaatttccaaggacctttctgttttgaaagaccataattctgtcatattagttatttgaaccaaaaaagtatatacaaactgataaggtggcaatgtgggtatgaaagagatagtcagcacctagcacaaacattcccatggtctcttttgttaaaccccatattggccctaagaaaaaaatctgggtgaatttagaacaaaagattcccacggggtccctgctcttttgacaaatttttttattgccacactatactcatctagaattcattcatgtccctaaattacaaaagcataagtagctctgacccaagtagcaaacgttagaaaagacaactaacaagactcaacttttgttacaggtaaatagtgcactagaaaaaaaaattaaatattgaaattacattgaggattatttgccctcaacttcactgaatatttacccatttcttttataatgttataatttatarcaatgaattgtatttctcaccttcccyttttttgttttgttgttgcttaactcagaaagaaataaaagttttgaaatgtcttccttcgtggaaaccaaaggacttgaacaactcaccaagtctccagtggaatttgtagagtatccttgatttgacgaatgactgcagaatgaacacagctgaagtcttgtgctatttgttcatttggttttttaataaggagaaagatgcataaaatggcttaagtatatagcctggggcggatraatagtttcaggtatcatatacaatgctgggcggggtagtctggcctatagaacaaaaaactggtcttggaataaaggaagcgtagatttcaaggttgccttcacaccaccaagctctgtgtctttaggcaatttgcttaatcctgactttccttgtctataaagcagaaataattatactagctttatggtttgctctttggattaggtacaacatatgtaacatgagtgtgcatactttacacatatataagatatatgtaaagaaatatatacctgacttggcatctcacatacttatatgtactatatgtccaaatagtagggatgatgatgatgacattgtaaatataaatatacattactaagactggatttattgatattactgacaacaaaaatttttgctactatccatgaactaaaataaagtgaaacaggctattaaatttctttcataaaattaacagtaaatatcacaaagtgctcaatttcatgtaataagtcccagaataaagttaacctttaaaattcatcagtggaagaagaaacaaatgttgactccataaataaagtcctgctagaaaattatcatcgttagtattccttattgactgtgtgatagatcttgtcttatctcatttaatcctcacaatagtcctatgacatagaaattgttaaatctattttatagatgaggagactgagtcacagaaagacaaaataatttgtccaaggttattcagctagcaagtttgagagttgaggttcaatttcattttgcctagctcagaaccctaaccaaccttcacctaacttggtgataggaactagtcagtcatgttttaaagacatagcatggtccaacaactacaagattcttaggatagaaaactgatratgataggaaccaaaatattaagcaagatcagaaacttccatggtacattgaccttgctatcaattataaagagtaccacagtcttggcaaatagcattcccagagaaaattaataaaaattagcagacagcatttcaaaaatagctatacagtgcatattatctacttctgccaaacacaatatcattctttcaaatgatttaacacattccagcctccttgtgtgtccttagtcattaagtctgtccttaatactctccacaaaatcacattgactttggctcagccactttttgctaccccattgacttttacccacggggctctgcaaaggtgatgctatgcctatgtgataagagcatacttattctgtttgtttagaaagctttttgcatatttgatattactgacaacaaaaatttttgctattatgcatgaagtgaaataaaatgaaacagcctatttaatttctttcataaaattaacactaaatatcccaaagtagcccaacgagatcatcaatatttacttcattttccaaatggagaaagatggaaggtagcttcttagttactattattgactaaatatttttataattgtattcactacttaacatgatggtccagatataacaaaatgcagcttagcaggatatatccaaaaggaacacgtgtggattcatccaactatatgcctcagctcttctggaatgcaggttgtcagatggtggcacttaatttccagacaatgggtaagtacatgcttgttcccattctgctatgaactcacattgccaagtgtccaaaaaccattcttacataattgggggagagaaaattgccagacttcactgaaaaaataaataaaagcaaatttcaatgaagggaatatcaatgcataaaaaaagtgaattttgaaaatcgagacatgttcttcaattattctgtaaatggatctttatttctacaggctttgcattatttttcaaacaaaaatttttatgctttttaagataatacatatttattttgaaaataatggaaaattcagtaagtattttaaaaacaaactgccaggaatgctaccaactcagagattccacagtgttgacttttagctttgtaatctatgtcttttttgtctacatataaatgctttttttatgtaactactcatttaaaataaatacatatatattcatatatacatatataaacacacactcacctaagtgccatagagagacatgaatttcaatagctgcatactaagcatatttcacaattcgctaaaaacttatttctattccctaaatttcttttggaaaatattttaaaaacagaattactaacgttaaaagatgtgaacagtttaagtacctttatgaatattgccaaattgtctgtaaaaaatgttgtgctacattactccgctgtcagcaatgtttaatatgacgtggcctctcatttgcgatcttggttaagtattatcgttaaataataataataattaaaccagacaaaaatgtgttatttcactgttattttaaattcatttcttgaatcattattaaggttgaactttttaaaatatgtttcttggtttttgtatttctgcttttatgaattacatattcaggactatcgtcaattttcttgttgatttataacagcactttttatttaaagggtrtattgtcttttgtgaaacagagacaattcagtggatcaggtcaggctgattaatgtttaattaaaagttcttggtttacttgtatgattacagcctcctcaccccaggatgaaagccttgtgctcccatttttctsatggtttcttttttatttaaccttttcaaccatcaaaatttaattttggtccatagtctcagtgagatcaatccttttttttcatcctaaacaatcatcccactgaactggaattacacgttaatagatacagcctttttcattgttgttaattcagacccattttttcactttgtatcttttccattaataaatttgtctgccttcctggatgcaataactcactgtttttactgtattttataatatggattaatacctggaagtkgtgattctcctttactactattaattttcaattccttttttgccattgccagtggaattcttatttcaaataaacttaatttaactgtattatgttttccttgactactaaaaaaaaactatttttaaaatcatattaactttataaatttatctgacaaaaactgacacctttttaatttttagtttttctgtcacaggaaaaatgcttttctctttactttaaaattttttgtattaagtcctcagcaaaatcacttgtcttcattagaggtctagttttcttagactgaatctttctttttatttatattatatttttaacagattgtttctggatatttatatttgtatatttgtttattttataaatgattgtattttacaaatgatcatcttyctaaactcttataatagcctattttttgcagtacattccgttggaatttttagacacacaaagacagtaatttaatcatatctcatttctccacctgccttatttattgctttggccttaccgttctcaggtattaaatgagggttccgagtgggcatctttcttttttattcagtaggaagttcaacattatgccttttattaagtatctatcaagctctaagccacgattaagagtaatttgctagatatttatggctttttaaaatcaattaatttatttttattgatacataatagctgtacaaacgtttgcagtacgtatgataatttaatacatttatataatcaaatcagagtaattgggatatccatcacctgaaatatttatctttacattagaaacaatcgaattgctgtcttctagctatttttaaatgtacaaactattaatgttaactatagtcacctccttgtctatcaaacaccaggtcttaacgtcttctatctaagtgaagagtgggcatctttctcttcatcctgatcctaatatargtttcactgttgtgatatcatcaagtcagatattggctgtgactttgagtcagatattctttaacatactaaaggacacgggtcctatttgactaatgttttagaagttggtattgaatgttattaaatgtctcttggacatccattgggatgatcatatgttcatttttcagacataaatgtgataagttatcttaatagatctcatttcctaatatataattatccttttgttcccaaaataggctctacttatttgttgtgtattatttttagaacatatgacttgctaatgtaatttttaggcttttgaagctaattttttcaagtgtcataaattcattattgttttgaaattttgtccaattttgacatcatagttatgtttataaaataatagtttaataagagagaaaatttcactgatttttttctgctctaaaaatgatttgttaaatgaaactttagaataattctgccatcacctctttattatgcacatagagatgagtcatgacacagataatctggaactgttgacaacttcccagattctttacaactttaatatgtattctttcactctatcagttgcaatatgtgtgaacgttcatctgatgcactgagtctgaggaaaattttgaccagtaacctttgtccactggaaaagagtctatgtagaattagatgttmattgtaagtaatcacagaagtgcaaattataaaaaagaaattttttgtacaaattaaaaagcaggaaaaggaataatagaatcctcttttaatgaggcatggagaagtccattctcaaaaacatggcttagtagtataagctggtttaagctttctgaagggcattttagcaaggcatcaaagaaaaattttccaatgaggacatcatttgtcccaggaattcctctcataagaaaatcactgatcatggcttcaaagatttcaccacaatgatgtttatcaaaacattataagggtgaaaaattagaaaaaacataaatgtgcccaaaaggggaatggttaaatacattatattctaatatattgtattagatattatattctaatatattgtattagatattatattctaatatattgtattagatagtgtatcatattagaaattagatattagaattagaaattagaaattagatattagatattgtatcataatattctaatatatgctttatatattagaatgatatatttaatatatcattctaatatatctaatatatattagaatgatatatttaatacattagatattagatatattagaataatataaataatatatctaatatatgttagatattagatattttgtatatactatatttatatataattatatattatatattagatatattatattatattaatatttaacatatattatacaaatatattattctaatatatttaatcaaaggaatttgagacagctgttataattaaggcagatacatattaaatgaaatcaatatactgtatgtcaacaatatatttgaagtggaaaagcagactgcacacccaccagttggcagtgattatttctggacttggggattagaggtaatttttttcttatctgtgtttcctgcatttctacaatgactctcttccaagggaatacagtcacaaaagtggactgggatcaactttactttacaatcttactttcttaycccaartatagataaactcacaataaggcttgtgtttttgatactcagacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaaggtaggtataccccatcacaaaattgttcctaacaatagtgttgaatttatctacattgcataaagaagtggcttagtcattaaaaatttagtaactaggaaagattctactttcttcctacattttttttctctaaagatcaaatacacattaaaagttttcgtaaggggtccgtgtgttctcattgttcaattcccatctatgaatgcacacgggaaggggaacatcacactctggggactgttgtggggtggggggagcgggragggatagcattaggagatayacctaatgctaaatgacgagttaatgggtgcagcacaccagcatggcacatgtatacatatgtaactaacctgcacattgtgcgcatgtacmctaaaacttaaagtataataataataataataataataataataataataataataaaagttttggtagggtcgggcgcagtgactcacgcctgtaatcccagcactttgggaggccgaggcaggtggatcacgaggtcaggagatcgagaccatcctggctaacacggtgaaaccccgtctctactaaaaaatacaaaaaaaaaacaattagccgggcgtggtggcgggcgcctgtagtgccagctactcaagaggctgagacaggagaatggcgtgaacctgggaggtggagcttgcagagagcccagatcgcgccactgcactccagcctgggcgacagagcgagagagcgagactctgtctcaaaaaaaaaaaaaaaaaaaaaaaaaaaaagttttcataggccacatgaataagataaagcgactgaactttattcttaatgataaaaatctgactctaaatcaataaaatgagttggagagactcatcataagcaaacctcttttttggtgtaactaacctactatgaaatttacatgataattagtggcccatattggagagattttccggtctttttttccccgtttggttcttagaaaattagagacagaacattccctcaataaattatcaaatgttaaacaaaagctttcaarttactttaaatggtttttgaaaatcttccagagtattcagagattttaaaacacatattaatgatcattaaataaaagagttgctttattaaatatatatgtatatatacawgtatgtcataaatatataaaaatcatagatatatwcacatacatatgtatatctgaccctaaacaattctaaatttttttagtctttgaaattgattttatatcagatataattttttagctaccagaaaatatttttaatactatgaaaggaaaatcaattttttagaatacattttacatggattcttcatcgttaaagcttttcaaaaatattgtctgttttctgtttaactgaataactatagaactaagaaatttttttactggacataaatgtaattttttgattaaccttaaacaaaggcatttgaaaaactatgtaaaaagctttctataacagcttcactaatttctttctaccctaagcagttgagcacatttttaccwtaaaactttcgtcactttatatcaagggtttaaagaataaaatttcagtgaagtgtctcataattatatcttttgaaattacttcaagccacatgtataaagagttcaagttggcagaattagagtttattttaggaaagtattttcagaaaaggctgtttaattcctgtcaggtgtgataaagataaactcataagctccatgtactgatagaatgctacttttagaatccttgtcaattgttgttatagttcggttgaattaataatatttttgctttgcttgcagattcgtcttgttttgaatgtatttgtttgcttatttctttttttgtcttgaaaatcctactgtgacagtaagcaattataaaacaatgacacagaggcaggaaagtacattgagttgtgaaggggaaatagttgatccccagacaagtgtaacctgctgctcctgtccagaatggagacgctgctccagagctgtcagtctcccctgaatggacagttctcactgcagtagagtcctacctttgacattatagctagagccaagatacagatcataactttccaattatgcctttgttttcatcttctggcatagattttataatgccagaatggacttgtgagctcacatgatgttctaccgtcctatgttactgacgagagcattgtggttttggtgtcatgaatttagtttaggactctgctttggtcaaacatcttaaacatacaacatcttctgtgcatctgaattccaagtaggacttgcataacttagaagtttcaaacatgttttgaaatgcttgcttatttcatagacatagttctcacatagaacctcaagttaaacaaagagattgttgctagcaggtcccatgcactcaagccaaatagaacatacaggggaaatgagttgtcccagggcaaattcagagagccttcctgatgactttctctctgaattactcagaatttctgacaacatcagcatatagctgactttgactttactcagcctttgatagctattctcatgccaccattttgtctgatttctggcccagccataattctgtcccctttcacaatcttgagctcagattgtgagcccagccataatgctgtccccttttcacaatctggagctcagaaagttcttgaccagcaggcaattttcttgtaaccacataacccagattcaccaggtttgctctgtcagcacttgcttcctgctttccccttcctggtatacagcagaagcacatcttgtttgcctccgctaacctttatgacagctrgtggatagttcagattttgaaaatttgcatagaaacagaggcagacatggaagacatttataaatacgtaatattaaaaatctcttttaagtctataatatccattagttctgtagctagacaaagatggtgacaccttgtgagattaggggtaatgataaacttatcttgatggtttaaagtgaatacttgttcatttattcctcctacaatactgtgtcttattaattgactacttctaacctcaccattttcaatatccttctaccaacctgtgtttgtccattttcacactgctataaagaactacctgaaactgagcaatttataaagaaaagaggtttaattgactcacagttctgcatggctgaggaggcctcatgaaacttacaattatggtggaaagtgaaggggaagcaaagcacacctcacatgaagggagaagagagagagtgaggggggaactgccacacacttattaaaccatcagatcttgtgagaactcactatcatgagaacagcatgagagaaaccactcccataatccaatcaccctccccaaatatgtgaggattacaattcaacatgagatttgggtgaggacatagaaccaaaccatatcacaacccattaagtgaaagggaagtcatatttctactcttgcttctattccattttgcttataattcaacatttgctgaagagcatttgtggctctttaaagtattctcttatgtctttgttatttgcatatcaaaattccttatggattgattgatttattgattttctagattatttcaggtcagtttctttctgataagaaagttggracttacgtggaagtagatatgtttggtttgcctgtggatacaagraggaaggcatttaagaccaaaacatcccaaggaaatgctgtgaatcctgtctgggaagaagaacctattgtgttcaaaaaggttggtcacatgttcttgatatgagttataactgcatttttcaggtgttttacactgagaaaataatgaaatggtgaattatttgttatttaatttgaaaatttacacacttataaagcaattaccttttgaaagccattctgaaaacccttcaagaattctgttaatcactggtttggattttcagaattgtattgtaaatcarttcattctagtatgcctcaaatggacggccataaaaacatatacatttaactcatatcatctgatagtacaaatgataaatgatacattttaattataactcaaagaagtagagtggaagtagggaataatatagtggctgagataaagaaaattcatatttcctttaaaaggaatattatttaaattccccaaaatctctagcctctgagagctggtcattcaatcttgtctgggttctatctaataaagttgaaacctttcacactcaactgggcccttctctttcttcaccaaaaagcaaatcttcacacatgcttatcatgtaaaggaagaaagtaggttcagtgggaagtagactttttagcctactctttgcttttttctggccaaaatatctacaaatccagtcttctgcaaagagaatagctatgcggaaactctctgtgctctgggatttttccatatgttaactgagtttaataataatgcttactatactgcttacttcttacagttattatgaatattccataagtaaatacattgaccacacttaagaaatatctagcacaatgaaaatattcaataaatgtgagtttgctgtttttgtaaacaatacatttttaaagagatagtcgacttcatgttcttgacataagatataactgcatattttagatgtttcacactgaggaaagaaatgagtagttgctctttgcttactgtgggaatttacaaatttataaagcaattgtattttgaaagctgtcctgaaagttattcttgtttttcagtggtggttgttttcactttttttgctttcactttgaagatgcaaaagtcatttgctttgaaaacataaacgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcttagtgggtgcagcgtaccagcatggcacatgtatgcatatgtaactaacctgcacattgtgcacatgtacccaaaaacttaaaagtataataataataataaaaattaaaacacaaattaaaaaaaaagaaaacataaatgaaatattcacatggtgataaaaccactaaactctttttgttgaaagatagaacttttgtcatttccacattgagaatgttcatgtaaaaataaaacagcctatttttttaacaaatgcctcattaaggcaaggtgataaaacatagatgaagccctatctctggcaacccatgtcttctcctctgaaaatgaaatttatagggcaacatctcaactttttgtctaaagtagctaagtagaaacttctagttggatctgaaaagctggtcctggccaggcgcagtggctcatgcctctaatccgagcactttgggaggccaaggtggtggatcacctgaggtckggagttcgagaccagcctgaccaatatggtgaaatgctgtctctactaaaaaagtacaaaaattagtcaggtgtgggggcatgcacctgtagtcccagctacttggaaggctgagacaggagaatggcttgaacccagaggcggaggttgcagtgagccaagatcacgccactgcacttcagcctgggtracacagcaagactctatctcaaaaaaagaaagagaaaagaaaagctagtcctgattgaataatacctttctaattatttcttggaattgttcattcttataaccaggtgtgtccttaatgtcctttgtaggtggttcttcctactctggcctgtttgagaatagcagtttatgaagaaggaggtaaattcattggccaccgtatcttgccagtgcaagccattcggccaggtatgggtagtgtgctgagaaaccttttatcaaagttgcaaaraaaatcattactgcttaaaatattactagaaaatgacttaagaaactattttctgctttgtaattttgttatgtaacaagggcgatgagatttagttacatgtttttgtgacatgttgtagtattaatgttagtyaactctttcaacaataattatgtgtaacaaayaatctgaaaacttatatgcaaatatttatcttcgtgctcataggtctgtgggttggccgggtttggctaatctagcctgggctccgcagcatagctgtgcttcaggttctgggttgggtctatgtctgtcccacatgcgctcactctggggtccaggctgaagtggcagttgcttctacaatakggacttctcttggcagaacactggaatgtctaactctgcatgtgcattttaagcctctacctacaccaaattactaatatactgttgactaaagcagagcttaagcacaagtcaagaaatcacgtcaaggctgggcatggtggctcacgcctataatctcagcactttgggaggctgaggcaggaggatctcttgaggccagaagtttgaaaccagcctgagcaacagaatgagaccctgtctctacaaaaaataataataacaattttttaaaaaaagaagtcatgtcaagtataattctgttatgggggcaagtttggatcaataattcagtctatgacatgtgatttggaattatcttttgtgggaaaaatcatacggttggaaaggaaaaaatcacattgaatgttttcttgtctgatgagaaaaataatgccttatcattcataaatgttattaaaatgaaaaaagtgatttgtttttcatctaaagtaacctgaaatacatgctttcatcacatagatgcgcataattataactaacattggaaaggaaatatgtgctacacagcattmttctcaccttccaggctatcactatatctgtctaaggaatgaaaggaaccagcctctgacgctgcctgctgtctttgtctacatagaagtgaaagactatgtgccagacacatatgcaggtaaacaayttaactcaaataccactttactcaaaggggtatttctgtctgagtcaccatatatttttgggttagtgaaaggaaaactgaaccaaacaaagcaggagattctggcttcagaatcacccctactttcgtatgtatgtttagaggtaaattgcttgagccattgtgaatacattttaatttaacgtattttaattaaaatcacaacacctcagttttttgaatatttattcccttttagtcttattctcatgggcccagcacttaccaactcatgttatccattacaacaaatgtctaggtctgtacactgaatttgtcttccaccaattttagaatgctgattcttttcaygggtgacatcctaaatttaaggaattaaccaagaatcataagtgtaaatgcttatagtgccaagtagcttgggtgtaagacactggggagtagtggagaccatggtaagcttggggctgtccatccaaagctggcagccataactcattccagctaggcactgcccttcaaataactatattggcaaatcattgggttatcccaacagtccggaaagcaggctttttatgtaaaatgtctccatttatgaaacgtcatttgggccaaataggacaattgggtgggccattgccggaatggatgggaccttcaaaaagaaactaaggaatcaagaatattcagggatcctgagttgaagcctgtccagtttgactctcagaactaaactcttaatttctctcttcctgaagtttcaacagagtcctaacccttgtccatgttcaaagtgttggatagaggagtagatagttatatgggtagacagaagaatggaagatggataatgactgggtggatggatggatggatggatgggtgggtagatgggtgatgaatgaatgcatggactgatggtcagatagatgagtaagtagatgaatgatggataatcaatacttccaggacctttgatctaaaatatctcttccctatttagatgtcatcgaagctttatcaaacccaatccgatatgtgaacctgatggaacagagagctaagcaattggctgctttgacactggaagatgaagaagaagtaaagaaagaggtgagagggtgttttaattttacatatagcattaagcatgatcaccacacctacttgttggctttgcctaagtaatatcacataccttgggagaaggaatagcacattggaacaacactttcatgcagtttagcatcatgtcacagaacatctagatgattgacttaaatttttcacatttcattttcttttggcattctgtggataccacgagcatcttatcttgtgataaaattaaactgcacacatcttgctatttcagatgaaactttctacatgattccatgctaattaaaggtgatgagcgcatttaaaaaggaagataatcatcaaatcatttagggtttccctttrtctttaatgtagcatgcaggattttcaaagtgcttttctgatttttatagtacataaaatatttaacacaatacctggaaaatagtatgagtcataaagagtctactgttattattagatggtatatttatgtattataatgtgtgtcctgcaaataattgatatattattccaaattagatgtcacaatgcaaagcataattaaggaagggtctaaaaatagtagaaatgaagtttaaatttataaagcttctatgtagactggcagtctttttgcttttaaaaaaagtgaattataacttgattattaagggtgacactaatattaaaaatagtgataaaaatttgctattttcatattttattcagaggaaaaactcgagaaaaaagatagaaaatggagaactgtcartattgggggaaaaaaccttgaaaattgttttaataagtataactaatagttatccattaaatagtccatttaaatagtctattaaagttgacattgttaagtaatgtttttcttatttcgaaagcatcctcgatttattatagaaaatttaaaacgtaaaaatgacaaaagaaaacaacaaagaaatcaactgtaattcaaacatcccatccgctcagagatagccacattaaatgtggggtgtatacatatctagtctttttatgcacaattgttactctttcataaaatgggataatattcacagtctgtgttttaagtgaaaataaaagtattaagtatctcattgcccatgtcattaaatattcttctatgacatgacttttaataactcatagccttctatcatatagctccaccataatttaattactaagtccccaattattggatatttgcaatgctgcactattttattttatttgtgggtacatagtaggtatatatgttacggggtgcatttgatattctgatacagacatactgatttttgtacactgatttttaatcctgcaactttactgaatgttaatcagttctaatagttagttggtggagtcattaggtttttccaaatacaagatcatgttatctgcaaacaggaataatttgactttttccagtttggatgccctttattttattttcttgtccagttgctctagcttggatttccagtagtatgttgaataacagtggtgaaagtgagcatccttgtcttattccagatctcagaggaaaggctttcagtttttcttcattcagtttgatactagctgttgaactgttatatatggctttcattgtgttgatgtatgttacttctatacccaggtggggtttttttgagggtttttatcagaagggatgttgaattttatcaaatgctttttcaacatcaattgaaatgatcatatgggtttttttttccttcattctgttgatatgatgtatcacattgattgatttgcatatgttgaaccatccttgcatctctgggataaatcccacttgggagaatcatagctcagtaccttgyttgtggtgggcaacttctrtgttgcaattcatgctccagagaaccctgtgggatcagtctgagactggagtttgcctgaggccacatttcgacttatcttcttccctgtcttaacctgcttgcctcacctccctgcagttttttcctgagaccattctctcagttactcatgtgctcaacatgtgctcaagaatcctcatgtccacttctgcttctagggaaaccagcaatgctaagtagcttgctgttttataaataaatacaagaatgagttccctatctgaattaattcttaatcaaaattaagaatttaaatatttgaaaatagttacatctctcattctgatatttcttcagttataatagtgctttttctcttttccatggcctttaaaagattaagaaagactgttctatgagtttctcattttactcatatgaacatcagtatgaaattaatttctctttggaaatccaccaaaggttctcaaattcttttctctttttcctgctttacttaatagcatatttaataaactataattaaaggtaaagataatttacatagatacaaataaatcactattaatatcattcttctctaaatagaaaacaggacctattaggtacaatgcatattacctgagtggcaaagttatctgaataccaaacccctatgacacacctatatgacaaaccctcatgtgtacccctgaacctaaaataaaagctaaaaaaaaaagaaaacagaaatgtcctttttcaactggatgaattttattcygtaagaaatagaggttaaacaaaagcattttcaagtgaaattacatgtattttcagtatttagaggaaatactttttagattatcaactttaacccattagttagccattgtctctaaggaataagcacttgcttcaagagaacatttcaacactaccatatttcagcctactttttctattgtctgactcacatgttcttgtgagtgagctgaaatttatctaaaattgtttcaaatagctgggtgtgctgacacatgcctgtaatcccagctactcgggagcctgaggcaggggaattgcttgagtccaggagacagaggctgcaattaactatgaatgcactactataccctagcctgggccacagagaccatgtctcttaaaaataaaataaataaaataaaataaaattaaaataaaataaaataaaataaaataaaataaaataaaataaaaaaataaaattgtttgtaaatatttcctgattcagtgtatggccccgattcgatatagcaattgagctaaaggtctcataatggaacattttactaatggtgcttcagagatcatttctgtaatgactaggggaaaatgtcactctaaagaatgagagacataaggcctttgaggttgtagggctcttttcacaaattgatgtcctttgraaaccttatctttgcaccatcaaaaagttattttaggaggataaaatgtacaaaaatacagaagtagagttttaggtcaatcttatttttgtttttcttttcttaaaggtgatcagaaagcatttttagaaatgtataatattgtttaaatttggacagtatttggacatttttcagttttagaaaaaattttagaggcatggaatcacatggagtctatattggtctaatagagaaaatatgattttttttcctttgacatgtctaaactcttaactggcctcatttttacaactcaaggaaaaaaaatcatttgcccttaacatgtaatgctaggaaagaaaagtcatttcacactttgagcatcagtgtgtcttttttcttgtcttggaataatgtaagtttgtttgaatgatgccactgaaaataagtaactgtggttttctctaaagaaaattctatctaggacatggcaggcactgggacactgttttagcagcaaagacttttttagtatcatcattttaatgtgatgcttgtaaaggtcatttctatttgaacattaaaaatgtcattggactgcaaaatattaccagatgtttaatagtcctgtaaattatctttttagagtaatttataaaccaaatagataagaaagtggaatttcccccatgatttgaacaatagatatttatttcagataaggcaaaaatacattattcagattatattatacatatattatgtgtataatatatgtataatatttaggttatgtattatctgaataatggttggaagttaaggaataataaagattcgttattggatttattttgtctttgtaaattcagagtggtagattagtcaagttgtagagtaagtgcctaactgaatcctaacaaagtataacattcacagttaattcctttaaataaaaagtcacgtagaaaaatataaaaacatagtaaactaaagaaataaaattttaaaaccctctaattctgcaaatactggtaacatttttaatgtatatccttctagcatgtttcctatgtacatttttgtttgtttgttttttgagacagagtctcgctctgtcgtccaggctggagtgcagtggcatgatctcggctcactgcagcctcggcctcccgggttcaagcgattctcctgcctcagccacccaagtagccgggactacaggcacccaccaccatacctggctaatttttgtctttttagtagagacggggtttcaccatgttggctaggctcttctcaaactcctgacctcaggtgatccacctgccttggccttccaaagtgctgggattacaggtatgagccactgtgtctggtctctgtgcacattttttaaaataattttttaaatgttttacagaccaaataatgtaattacagagatgcctagtgaaatatcataacactttttttctatttttaaaatacctataaaaggaaaaagtaaatatccaatacatttattaggaaatattatgtgataatgtcataaatgcaatatttgaatatgacttttttaatgttagagaagtaaagaaaaaaataatgagcatttactgagtacttactgtatatctgacactatgttgagccctttattttatttttcttttctcaagacagggtctcaatatgttgcccaagctggtcttcaactcccagctcaagcaatcctcccacttctgcctcccaaagcactgagattacaggggtggttcaccatgcctggccatgaagcttttactgtattcactcacttaagtcttaaaacctccggatgtcctaattaccattatttccatttaacaaatgaagaaactaaggcactgaggagttaaattgcttgccctgtgccacacaattagtaaagaaaggagttaggatgaaaacccaggcaatctggttctgcaactcatgttccacatcagcacttctgcatgttamgtgtgaagaccagggcatcatgataaattgctgatcctggttcactggatctggggtagggcctgggactcagcatctctaataagcccccaagtgatgggatactgctggtccttggagcacagtttaacaagcatctccacmacacacacgcactacctctgtaacaaagctgtaattttctggtaacctttagcaaggatgggcccttcattcatctttctgacctccatagcaggttacctgaatgagtgagcacaggatataagacctttaccttaaayagtaacatcttttgattgaatttttagttgaatgtcaagaacttcccccctttaatcactggatgttgtcagaacttattcttcagaaagttaggtttatctttgtgggttctatttgattgatttgtgcattggctggccaaaatacatatccctcaacttggaagttacgaaagctgtattcatttgccaagcattcatttccatacttgggaaagttgtcctctaagacagagtacctgaaactacaaatcttacccagccctcaaggccaaaattgttcacaagaattcccaacatcgtctgtttcatcctgcaagtggaagtgtgtgagtggtcttcgtgtaatattgatgttgaaaaggaaaagttgtttggtaatactaaaagtttatttattccaaagggcctactttttgtattgtctgactcacatgttcttgtgagtgagctgaaattcatcaaaaattgtttgcaaatattagctgggtgtgctaacacatgcctgtagtcccagcttctcgggagcctgaggcaggagaatcgcctgagtctagaaggcagaggctgcaatgaactgtgaatgcactactgcaccctagcctgggcaacagagaccatgtctcttaaaaataaataaaataaaataaaataattggtaaatatttcctaattcagtgtatggccccaatttgattattttaataatgatatgaattccaccaataaaataatgtgacatcaaaaaaatccaaggtastgcttttataaggttacaatgttttgcccaaggccttggataccatttaattattcaaaacagaaacttgatatttcattcacaatataagaacttgacactaaaatcaaagatgaggtttacagcttattttggattctctttaaataaaattcttcctccttcaaatcttcctcctcaaataataaatttgcaagatattaatttatagaaacaatagtttatcaaaatccctgaactttaaagcatccaatacagtaaaaagaaaaggttttcctttaaatagtgatgctatctctttcatttctatactgtacagatttggcattcacaatgcactttcattggatgccttggataaaactgggtcctaactaggaaaaccatagtaatccccatttttagagaagggaacaattgctcattatggtagagtgatttggtgcctaatatcaacggccaatgagttgaagaactagggtctttttaaatatgtatcaagaaaagaccattcattcacttgaattgaaactggtcaatgattggttcaattcagctgcttttacgaatatcctccataaaaatttctaaaatttcaatggattctaatgaggggctttgggttcatctgcctaaaatagggatgagtacaataacttcaatatccatgtcatgtccaattataaaatcatggctcccaattaatgatgaagtttttcactttgctttagagcagggcttctcaagttttaatgtgcatacaggtgcaggaaatggggaggtgygggtcaaatgatacaaagcaggaaatgtgtaggatgaacaagtaaaaaaatctaatgtacagcrtgaggactataaktaacaatcatgtatcatagtcagaattttttctaaatgagtagattatagctgttcttgccacagggggacaaagcgggtaactatgtgagatgatggatatgtctatttgttcccttatagtaaccattttactgtacataggtatcttataacatcatgttgtatgccttgaatttacacaataaaatttatttttttcaacgtgcatacagatcacttgagaatcttgttacaatgcagattcagattcartaggtctggcacagatcacaaaacaccgcatattcaacaagcttccaggtgatgcttatggcccatggaccatatttggattagcagggctctcaaactttagcatgtaccagaatcacccagatggcttcctaaaacacagatcgatgggtgtcgtagccaaagtttctgattcagtaggtctggggcggactcaagaatttgcatctctaacaatctgcagtgaagctgatgctggtctggggaccacacattaaaaaccgctgctttgaagccctgcatctttctttcgcaagagtgtggctctccccagatgaaacccattaattccatccactctaaaatgacagcttaatcacagaaacctgggaagggctccaggagacacttttcctgggaattatccagaatttgtcccgcaagtgattgaccatagtccgtaccaaaygatttgacttaattaatctcaaagatatatttccacaaaattaacattaagagttgttggtctactttcctttaaaaagagaaatccatgatttctacctagcagccaagagttcattccttctgaattctttgtaaactgtatcaaaacacttctaataaattcaagttggtaggaacttttttatatacatatattaaagtttatatatgtaacacatataaaagggtcagcagagctatgttcttttaccctttgatagcctgctgagtaacctgctgttattatgcattaaatacaaacttgttacagacagcagaaagcagcatcttcactcttttcattcattgatttattcattcattcaaatttgttttattttagcataacatttaggtagttctttactttcaggactttgccattaataatagagctatttattatgtactaacaggaaactaaatatgaattatgcattcattcaatattttttttttaaaaaaacccaactatgtgtcagtcactctgatggccattatatatgtaatgctgaggaaaatcagatgctctcatagcccttacaacttggaggaagagagtgacattataaaatttatacatctatgtgtaaaattgcagctgctactaatgttcaacaaaatgataccatgtgaatgctgttgactcatgtgagtgcttatatgatgacacacagccatgctgtgtcaagattcacttgaacccatgctccagttaccgctggaagaacttgctggacattaactgtgcaaaacaccaaaagtactttacttggtgttaatgaagaagctcaaaaaactgaagtcaacagatgaatttatccagctcattaaagctgtctcttgcttctaactcaccctggtagactcttcaaaattaggagttttgacatatttcattatgaaaaattctaagctaacattgaaagagctgtacaaggaacacctatatatcagccacccggattccataattaaaattttgatgctttcacttgatcacatataaatccctctatccatttatctatccatcttggttcaataggatgcattttaaagtaggttgcaaacatcagtatacttcactcctaaacgtttgggagtgcatacagcaggacaaagtttgttaaagtgattctgaatttcttagaaatatgaggcagatacattatctaatttcattcaactaatagaaatttaaggtacaaattgtgctcatgtttgaagaagctcctccttaagggaaaggctggctctaacaaagctactttctgacaatatttgtcctgagtagggtggatttctgcatgatgaaattatgagactcacccgtaatacgctggaaaaactgatggccttacctcttacccatgtggtgcccatccaaagcaagatgctgtcataaggtaaaaagaactgcactcttttttttttttttttttttgagacggagtcttgctcagttgcccaggctggagtgcagaggcgcgatctcggctcactgcaagctccgcctcccgggttcacgccattctcctgggtcagcctcctgagtagctgggactacaggcgcccaccaccaagcccggctaatttttttttttttttgtagttttagtagagacgggatttcaccatgttagccaggatggtctcgatctcctgacctcgggatccacccgcctcggcctcccaaagtgctgggattacaggcatgagccaccgcgcccggccggaactgcactcttcagatgactcagacaaggaaagcatgatccaacacctctaatagcccagtaatacatatgatatttgaaaggcccttcacttaccatgttaaccattcagttaaatcctccaaatcctaattctctgctgctcaaccatcagatccaaactttcaatgcccaggacggaaatcttttcaaccagcacatcaaatggcttttcctccttctatagaacttataaaaatgatcttttcagttaccattttactggtccatctgtattctattttcagtgcacttctgttcattttggaattaggaagcgtacaaattctttttatatttaattttaacattcaagttaggcatattttgaagaaaaagatattgcaatgattgcatttgtccactagagggcaggaacttacttctgtggttcattctgcactttttttttcactacccacctaagaaaaatctagtcaatgcgactgaagtactaccaccttctgaaycttctttccttgataattgcttaattggaatttaaatctttgaatcaaattaagaaactagacattcctagtttctgtttctatcacaatttccagtaccagatttttattcactcataaaaacaaataatgggggagaaataaaatattgacttctgctgattctcttgagtgggataaggaatttggtttttgcactttggcttacagatccatatagtggaattattcgatctttcaattataatatcagaaagttcaattttagtattgtactcctataggtgctttttttcatttttcagccattgttttgcttaacttatttaactttgtatgtacggatgcctttttagtgcaacagggtagttctttgagaattatgtttacatgtagacatctctatctcagcagcaagttaagttattattacggttccttaagctgctgttatcatagagtggactgctgtaatagaaaaatttagtctttagcatatagtccatattcaaatacttgttcacagtttcctgtgtgacctctggcaagttacatgacttttaataaagtttttagtaaagacttttaataacacctccgattattttgctttattatggtactgtgcgtgttgcctacactgactggctgtgaaaaagctgttgtatataacagtgtctaacccaggatgatctacagccacttctaattgcagtctccattcggtaaatggaatcaattaaaatgtgtacctatgggctgggcagggtggctcatgcctgtaatccagcactttgggagaccgaggcaggtggatcacttgaggtcaggagttcgagaccagcctggctaacatggtgaaaccccgtctctactaaaaatacaaaaattagctgggcatggtggtgcatgcctgtaattccagctactcgggaggctgaggcaggagaatcgcttgaacccaggaggtggaggttgcaatgagccaaaattgcactactgcactccagcctgggtgacagagtgagactccatctcaaaaaaaaaaaaaaaagtgtctacagcccttagcaaaaaagtttaaacattagtcacatgtatatgttatagaatcttacttaactcaggcatcccaaccagtactggtctgtagcttattaggacctggcccgcacagcaggaagtaagcagcaggtgggcaagcaagcaaagcttcatccccatcactcaaattactccctgagctctgcctcctgttagatcagtagtggcattagattcccataggactgtgaaccctattgtgaactgcacatgtgaaaaatctaggttgtgggctccttatgaaaatctaatgcatgatgacctgttactgtttcccatcacccccaaatgggaccatctagttgcaagaaaacaagctcagggctctcactgattctacattatggtgagttgtataattatttcattatatagtacaatgtaacaataataatagaaataaagtgcacaatacatgtaatgcacttgagtcatactgaaaccatcccctcaataacctcctctccccctggtccatgaaaaaattatcttccatgaaactggtccttggtgccagaaaggctggggaccactgacttaacttgtatataacatctgtctccagaaaatcatgaggtccctgacaagagtcagactatgcaaggatctccaaattccttagcccagtgtttaatgtcctcattactgaccctcttctctatgcctttgcttggccactggggcgagaaggtaagaagctcctggcccaccgagttcccagcacagtcctgtcacttcagcattactaaggatgcatggctcactcttgcaccatctcagaattccaggcaaactctgctcctcctggcagagggtacagattggcaacttctgggccaaatgcagtctgaagatgtgctctgtttgtcttttcagtgattggaaactgggagagttcactcaaaactttcatttttccatttttctcaaaacctgggtggaaataggctaaaaatgaacagcagccactgccccatttacaggctgtctctctcctgctctggacatgacctcactttgccctattgcattaaatctacttcactggtttctatcatttccactaactgcctattactctacagtgtgaatagtatccttaggggttgtgtcccaagagtgacacagtccactctacatggagacatcaccaggtgtgacccctggactaagcatttctctaaagcctacttcaaagtccagcaccaacccttggtgcccactttatccccgactgcaaccataaagtatttgcctgaatgtttacttaacatctatctgctttttaaaaatgtctttgattttatatagtacgtccctttttggaaggtggaggctttgtctcacatgcccttgataagcagagatttattttttcctttatttgactcaaattgacaatcgaacttggtttcccaagggcatacagctacatggagtatctgaaaacctaatgcaaatctaaaaataaacttgttggatccagtttgaatgcacctccagtctaacacctcaagacactaattttagttgccaaaaaaaaaaaaaaagccaccattattactttcacagaagctggttttccctaacttccattctttcctccatcaaaattttctttttctctatcctttttcagagggctaattttagtgagctgtcacattgggaagaatctggttcattccccacatggttttagaaaccaacttggatataatggggaaggtcagatccccacggaayagggacatcttcctacctgctttctaaagcagctgagtttggtaaccatgggcaccctcttcagctgggaggccagsaaagygttacccctgctgtatttaagccaaagarccacccactgtgggtgtataggtcccatgtagtcaaatctagtttttcaagggaagtaagaaacccattgtttcagtataagatcaccttaattaaaagatttgacaacactggttgagccaaagaaaatgcatccatgtactccattgggaccatgactttccagtttgcaatgtcttgctgaacaacacatacacaatcctttccctttgcatataattctagggagaatttttctgatggatgtaactaaatagtgtgaccatactggcacttacccatcagaagtagtcatttttcaaaagaaagattctgccatagtgagctatacaggctgccccggttacttgtttagtctcctgtctcccctaactgatgtccagccactgctactaagggctcttccagcattgagtagggtgtagtaaacaagcagggatgatttgttgaattaaaataagttctgccatcacttaatgcagttttggaagatggtttaaagatgatttgggaaacagattaaaagccactggtgacaatcagtgtcactattttcactcttatcttactttttataagaaagttattataggtcaatttttcatctgtaatcacatgccaaaatgtcacaatgttaggctccaaaagacttctggaaaaatatatttcctaatgtatttttaaaatgtgctacaaagtagaacattgggatagcctcattgtcagtaaaacctgccagggacttggaaggcaattctgataaagagttacagagaatttagcatattgaaaagcaacattaaaagagtatgtaggcaattattttataaggatcagcatttattcaacaaayatttttaaactgtttactgtgtataaggtatgtggaattagctgctggagggtgtcgaatgaagattttacgtttcaatgcatttattattattattcattggtagtattccacaagcttaaaggttttatttgttttatgtcaacataaataacaaacagatgctctctaaaagaaaatggtattatttaagaatagggcatactaaattatgtgcttagtcagggagggaaggaagacaaaggtttgtaaaggataaatgaggagggttacataattgttttcagatgattagccttggctacaaggatcaataacaagagtgacctcagtctgacgttggacagggagttgctaggcaggtgtcctcacagaagtattttttgtgtaaagttgctatggcctttgtacaaggtgatggcttttgcagagtcttttgtgagagtttttcttatcaggcatttatgagtgagaaccttctctttatgacattccctggctctttttgtcagggttttttgggtttttgtgggtgttgttgttgttttaatataagggactccatttagattctgacaactttcacattatttaacatccacatatttactctgtgccagaaacaattctaagtactttataagtattaacttatttaatcatctaaacaatctaacaagataatattatgatccccagtaaacacctgtcttcatctataaggataaagaaattgaagcacagagagttaagtgaactgcccaaaatcacactgctggtaaattgcagggccagaatctgaacccaggcaagctgtgctccaaaatgtgtgttcttatccatcacatcgattagctcattctgtaaaacaaccccaaacttggcagcttataacatcaactagttattatttttcatgcattatctggtcagctgggcaggtctgcagatccagaccagactcatagactcagctcatctcagccgggttcactcaagtgtatgtgctcagctggggactggctggtccaggacatccttgaccaggatgactcagctctcttccagaagagctggatgacagaccaggatgactcagacctctcatcctccattgctataataggaccctgagaaacagtggaaaaatttgcaagggtcttttgtatcaagtttgctattctctgattaaccaaagcaaatcacatggtctggtccagagtcagtgtggaagggcaccaccaacgggcwtagacataggttggtgtaaaaattggagactttaatacaattaacctcccatagtcatggctcaacactatgctgttttaaccctgctttccagggagtatcaaatttgatatttccaactccaaaagaattgtgaagatgctrtaaaatgtagccttgttggtttaggaaggcaagaaaagaataaaaagaaatgtggaaaatgaaaggatatttataattttaggctgatcctggagaaacaccatcagaggctccaagtgaagcragaacgactccagcagaaaatggggtgaatcacactacaaccctgacacccaagccaccctcccaggctctccacagccagccagctccaggtaagccatctggaaagagctggacaacatgagcaagatcctccagttcattagtgccactgacggaggcgctgtgatgtgggtagctaaagcatcaagtggggaaagatgtgtggacttaggaggagctccgtcaatgtgcaattaatgaatgaaagccagaagagagtcatatgtgctcatctggctctacagataacttatgaaaccacaacaaaaaaaatcacccagatttccggtgtcctttttcagtgatgagttatgacccatctgctggcacagtttgagaagaattctccaagcagcttataaacaaccatgccttagaagtgcattcttagtcytgcttcattaattctgtgccaagggctcctttccctctttctccaactttcttttcaacatctttgagtgtctgccctgtgctggacacattgctaagcttttcatatggatcatttcaattccccccataccaggcccaagagtagattctattattgtccccattgtgcagatgaataagctgccattttcaggtgataaagtacttattgaaggccacagtgccagggaagagtgaccttaggcctgatgcagttcccaatgatactaacattcttgcttttagctcctatattacagccaaagccacactcttgtctcatttctcaaaatgaataaatgaataaataaataaataaataaataaaataaaaatcctttgatttctacgcagctaactttgacatttaatcttatgcagctttgtgtaactattccttgtgtgtatgtcctgtttaccccagtagatgggaggcttcctaggtagacttcaatttgatgcctcctctgtacatcacacagtgctggggaatagcatgtacctgataatttcttgttgaattggttaataaagtaaacaaaagggagcagaatttccttccatgaaggtgtggaaaggagctcctttctttgtcatactagatcagggtgccagtagatccagatcttttaagggtatttctcatgggagagaaagagaattaaaaaaaaaaaaaccaattatatttaatttgtatcagacacgcttgaactgctttttaaaaggttgctggccaggcatggtggctcatgcccgtaatcccagtactttggaaggttgaggcaggtggatcacttgaggtcagcagttcaggaccaacctggccaacatggtgaaacccccatcgctactaaaaatacataagttagcctggcatggtagtgcatgcctgtagttccagcaactcaggaggctgaggcaggagaattgcttgaacccaggaggcggaggtgcagtaagctgagatcgcaccactgcactccagcctgagtgacagagcgaggctccatctcaaaaagaaaaaaaaaaagttgccaaagtcaataatagtaagaagatgacgttataaacaagaagtaaattttcaaataaagagttttatataccaaatacaaacatcttgaatgcttctgaaatataaatccatcatttaaatgtgtgagtaaatagtcatgtgttcctgaaagtaaaagagaatttagcattttcacatttaatttttttaacttgatattttggaataattgaacttacagaaaatattttttaaatggcacagaatacattgcaaaaataacctcttcttcccctaaagttaacatctcacgggatcatggggcaatcatcaaaaccaggaaagtaacattggcatgatactctgacctaaactgcacamtttatttggactaacctgctttctacagtaatgtccttttactgttcaagattccaacgcaggatcccaaattgtattttattgtcatgattctttagtctcctttaatctatggcagtcccacagtctttcctgtctttcataaccttggtactttggaagaactctggtcagttattttgttgaacatccctcagtctgggttggtccgatgtttccccatgattaggttgagggcatgcattttgacaagagcaccatgcaagtgatactcgcctttctcagtgcatcacatcatggatatatgatgttgctgggtctcatcactgatgatatgggatcacttggttaaggtggtttctccactgaaagttattattttcccctcttagatatattgggagagctactttgagactatgcaaatatcctgttcttccttaaacttttgcttactgatttttaacattcaccaatggatctttcctgtaacagttattactgcctagtggtcaacatttgacttttatttttattttactttattttattttgagacagagtttggctcttgttgcccaggctggagtgcaatggtgtgatctcagctcactgcaacctctgcctcctgggttcaagcgattctcctgcctcagcctcccaagtagctgggattacaggcgtgcaccatcacacccggctaattttatatttttagtagagacggggtttcgccatgttggtcaggctggtgtcgagctcctgacctcagctgatccatctaccttggcctcccagcgtttgacttttaaaaggtcacttgtcattcctgatttagccagaagatggcgatagcattgcctaaactgaatttgttccaagtggatgtcttttctcttttctctcgttataaatggggcatataatatcacatttttttttttttttttttttttggagacagactttcactcaatctgtcacatagggtggagtgcagtggcatgatctcagtccactgcaaactccacctcctggcttcaagtgattcttctgcttcagccaaccaggtagctgggattacaagtacccgccaccatgctccgctaatttttgtatttttagtagagacagggtttcaccatattgccaggctggtcttgaactcctgacctcaagtgatccgcctgcctcggcctcccaaagtgccggkattacaggaatgagccactgcacctggcctaatgttacatttaattaggtttgtctcaaagctgcaaatgaagactttttaagaataatttttataaagaattttctcacacaatttgtcatttctctgaaaagagatttagattcaaggcccaaatatgtttgtttgtttacaggaagaataaaatttaaaaagttgaagaggytatttattttatcttttatattacaggttctgtaaaggcacctgccaaaacagaagatcttattcagagtgtcttaacaggtaaatgccaccctttccccccatggaattaagcagctcagtgttacacagtggaagtatttagaggagaggaaatttccrttcatatctgaaaaacaacatcattaatatttcttcttctaaaaaatctagagacatayacttttagtttagtctacatgatatgatataatcacagagaagtaaccatactttgtagctagaaccctactggcataaaaataatgtagtttcacaagatagctatttcagcatcaaagaatagtttcatgctggaaatgtaacccagtgaacaagaatgcctgtcttcccaaattgccaataataaactatattttagatatgcagaatatgatccatttgtgagcataaaatgcacagtgtttaagaactgtgatacagtttggagttattttatatttggttagtcacataaactagtggaactaaaattggtacaagctttgtgcagtacaattagcagtatgtagtggaatcttaaaaatgtttataatacttggttcaatatacaacagaaatgtacacacacgttcaccaaaagcagcaccactggtaagggccaaatctagaaacaacccaatgtccatcagctgtaaggtaggtaaataaattgtgataaattcctagcatggaacaggaggcaactgcaggaataaataaactcaagtcacacacaacatggataaaactcaagcataatgttgaggaaaaaagtcagacacaaaagaacatattctgtaggattccatatacaccaacttcaaagacaaaactaatctgtgctgtagaaacctggatttggattatacttggtgggagacaggaaccaaaaaggaaggcttctgggatgctggccaaattctaactttgacctaagtgatggatattgaagcacattgactttgggaaaatttacaaggctatacttttatgatttatgcactttgatgcgtatatttgcatttcatcaagaaatgcataaaatatgcgtagaaaaattayttgaggaaagtattaaaagaaaacaaaacatggtttggttttgttttgtttttgagacaaagtctcactctgccacccaggctggaacacagtggtacaatctcggctgaccgcaacctccacctcccgggttcaagcaattctcctgcctcagcctcccaaatagctaggattacaagcacgtgccaccacacccggctaattttgtatttttagtagagacggtgattctccacgttggccaggctggtctcgaactcctgacctcaggtgatccacccgctatttttagtagagacggtgattcgccacgttggccaggctggtctcgaactcctgacctcaggtgatccacccgcctcggcctcccaaagttttgggattacaggcgtgagccactgtgcccctcccaacaaaacatgtttttaaaagatttagttctaggctgggtgtggtggctcacgcctgtaatcccagtacctggggaggccaaggggggggcggatcacctgaggtcgggagttcgagaccagcctgaccaacatggagaaaccccatctctactaaatattacaaaattaaccgctgtggtggcgcgcacctataatcccagctactcaggaagctgaggcaggaaattcgcttgaacccaggaggcggaggttgccgtgagccaaggttgcgccattgcactccagcctgggcaacaagcgcgaaactctgtctcaaaaaaagaaagatttagtttcatgggaaacaacaccatattaatgcatacaacaagagacagcagtgttcctagaatgttgtttaaaataacgtaaatgaatggacaaaaggcaatggtctgtaccaatacattagctgtgattatatcttggtggcttatttataaatgatatttgtgtctttatataagtgagcattacctttatacttaagagcatagtctaaggaacagcctctctcatctacagactttttaaaaataatagtttatgtggatttatttctaatcgtaggttagaacawctagagccttatttccaaactgcctatagctgatatgctgtaaaccacttttaaagaaatagaattgcatctgcctccaagaatgcagcaattccttgggattataaattcttaatgtaataatttattatgcaaccataatgagtcaatttgggcctgaaggaaaccattaaataaatgtacctggttttctccatggcctcattctcaaaagagatcgaatgtcaggagaatagacacagtataagaaaaggaaacatatttctattgcttaaagaccttaacatttaataacataacttattattctagtctcaatgtttattcactagacatcttattttctattcaggtctcttgttattcacagcatatattatttctgaatctcttgatagtttcaaatatttatggtaacattttttgttcccagaagcaggacattcaattcaaaccatggaaacatgtgaactatgacttgatctaggtccatataaatgataattcactggagttaagataccatcagttgtaaagcatcctacgttcatgtattgctaaaaaagaaaagcactgaccaaccatcataccccaccaaccataagatgcatcttgatttcggaaatgttaacatattttttaaatgcacattctagaattgattgaatatatcagtaaaatacagattagttttgttttgttttgagacggagtctcaccctgtcgcccaggctgcagagcaatgatgtgatcgcggctcattgaaacctccgtctcccgggttcaagtgattctcctgcctcagcctcccgagtrgctgggattacaggtgcctgccaccacacctggctaatttttgcatttttatttatttatttatttatttagagacaagagtctaactctgccacccaggctggagtgcagtggcacaatcttggctcactgcaacctctgcttcccaggttcaagcaattctcctgcctcagcctctcgagcagctgggattataggcatgtgccaccatgcccagctaatttttgtgtttttagtagagacaggagttttgccatgttggccaggctggtctcgaactcctgacctcagatatccacccaccttggcctcccaaagtgctggacttacaggcatgcgccaccacacctggcctaatttttgtatttttagtagagatggggtttcaccatgttggccaggctagtctcgaattcctgacctcaggtgatcctgcctcggcctcccaaagtgctgggattacaggcatgagccaatgcacttggcccagaatgttttaaggtcagactctatcacattcaaagttttctcagcatgggataaaaaaatcagccaggcatggtgactcatgcctggaaatcccagcactttgggaagccgaggagggcagatcacttgaggctgggagtttgagaccaggctggccaacatggcgaaaccccgtctccataaaaaatagaaaataattatccgggcatgttggtgcatgcttgtaatcccagctacttgggaggctgagacatgagaatcacttgaacccgcgaggtggaggttgcagtgagctgagatcacgccactgcactccagcctgcgcaacagagcaagactctgtctcaaaaaagaaaataataatcataatcataataatatagtaaagtgggctgctagtaagcctctggtgactttgtgcaaattatattaaggtatcttccctcaagacactttactgctatatgcttttatgataaatgtaccagcttatgatgtttatactgtaaatgataccttttagaaatgrtgttgtagaacctgcacagttattttctaagcctccacaggcacagtgccagaaactgagttaaatactttccatgagttcttttatttcatcatcttaacaaccctataaagttatagaagtattataatccttatagcaatgctgttggtgccctgcccagattccttgtacagctggtgcacccgtctcctggctggtggtgagggttggctgttaacagctcataacttctccttctctgcaaaattgccctcaaccaaaaggaagccccctctccagatggttatgcctccctgcactgaatgttccaaatatgcaagaagcttgccttcttgcctcaagatgagaccagctcagtggtacaactcacactccagcacttccccatgggatcaggcagagaccagactccatccttctgagaccacacccttgctcagctccttccccagccccgtctgctttcctggctcccctactctgagartccctcagtaaatcacgtgcacctgaatccccatcttgcattctgcttctagggaacccaaactaaaaatatatgtattcgaatgaagcaattgggtctctgagaagtttagtaacatagtctcaaagttagcaagtgatagagccagactggaacccaggtagagctgacatcaagctttgctcttaaactctagctgggcaagatcaaccatttcttcctaagaaggtagccgctcttctttccatctggatgttcagccctcccattcccttagctttcatattcatttgttgcagaagtggaagcacagaccatcgaagaactaaagcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaagtaagttcaatgaatatttttagttggtttcatagcatgaagagttgttaacatggatttttaatgttttatatcatatttttggacctgtaccatggcaagaaaaccacctaacctccrttctccatagcttttgtggcaccttagcccagatttgcttgtgaattgaatttttttatttaaccaaattctgagaataaatatgcaggaagtcctcctgtgagtctagcctgcgatcccaattccagttaactaacttcctatattacagctgccaatctcatgggtatgagactttgcctggagtacctagaacctagttggagaggcagctgatttttttttttgagacagagtcttgccctgtcacccagactggagtgcagtgacatcatctcggctcactgcaacttctgtctccagagtttaagtgattcttgtgcctcagcctcccaagaagctgggattacgccactacgcctggcgaatttttgtatttttagtagagatggggtttcaccaggttgcccagctggtcttgaactcctggcctcaagcgatctgcctgcctcggcctcccaaagtgctgggattacaggcatgagccaccatgcctgcccacaactggtcttatagaaaagagaagcttactatcctttgctaccctgtctgaaatccataatgccctacacaggtgactctaatttgggcctgggttcccacagccccatatacccaaaccttgatgatgagaagcatctctcacacattcacttaattaatattttttgagtgcctactgtgccctggggacacagcaataaacatgacctacccaatcatctcaaatagtaacatggtaatgtgggaaacataaataataaacaacaaacacacagcatcatctcaggctgtgatgaggactatcaaggaaagaaagaaacaggaccatggggtagagaatgactggagataggagatcccttctgacatgttgatctgcaataaggtggcacagaaagaataaagcctggtcagctatggaaagaactagggagacttactccaggctgaggaaacagcaagtgcaaaggccctcaggcaggaaaaaaatgtgcttgtgccaggaacagtaaagctggcaaagtgggtgaaacattgtaaaccatgagaggagtgaaacaggatgagatcagagaaacaggagggaatcccactgctaggttctttagagctrgagcaagcaacagttcaaaatgtatcgaacgtgcaataagattctactgaagaaagaaattgatatggcgaaatttgagagtctcagagcaatgactctagctgctgtgtggaagagggaccctcaagctgtgcatctcaaatggacatgagtcactggggatcttgttaggtgcaggttctgctccatgtctgaattggggcctgagcagcaccaggtgatgctgattctgcagttccatggacaacactctgagtagtgaagatcaaggactcagagtgaaagcaggagaccagttaggaaactttttcatgagtccagctgagtaatgatggtggtttggtctaggatgacgctggtagacatggagagaaggggatgaattcttgatttgttttaaaaagatcgtaaaatatggggtcagaggcctggaagagagaagcctgcttgtatgtctctgcaattcccaggtgtcctttagagaatgaaactcatgctgttacccacaccaaatgtgttcatgaaactccattatctagcctagatcagtgcatctcaaatttcagtgtgcatgtgaatcacttgcagcatttgctaaacacagaccctcgggacctgaccctagagtttctgcctcaggggcctccttcggtagggactgagcttctgagcttctaacgagctcctaaggtttgctgatgctgctggtccacagactttccactgatgggccctggtctataatcattcaggagcatcctagaaattgaagggtggctgaaaggctttctttggtctaatccctgcctcccttcccagctgccatctcccagcacttcatatgaaaacctgtactttctsccgagttcccaccatgatgagatagggcagttaggattctctgggctcagggcccttcttcaattgcaagactcttgtgtgaacaatgcagacgctgcctctaaactccaacaaagacctgcttccaaatgtgaggwtgccgtgtggatttcagagtgtcacccgctctcagaaccccacatgtggactgcgcatcatagcttatcatgggactttgtggacacagggtctgrcggaccacagggggcttcctctcttgaaccctgtcgagggctgttcccagttctggaatagcatttcattgagtgtcaacaaagtactgggcatatgtgtcatatcagtttcctaggattgctgtaaaaagtacagcaaactggatggcttaaaacaataaaaatgtattttctcacagttttggaggctaggaattcaaaatcaaggtgttggctgggcgcaatggctcactcctgtaatcccagcactttgggaggctaaggtgggaggatcacttgagaccagcctgggcaacatggtgaaaccccatctctactaaaaatatgaaaattagccaggcatggtggcacacacctgtaatcccagctacttgggaggctgaggtaggaggattgcttgaaccaggagatggaggttgcagtgagccgagatggtgccactgcactccagcctgggcaacagagaaggactctgtctcaagacaaaacaaaacaaaacaaaaaaacaaaatcaaggtgttagtggactatgcgctctctgaaaagtctaggggaagaaacttttttttttgtttcttctaacttctggtggttgctggcaatctttggcattccttggctgacagacatatcactccagtctctacctccattatcacatgaattctccctgcgtaggtgtgtcttggtccaaatttccctcttctaatgacagacaccaggcattagattcaggtccaccctaatccaccatgacctcattctattacatttgcaacaacctctttccaaattagatcacaggctgaggttctgggcagaacctgaagtttaccgggatgttatttaacccagtacatgtgctaatcacttctatgtactattccatatatttctcacagcagcactgtgaagtaagtacaggcatcacccacattggataagagaggacctaaaactcattgaggccaagtaacctggccaggggcacatgcaacacacaaggccatagtgacagtgaggtcatggcgtggtgccccctgagatactacttgtgtcagatgacatagcagatctggaatctgcatctctgtagacctgtgactgcttctggtccgtatacttataatcttctatctctatacaacaaaacaaacagatgcatgaaataaatatgcccaaataaattccctcgttaactatccctaatgttaggagatttctcttctaaatttagattcctgaaatttctttgaatatcttttgcaggtatatagtatgaacttcttgacaataaataatgttttgcaacatgaagttctctaatcaacagcattaatttttacataaaaatcttttcttcaaagttgaataattagggaaatggaaataaatgcagtggatttaaattttgttgctatcttttgaggtcacagacagttcttgtcttcctcagggcttatttagctgtcaagaatatttttaatttcagatatttagtgagcattaacagagcgttgtgtaagacattgctcttaagtatctttaaacatcaactcataacatttttaaaataaaaattaacattttatttttaaaataaaatgttatttgtggttttaaaaaaaagtgtatcgtttagaagacataactttcaaaagcaaaagtatcccttagttctatttctatatatatatatagcattttaatgaattgtagcatcaaragaagtgaaaaaaagccttttaagtttaaattattgctccacttaattttctatactatagtatataaattactcttatcagatagcctatttttcatatgttggctaaccaatggacaacgtattgccaaagataatccaacgaccttcacagctctaggaaatcttatgtagaattggttgtacatttactgaaaacttttttggaatcattgtcatcagctgtctcagtaaagattatctcaaaagcttgactgataataattgccactgagaaataaaatttcattctttaactgaaaactttattaattaccctgaaactatgtaagtatgtaagtgacctgtcaatgagcaaagtataagacatattacatccttcctttactgaataatcttcttttgatgccaagttatagagataagatgcattttttagatttatattgtgacatatgatttaacacatgcttaaattgaaagcactatcaaaacctaatacttgggctttaaaaagtaataaaatcatctcttttttttttgttttttgtttttgagatggagtctcactctgtcatccaggctggagtgcagtggtgcgatctcggctcactgcaagctccgcctcccgggttcatgccattctcctgcctcagcctcctgagtagctgggactataggcgcccrccaccacgcccagctaattttttgtatttttagtagagacggggtttcactgtgttagccaggatggcctcgatctcctgacctcgtgatccgcccacctcggcctcccaaagtgctgggattacaggcgtgagccaccacgcccagccaaaatcatcatttcttaagcctggaggatccttaaaggccatctaggtgatatttgtcactttttcaaggaggaagctgaaagctaaaggtattaccatttacctgtagttacacagccagttcaagcaaagcttggcctaaaacttctcctgaatttctgctttagtcttatgtactatgaaccccaaaaatctgagacagttaatttagcaagtttatttagtaagttcatttttccaaggttcaggacrtgcgcctgtgayagcctcaggaggtccagatgacatgtgcccaaggtgttcagagcagtttgtttttatacattctagggagacatgagacatcactcaacctatgcaagatgaacactggttctatctggaaaggcgggacaactcgaagcaaaggcaggaagatgggaagccgggagggggtttccaggtcataggtagataagagacaaatggttgcattcttctgagtttctgattagcctcttggaaggagacaatcagatatgcatttatctcagtgagcagaggcatgactttgaatagaatgggaggcaggttggccctaaaccattcccatcttgacttttccctttagcttagtgatttggggccccaagatttattttcctttcactgtacatatttgtttattcatttttgtatttacttgtaagtcatatcctgcaaacttccagtagaatattgaaggtaacatcatagaagatttgtatgtaaaaatcccatgaaaatagaaagagaaacaacacacatgcgtagactaagctttggacaaattatctagacctgctgcccaatacaggagccactagctacctaccagtggctcttgagtccttgaaatattgctcgtgagatgtgttataactacaaaatacacaycagatatctaagacttcacttttttaaaaaagaatgtaaaatagctacaacatatctgttgattttaattacatgttgaaatgatattttggatatattaagttaaataaaatatattattaaaattaatttcactcacttatttttactttttaaagtgactactaatagtttgaaattacatatgtgaagggaatcacatatgtggttctcattctgtttctaccagacagcgccagccatttaatgtcatctctgtccttgaacactgaattcagctcttagcttctgagaaaaggagtatgggtttgataattctcctcatctgattaaaggaaacttgctgactcttccaagagagacaagcgttttcctagtattaaattgccagagatttaatttcatggatcttatacaagcagcagaggggataatgccttcaactttgtttttatagaagatgcagagacgttgttcacttgtttttttcttgtgttgtcctttaaaacaaaacaaaaccaaaaaatcccttagtacatagtatctaaagatacgtcatgaggagcttttcttcaagtggcaaagccagtgggtctgattatgtctacctgtcttccatctctcttgatatgcaataaaatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggctcaatcaatcctcctgccacagactcccgggtagctggaactagtcgcatgccactaggcccggttaattttttttttttttttttttttagaggtggggtctcactacccaggctgactttgaacttctgggttcaagtgatctgcccacctcggcccccaaaagtgctggaattacaggcgtgagccaccagcacaccaggcctgttcctaatactctgtctttccctgtttcctacagatgataatatagagtacaaaattggaatgaatcacaccaatttctttaatattcatcatctcaagtgagctttctacataatgtgaagaacaggttactcaaaaatagttttggtccagacatggcatgcagtcatgctgtgttgctcttaagagcacaggtgttgcccttctgcccctgtaatttttgaccttgggcaagttgcactactgcacctccatgctgtgtccttggccaattatctcacagagccgtggtttcctcaaatgtaagctggtgatgggtataccgacttactcggatacgagtgtgcccggcatatggggggatggttggcaatgagagctacctctgctagagtggttggaactgattgaagaaatgcctttatgccctggttacaatgatttcctgctatataagatcattcaggccgggcgcggtggctcatgcctgtaatcccagcactttgggrggccgaggtgggcggatcacctgaggttgggagtttgagaccagcctgaccaacatggagaaaccctgtctctactaaaaataaaaaaattagccgggcatggtggtgcatgcctgtaatcccagctacggaggctgaggtaggagaatcacttgaacctggaaggcggaagttgtggtgagctaagatcrtgccattgcactctagcctgggctacaagagcaaaactccatctcaaaaaaagaaagaaaagaaaagaaaaaagataattcaatgttaactatgtcatgccaagaggaaagtttccctcaacactgcagtgaggagccttwtrgaatgtccgtcctcatttggcattgcacataaaaatgcaaaaagaaacttgagaaaattcygcatcccttatttgacaaaatctgattctaacaccagcttcaaccaactcccttccccatgtgatgccactgatgctggcccaattcaaagaaaaagcaaccagaattactgacagctgattctaagaaactttacctggcctatcggaccacaagtgaaaaatatggaggcagagtctgatgtgttgaatgtcttaggtagtctttcgggaagggattccatataaatgaaaagagcatacctactctttgtaccctgttcccaatactctgtctttctttccactgtttcctacaggtgataatacagagtacaaaattggaaggactcacaccataagttaatgataattrctttaatttattttgacattcaccctaaccttctaaatatttgtataattctctaagaacaatgcagagaaagtcatactgctaagaggaagcattcgaaatattttagaatgaactaacgcatctctttccccttgtaagctttgtgtggaaagtgccatttgggtaaagatatcagtgaagttggtgaagcctccaaagggccttattttcattgtgtgtctttgctgttaaaaatcttgttaagaggccgggcacggtggctcacgtctgtaatcccagcactctgggaggctgagatgggcagatcacttgaggtcaagagtttgagaccatgctagccaacatggtgaaacctcatctctaataaaaatacaaaaattagccaggtatggtggcacatgcttgtagttccagctactcaggaggctgaggcaggagaatcactcaaacgtgggaggtggaggttgcagtgagctgagatcatgccactgcactccagcttgggcaacagagcaagactctgtctcaacaacaacaataaaattgttaagaaacagaactcagatgtcagccaggagggttatctgcacacggcatctacacgtgctctctgtttataatcatcacccctgatgctaaacaaggcacatctttagcttcctctaacaaagtctactcaatgcagtgtcctctgaagttttcatacgggaaaggtaactgggaatgccattacacttgtcacattttaaaataacaaaaaagattaaaacctgaaaattttttattagacactgtttttcccaaacggagattattattctcaccactgccatgcctagggcccccagcctctttgcttttctttctgcccctgcctctttctagagcaccatgaattccattcagtctctgggattggagacactctattgctaagcttgtccttggggtctcaccctctaccccaagtggcttatgaaaatatgtatttccaaacagagaactttctctaggaggaattctggtgaataaccttccctccaccttgttatggcctgtctgttttgtgagtcaaactctgtgtctttgcagatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaataccagaagcgagaacatattaaactggtgagcctgagaaacatgatttatgtttgtgcaactggaactcccttataggaaactttggatacttttggataactaaaaggagacaagggtgggtgtgactggcaccaacttgagagattgtttaggtgacacagtgtccatcacactattgtttttataagccccacwgtcttaacatctttaccaagcttctctgtcttctgccaataaggctgtattttatcatttttattttcactaacttatgttgagtttataattgcttttgggaatctttgaaatctcataagcaaatagaaaacacttatctttgtttaagaaattaagaacatgttgcaaacaaattttccctttttttttttttttttttggtagcactgggctttgtaagaatttttttaaaattatacagtacactgtcctatatttagaaaagtcagtacctaaatggccaacacggaatgttggctacccaattcataaggctccctatgaaaggaaatgccatcctcaccattaataatcagttttattttccaaaatgttttctcacgaattgagacattctctccatttttgttgattccttgatacatagtagggacacaataaatatttgtgacagatagattagataaatttagcaacaaaatatccttgaaaacaagcttatgccaaaaccaaagaaataagtaagcttgatagaaattaaggtagtgtatccagaagaaatgggttttaagagatatttgtataagctgtctatttctttgctgagggtctgtgcatataagagaattctgagcagcttcagcttgtaaggttggaagcctatagatgatttagccatcactgtataataggtgattcagtgtaattctgttgttctaggacaacagtccccagtgactgtatgcaatgagtagatcaaaatcacatgaattgcttattgaaaatcaaattctaacgaggcccgttattctcaacttgagcatgaatcagaatcacctggagagcttgttagaagagatttttagggtctaccttaaattttcaacagatctctcgtagggctggtgttttcatatttctgatcccaggaccagacttcaagaactgctgcccaatacctaaatgtgaggctcaggatttactttttaacaagccccacatgatttcgaggggttgcctcatttgtgaactgctgaaataagacgaaagcagtgaaagaatggctgggcaggggttggatcaggcatagggagggattgccttgacagacctgagcaagtcaaagtaaattttaacgggcaataatggctttgagatcyggctataaccactgccttctgactttctccagcaactcatccccagtagtccagaacataataaaaattaaaatagtggccgcatattaagcattcaccatggggctatattctgtgctgagtcatttacaggaaacagcctatttaattctcacaayaaccattagagtttggtactattgtcagccccattttgcagataaaaaatgtatatagcaaaatttagtgactttcccaaggatccacaactggaaggtggtacatttgggatttgaaccttggtcctcgggttctagagcccctggtttataaccattgtgtagatgcctcggctaattcaggtttcaagccaatgtcatcataatgaagggagttgctctggtgtcctgctcacacagagagcacacagcaaacttcttcattatgatacctggaatgccatgcctgtctctctttaaacagctttatttcccaatcatacaattcactcattttaaagtgtgcagttcaatggtttttgtatattcatagatacgtacaaccaccactagaatcaattttagagcattttcatcgccttaaaaagaaatcctaataaattaggcattcagccattcattcattccttgaaacaaatgcttattagacacctgcttgttaaatatttttaaacagtagtaaataaaaataacaatcctaggctttatggagcttatattgtagaaggatgagtcagaccataaacaaaataagttggtaaaacatgtagtatgttaggtagtaataagggcttaggagaaaaacaataacagaaatgggagaataaggaggggcrgtttggggaaggatgatgaggatgcttggcgattttaaatagagtaggcacggaaaggtttacgcagaaggcaacatctgagttaagaggtgaagaactgacaacagccaacacagggaggaggattcctccaggcagaaggattggcatgcaaagactctgggctggaaatgggcctgagtgttgggggaacagcacagtggctctgcctgaagaggattatagggcatcaggtcagagagatgggacttttgaggtgggagacagatcttctggggtctttaggcctctgtgttttcactaggagtgaggtgggaactgttggaagcttttgagcagaggattgatgtgatctgaagaaacttccacagggaccactccggggctgtgcttcccagtacgttacgggaagtggtctcctaggaagaagccgtcccaaagttcaggccaacagcagcccaaggggttaaggaatcctggggtctccagcagatgactcaagtttactaacagggtgaatgttgcttagaagtctggacatcccagctgggtgcggtggctcacacctgtgatcccagtactttgggatgccgaggcaggtggatcacctgagttcaggagttcaagaccagcctgggaaacatagtgaaaccctgtctctactaaaaatacaaaaattagccaggcatggtggtgggtgcctgtaatcccagctactctggaggctgaggtrtgagaatcgcttgaacccaggaggtggaggttgcagtgagccgagatcatgccattacacttcagcctgggtgacagagcaagactccatctcaaaaaaaaaaaaaaagaagtctggacaccccaatattagtccatttccatgcttctaataaagacatacctaagactgggcaatatgaaggaggtttaactggacttaaacttcaccgtgactggggaagcctcacagtcatggcagaagacaagtcatgtcttacatggatggcagcaggcacagaaagagtgcttgtgcagggacatttctctttttaaaactgtcagatctcctgagactcactatcatgagaacagcatgggaaagacttgcccccatgattcattacctcccaccaggtcccgcccacaacatgtgggaattcaagatgagatttgggtggcacacagccaaaccatatcaccgactataatcatctggagtttccccagggccccaacccttgggcaagaccattccccaaggaaagacacatggcaattcagaagagaggtggcagagtgagagggaagcctaatactcacgggagattcctgaaagaggaattcagagtacagatgaaaacagaagccaaaacatcccaagaagacctcttggggagatttgagctgcaggaataggggccgaagtcacaagaaagtcatgcaaaacctaaacatcccaggaacaatgcctgagcatgaggcaccatatggaatcccactgatgagggtgtggaaagcagctcaggagcttttctcctggaggagaaggttggttgggaattggggaaaaccagctgagcttgtaggtgggaaaattgcacttgaggagctagggaggtggtagaaatcctactagaggtggcaactctaccatatgtccttccacttccttctcactaagaaggaatgtgagtacacattgtaaaagttttgaagactgttcagagggacataaatacatgcccaagtcagcctggccctttcaggccaaatgtaagccactcactcaaagtgctcacccctgcaccactgtgattgtggatgtgggtttcagataaagccccagtgcctgttacacacacctatcccagccttgttaggaaggctaaagcctgaatatcttggaattagaaccacacaatgtttattttatggccatttgggagcatttacaatttttactacctgcctttagctgcgacgtgtgtgccaaagcttcctactggctccatttgtaagaatcagagattgttctgtcaggaaatcttttgactgaaaggcacccagaagtgttagttctatctttgctggtggttctaagtaatgaacaggcctcccaggctaaattagacaaaccgaagtgtaattaaaaagtaagccccaggttaaaagaagtatttgggtgatgaggaaaattaagccgayagyatttcatctcccaaaattgctttggggattaaataccaacgtgctttggttaaggattatgcatttcaaatgccacatccacagttcgagagttaagaaagaaagcatggcatccgtaaactycctgtcagatgtttactgaaaacttagtatttgcacaacattctgatagacactggagacgaaaatgaataaaacacgatcaccacacacactcaggggatgtgtataataaacagtactaagaaatgaaataataaaagcaggaaaaaatggatatgaaagcacagatataactatttgcctaactctatcaatcgataagcacctagaggatatttttgatgtaattgttcatatcatgatacgagatgtaaaatgcacaccaagctctgtagactcyacttttgtgcaaaaaaaaaaaaaaaaaaaaaaaaggatctgtgtccctagagctctacatctaaataactctacagtctggctactcaaagtgtgaagtgtgggccgtgaatcacctaggagtgtgttagacatgcagagtctcaggccccacttcagacctgctaagtcaaaatttgcattttaataggattcccaggtgtcttgtcatatggtcaagttgaagaaacagttttagagtgtgtatcattgccccaaatgcattttagagtaagcctacaatttccgttatttgaaatgggaaatacagtgagctctttacagcttgtcatcaagttgagtgtattatctgttggtgacgaagtcatagttcctgtggaaatcacccctgtggttccctccctacatccacagtagaaggtactggttgctttagtcggaagtgagtgaaaataaagatggaagttcctccaccccattcacgtgcttgtgctccatgatatctctcaatgaacagcttgggggtctgtaaaccccaggtaaggacttttgctccagagaagaactacagggtcagggaatctgttctaattcatttatctgtttttcatcaactgctactggttaaacctgtgtttcgtctataccattagggtgaggttttaattttaaaagtgactttggtgaggcgtggaaattcttagggatttacctgagggtccccaatcactctgggtaytcagctctaccatcacattctactaaacacccacagcccagtgagcagggatttcgttgtaatgttaaggagtttttgcttctcagccacagatgtgctcgacccaccattttgtcttctttcttcttcctcctttttagcggctttacaaagagatttcctcatttctttcacagttaccrtatgtgttatcctctgcagagccttgctttgcttcactttgctttgcttcctgtcttttctcccctttcccatatctcccacatgttctaatcacatccattcacctctttctttacatcaaactgaatggctcgcgttcttcttacaatcctcatgtctgtcccaccagcaatcatttcaggaccccaaaccaacgttagtaccatcaaactgagttcagccccagaaagytaaaaagttgtgtttcagaccgcaagctctgggcagatacagatcagctatgaatggacgagcccaccaggacaagcaatcaggtgytgagtggggggtctagggtcatatgtsctcatttcaggccactgctcctccaccaagtcactgcatgaccacctgaatgtcaattttctcacctgttcaatggagataaaaatatctcttacctcatgaaactgtaaggaggaacaacaagataatrcacctaaaatattgtttttaatgaaagcctttttctgtacaatacctgaattgactaggaaatctatatgcacttcaaatataaacaagtattacagttttttatatcttgctacagcttgagggaactcattgtctctccttgaatgatttctaccagcactatgtgctctcccagctatctgggagccacacttgaatgttctcctttctgtggttgcctaggtgatgtatatgtgccaggagtaattgcagtctcaggaagtatccctactgtcagttgtggtagtgccatctgtcttcctccaatatttggactttacatagggtcattttttttttgaaaaataatttagctttcccaaaaaatgttgcatttttctactaaacaagaaatgacaaataagcaaaagatgttagtagtgaaataagaaataaaataattgttgacatttttgtcaattttcctgattattaccccartgggattcmmacacacacacacacacacacacacacacacaaagatccaaatccatatagttttcaatttgcttcttttacttagcattatgccatggtgatttttcatgtcatgctttttaacgctttttcatggcttcrtattactttattgcatgaatgtagcttaatttatttatctagttccctactcgaggtggtgtattagtccgttttcacayggctgataaagacatagccaagactgggcaatttatacccaaactgtgaggtttaattgaactcatagtttcacatggctggggaggcctcataatcatggcagaaagcaaggaggagcaagtcacgtctgacgtggatggcggcaggcaaagagarcttgtgcagggaaactccccaatataatactattagatcttgtgagacttattcgctatcacaagaacagcacaggaaagacccacccccataattcaatcatctcccaccaggtccctcccacaacacatgggaattatgggagctacaagatgagatttgggtggggacacagagccaaaccatgtcaggtggcaactccacattgaatagaagccttggtcagactttcacattcattttttctttgctcagcaaggaaaaaaaatttcaaagattattataacattgagactcaaataagcagctattttaatataagttctatttagctatggaaattttaaaaataagaattttataggtgtgaaagaatatctcatagaatgatcaagatgcttgacttttttgtccaagactttctccttctgaaaagagaagggagctagtagagattatagctctgggtagacagggccctctctgtctgctcacagaggaaggttggaccatcaatactagcatagtactggcacatagtaggtaaatattctttgaatgaatggtcaggtcacactcccatataaacatcttccttgtttttgcttttgtttttgtttttttagagaccaagtctagctttgttgcccaggctggagggcagtggtacaaacttggtgcactgcagcctccatctcctgggctttaktggtcctcctacctcagcctyccaagtagctgggactacaggcacgcaccaccatgcccagctaattttctctattttttaagagacaggtctcactatgttgcccaggttggtctcaaactcctggctttgagtgatcctcctgcctctaccttgttttcaaattgttggtgatgtgcttgctgtgtagatcattacttagttcagatgttttgwaaattaatttcttgtagaagaaaaacaatgtatagtgaaaatccagagtaaatgctttgactaaaaggaaagaaagaggcatcttctttagacattagtggaagggaaaggaagatgtgttgagcccgaaatatgaatattctagacttggctttttgcctatgttccaagattatccttcttagaagagactccaaacatacaaatttctgtccacatattttttatcccttttgagttagagtcaaggaattattctcctccatggaaaccattttcttgccctcagatgactaaaccaagtgaaatttagcagagttragaacaagcgtgaagttttattccccagggcctttctgttaactccttaaaaggtttggaacattgagctgggagagttatcatgaatggcaaacaaaccagcmaaaagtaattgagatgtgtctgttcctttgggacagaaaagaaaatcataccaaaagtgaaaattaaatgttgtttactaccattcagtttaccacataccttcttaatttatttcctaggaagtccaagtgaatttttgcttcttctctacctttaatagtcagtttactttcagagttttgtgactaataaatgatcgaatggctctttgaacagagccagcctgctgataaatacaccaaaagttagtataccttgcctttatgttagtcacaaagcacttcaattattatatgaaaaatcactcttctgggtactattttcacatcttatgcagtaagaactttgagcccaaaacacagaagtttatcttgtttagagattaagcagagttgttttatttctgtttttgtttgtttttattttatccttattcttttgattgcaagccacagaattccatgctggactaacttaggccagaagggtatatactagaaaagtacaaagggtatatcacataagaaagggggctgtccaaactctgcccctgcttttctctgcatattagtgttattcttttccaaagtagcaagacaggcttccccttgrtagaaaatacaggcactgatcccttctgagttttatttctccattgacatgtaggaaaaatcttggggaaaaccttgtttgggtcccatgatgaccaagtctgcaaccagaagtcagagtatgactgacccaacttggattaatgcctcccctggaccaattatcttggccaagagatggggggtaaaatatacagcagctcccaagggaagcatgtgggtgaggccattctcagaaagcagaggaagttcttcctggagaagtagttagtattgggtagagaaaactacaggtgtacctcacatcctctctttgtagcataaaaaagagataaattattgatgcccatataaaatcccattgccaatttaatgtgagttgggyggtagtggcatactatttaatattaacaaaatcataatattaattattctgtctcctggaggttcagtagacaaaatttaaataaaaatagtaaatgccgtrygggcagaacttcagtaggagtgagggtcttctgaaaactagctgaggtcgggctcggtggctcacacctgtaatcccagcactttgggagactgagaagggcagatcacgtgaggtcaggagttcaagagcagcctgggcaacatggtgaaaccctgtctctactaaaattacagaaattagctgggtatggtggcacacgcctggaatcccagctattcgggaggctgaggcactacaatcccttgaatccaggaagtggaggttgcagtgagccgagattgcaccactgcactgcagcctgggcaatagagcgacactgtatctcaaaaaaaaaaaaaggctgagatgagcagaggtggggctgtgtagtaaggcactgtgggggagatgaaggcaaactgagyacagtaggacatttacatattttacatattaaacagatatcctctgaaaacatatactccttgggattctagggaaacaccattttcatttaattgcatgcaaaagcctcagtttaaaaaatacacctggatttcacattaagatgctttttccggaaggaacaaaatttagcttgttaaacaccaaacctatataattttaaaagtatttccaataaggcagcctgtggcttgaatgtgagctttcagagctatcgctgaggtcgggtccagtgtagttttgaaacttaaaagatttcattcacaatcatttttttcagtgcctattttgtctagagcctgggattctaaacatttattaagaatggaaggttgaaatggtgacatccctttgtgggagcaataataagatatttacatacaaaaggtatgtctgtaaatgatacyctgtaggaaaaaccaattagggggccaacacccagagttatctgggcagtcaaaggggagaattacctaaggctggcttagaaagggaaggggcagagagaaattgaaatggtttcttccagattgtctccatcttccacaaccaccaagacaatgcttttcaaactctaatgtgcactcaaatctcctgggaattttgttgaacatgtagattctgacttagttgatctggagtagggcccgagaacttacatttctaatgtgctccctgrtgatgctcttgccactggtatgtggactacactttgagtagcaagatctagaaagccaggtcgtcagctcagagtttctagaacagtgcctgctatttagtaggtgcttaataaatatccattgcatcgtggctgaatcagatagtttagataagtgtgtgttctgggaccacaggaggtggaaacttgttctgcaaggggtaaagggcaaatgcagggggtgtgatgggagccaagagggaggcaaaaggacgtggcagacagggaacttctggggagtctggagggagtgtggcactgacagtggtgtggagcctgacaccaaaccaacataaaagtcagaactgagtgggcagaaggtctgtgagttmtccagcttagtctcaatattgactggaggccgatgctgctgaggataaaggcagtaggyggaagggaaacagcacatgtgagcagatgctggcataatcaagaaaatattctgaagtcaggtgaatgatagagatgaggacatggaaacaggaatataattgttactgaattcaaaagagttgctgggagacttagcagtggcttgtagaatgagggagggtccaccaagacaacctcccacttcaagtctggcacaaagcatccaaatcacctcaggagattttgagaatattgattcccaggccctacccctagacatttggagtccataggtcctggaatctgtatttttaagaagttcccccacatgattctgatgttgcagccaaggaaggtgatccctggataactctctrtaactccttcaagtggttggaagaggagaaaagccctctagggaagggaaggtgctagtgagaggacactttcagctaaatagagacgttgcaggagaccccaaggaaatggccagagtctttgcacactggaattttacatctagacagcttgayaaatggcatgactacaaagtaatgcctcatgatttctttaattgtgataatcatgattaggcaatcccttttgaatgatcaaataggctttctgctggcccaagtcctagttaatatttgttcagatttaatccacttcacagatgaatgcatcaaatttcatgataattttaaacgaatgtggattccgtatcgtaattctcttgcaagccatggaaccttatttgtctgggtttgtacccatctcagccacttaccagctttggggccctgagcccaggacttgagccagatgtgtcagcgtgttcttatgtaaaacaaaaataataacaccaaccgcatagggcaattctcagaattaaataaatacatgtgaatcttttttgttttttttttttttgagacagagttttgctcttgttgcctagagtgtgcccagagttgctggagtgcagtggtgcaatctcggctcactgcaacctccacctcccggattcaagtgattctcctgcctcagcctcccaagtagctgggattacaggcacccaccaccaggcctggctaactttctgtatttttagtagagacagggttttaccgtgttggccaggctagtctcaaactcctgacctcaagcgatccacctgcctcggcctcccaaagtgctggaattaaagtgtgagccactgtgcccagccacatgtgaatcttttaaaactaggcytgacatatagaaattatcagttaaagtgttgtaggaccctatccttagttcagctaaagacgggttccttgtcacatggccacaaaaagttaggcttgaaggcaatttgaagagtgaggaggacagggttttattgtgttgaaaggaaaagagggaaacaggttatctccacaaggctggagtccctgctagtgtgcttcccaccttgcagattgaattccaagttccacccaggaagaggagtggccaggctcctccctgctgcaaatggggtggatttctgtggctccacctcagtgtgcattcctcccagtgagcaggcccgttgcagtttttccggggactcccttatacttggctgtctcaaaagtttgtggtattatgatttgtcttgtcactattacagctgccacttatagaagactagtcaactcagcttgccttatatgtttttgggaaagagaatctccatctrtgggaaaagcagtgggggctttcagaggatgtccacactgtctattkggtgctccagtaagaagggttgagtccagttgctacagccacctgaaaaccttgcagaaggttctccaggttcctcatgaggaaaaaaggaaaagattaccaggcacaattacctttatgtaattggcaaacacttactgggcatcaagtgaatattaggaattgtgcagaataccaaggatacaaaaacacaattgatgcccccttggggcttgatttgataatagatgtatgacaataaatacttgcgttcacagtgatgtagtgacagttcattgaaagcacaaagagaatttctgatgttctttatatctactggaaattacccacgcaagaacataaatgtcaacttctaagatgggaaactcatgttatcctcaaagcaattcaacaatgaatgatagttgtgagccaagaattataacttgctgttgattataacttacatttgtgtcatacttatttttattttgagcttcacagcacctccaaagacataaagacagtgatcaactgagaaaatgtaggttctgaaaatgtagggtcttgccccaaatttcacttttaataagtcttagggtagagattggaaccaggttctacactgtaagttgtctttgcactgagctgggctataataactgccacaacaatctaatgaattctgtttaattaaaaagagataataagaagaatttcatattaaaacccataagcctagataatatgatggttctaaattgtcctcattgccaatgttagatgtctgacaactttaactattgtgaaacatccatcacagatattctaactatagattctgttgtttgagggaggtgggaaggaagctctgtttgcaatcatttgaaatagcaaactgacattttctttttccagcttattcaaaagttgacggatgtcgcagaagagtgtcagaacaatcagttaaagaagctcaaagaaatctgtgagaagtaagccytcattcccattacaattgacatgtgcatctgaatttattcaacacaaattcccatctgatttgcctcttttttctcttttacttccattgtgacttcagagaaaagaaagaaytaaagaagaaaatggataaaaagaggcaggagaagataacagaagctaaatccaaagacaaaagtcagatggaagagtaagtcaaaagtgtcccctctcccaaacagttcatctgggaattattttattytgtacgtcagagtcacaggttcataaccagtcaaagactccttcgtgaagtttctcctctagtcagcctttcaaaagattcttttggtaaggtttttaacagggaaggctcaagcaaagactggttcaataaaggagtgaggcacacccagggccttttagataaagagtaagcaaagagcttccctcagggaaaggctaaatcctcacttcctacccataatcttcctggcatttagtgaaaacagagcctgtgccttgggaggaacctgacctttgtccaaaggctggcagattataccttccttgtagcagtaataagaatgttgctatggctcacacttgtaatctcagcactttgaaaggcctaggtgggaggattgcttgaggccaggagttcaataggggcctgggcaacacagggagactctgtctctacaaaaaaattttaarattagctgggtgtggtggtgcacacctatatttccagctactcagaaggctgaggctggaggatggcttcagcrtgggaggtcaaggcttcagtgagccatgatggtgccactgcactctaccatgggcaacagagcgaaaccttgtctccaataaataaatagataaaaataaggaaaaaagaaaaagaatgttgagagttctgtaaccttttatctagaagtctgagattmccatttgtcaattctggatgarttggtataatgatgtattcatcatttgcttttagggagaagacagagatgatccggtcatatatccaggaagtggtgcagtatatcaagagggtatgtgggctcatcacgctctctcctttgcaaaacatgtgtgaacatttggtgagctcrctgtgagcttctggaaggaaatgtcatgccttgccrtaactttttatcactagcacctagcagagctgtttcacagggtgggcactccttaatcaacatttctgcaagttgaattgcaaaccactttgtaaaaggattcatctaaaaatagagtcaagtcatttccaaagtcaagagcccagaaacatattgtaaatgatagtgttcccaaaagaacctttaattgtcatcaatgatagagatgatggcaacctcgaagggctgtcctttttttttccaatttaatgtcatagaaatgtttacatatttataaaaaggtaagaacagtgcagtccattgatcaccacctcccacccttatgtttctgtcacctagcttcaacacttactacagtttyctatacttgtaagtgtagttcttgatcaggagatcaaataatcaaatgtaagccatagatctgaaaagctttcggtattttctgaaaacgtgcacttttaaatgtttagatgaaagtaatgtttcttgtaactttcttatagytagaagaagcgcaaagtaaacggcaagaaaaactcgtagagaaacacaaggaaatacgtcagcagatcctggatgaaaagcccaaggtaaacggaactgaattaaaatgmacaattattttatttgatttccatttagtaagagtaaaaccttcctggtttacataagtaccttgtacacagtctcagatcagttcttgcatatgaaactcatgtatctttctcaatgaaggaaaaaatatagcaatattcagtaagcatttatcatcacctggtgagcttttaaaaactgcaaatatgcagaacccagccccagagatttggctttaactaatctggggtatggctcagacaaaggtatttttatagtccgtttcccctggagaatcagagactaaccaaaccttcagtttgggtactactaagtaaacgtcagttctaaatagctgatgtaatgttgtaatgccaccctctgtccagcagaggatgccctgcaccaaaatcactttggtttttatctagcaaaatagtctcataaatcagagaaaagcaaatcttttgtttcccatagtaacagttgattggggctctgctttaaaattatcttatgttcattgtttggttaaaattaattgtcttatgaatattaactttgaatgaactgagtatytgtagatcaaatactttgaggttaccaaatggcatctcagttttagaacattcsttccattttgattcatcactgaatagttttctgtttgtggaaattgtgtttttcaattttcctgcgcttctattttcaatttaaaatatctactctaaaaagtactgccattccacacaagcatttctcgagtcctaaaagttaaaaaacgttagttttatttaattgtatgtttcattcaccagtttacttcttatagatttcttatggataattctaaatatattttcatggttctttgtgctcttatgctttcatatttattatataagacatttatttaatatttttaatttctaagtttttagggttggcaatatagattctcaagcaagaattaataattacttagatatggtgctaattcttaygtttctcctataaacatataatgtagatcttctcagccaccctctcaggttgattatgcactaataaagtggaataaattttaacataatttcagaaattgctatactttccaatcagaattgatctttttaaaatgctcaaattatttagagcaaaagatccagtttgactgaaatttaagaaacactttaataataatcagtctcaggtgatatattcagatacatacatttctaatctatgctgtctggttttaaatttgtcattactttgtacactgacataatagaatttgcttatggttgatggctcagctagtttttgtatttcaaaaaaatttaggtaatatggttcttttcagagtttcattttgcttttttttttcatgcgtgttttggttcaacaatgttaactattttacttacagataaaatgtgaatgtaaaatcattaatgtgtttaaattatataactctcagtatcagtaacccatacaaagattttcwtgttactgctctaggtcatcatgattaaaatcaacctcagtaaatgtggaagcacccttaaacttcttccctggatataactggacatgaaaagaactaataacttttggctgatttattagcagtcagggtgcattcagctgcaattttacaataagcccaattaaaactggcttcaacagttatagtatttagtaagccacgttactggaaattcagaggtactacagttgtaacagtgattaatttagtggcttaacaatttcatctccaggtatttttagaatttccactgttgttgccttctagatccagaccgtgaactcagtcatgagatggctgccctagctccacacatcataaccttacatgaaaccactcaaaggacgtgcagcaaatgtcttcattttgtaamcctttctaggattgagaaaaaccttcctacatcccccctagctggtgtttcctcattgggtacaatggcctcatattcccattcttaaaccaatcatgggcagtagggtatcactttcatgattggcttagagtaattaagattcactcacaaggctagagagagttcagttttcctcagttccatggtcatcaggtacctgaacaaaactgatattttatcatcaaagaaatagagsggaaatagcaactgggtagamaggttacatacagtgtacgttacagccatgtttataacaattttttgtttcttcctttytggccccttggaaagagatctgaagtgtttctatgaatttttagtagttctattgtctgcgttttttattgtaaataggtaccatgatgaattcctctgtgcttttcttccatgaggttgctccatgaccatctttttgygtctggatttgaaggttgcccatgaagattgttggttccatgtcaaactaaagcatttcttgagggtttttcttcatggcttaaaaacgttgtgccttaaagctgtgattttattaataaaataataaatcatgactgttaacattgtaggacatggtggttaataaagggaaatgacaatgacaasaggagcagcaatagacagtagagtaaaagaacaaaatcaagtgtgagacatgtgaagaaagaccaaagcacaggacagcaaagtaggtattaataaatgggtggtgaggagaggccaggccagcatagcagtcgctgatgctcctgtaactgtggggcatggatggaaaatacagtaacactggctttgaaataatccctctccacatctagtactgaaacaggctttgaatcttgacatagacatgagggaaattagcaaaagcagaaacaaaacaaggaacaacccaaggaaatgaaactgatcaatagtatctctaaaacaagtccacggagtcagttccattcagtcagataagaaaacagagtgatttcgtgacatctagaactttatgaatggttccattactgggttttggawgaggaacgtgagctgacattgcagcaggtaatattaaagacaattgtaaccttcttatgaagaagaaaccatgccaaactttgccacaggttactgaggagaatagagttcctccctcaactaatttacagatggtatcggggaatctgccccgatattcacgtaggttcttttctatttttcctaagcatcggctggcttgagaaataaagggacagagtaaaaaagagagaaatttttaggctgggtgtccgggggagacatcacacgttggtaggatccgtgatgccccacaagccgcaaaaaccagcaagtttttattagagattttcaaaagcggagggagtgtgcaaataggtgtgggtgacagacaagtacttaacagggtaatagaatatcataaggcaagtggaggcagggcgagatcacaggaccacaggaccacaggacygaggcaaaattaaaattgctaatgaagttttgggcaccattgtcattgataacatcttatcagtagacagggttttgagatcaactggtctgaccaaaatttattaggtgggaatttcctcttcctaataagcctgggagcactatgggagactggagtctattgcatctctgcagcctcaacagtaagagacagctatgcccggggggccagtttagagacccacccgcaggcrcacattatctttctcagggatgttccatgctgagaaaaagaattcagcgatatttctcccatttgcttttgaaagaagagaaatatggctctgttctgccyggctcaccagcggtcagagtttaaggttatctctcttgtttcctaaacattgctgttgtcttggtcttttttcaaggtgccccagatttcatattgtttaaacacatgtgctctacaatttgtgcagttaatgcaattatcacatggtcctgaggtgacatacatcctcctcggctgacaggattaagagawtaaaataaagacaggcataggaaatcacaagggtattgattggggaagtgataagtgttcatgaaatctttacaatttatgtttagagattgcagtaaagacaggygtaagaaattataaaagtattaatttggggaactaataaatgtccataaaatcttcacaatccacgttcttctgccatggcttcagccggtccctccatatggggtccctgacttccygcaacaagatgggatgaagttttttaactagaaagtgatcatagctaagtttttgcasacaccaaaagtatgtataggctacatgacatcatatttcttcctgttcttccatttctttcaccatgttgttgtatataataatttactttctcttcatccacttattctaactaatgtaatagtgtgtttcatgttcctaatcttgtcttaacagggaggaagctctttttttacattactgtttgctctgggatattactattttgagctattctgaaccttgatcaacttagaaaatcatatcaatataattttctaagccattggtaaataaacaactcctttgaaagtaacaaacagatattttgtaaatctttcagcaaaagaaatttgaaaagccaatggctcaaagttaacagtttttcagtggcaaagaagtatttattctggctcaatttagagcaaactacacatgaaacctcattcaaagtgtgactttgctagcagtttactcaacaatgggcatgtcatctagagttcccaasatttttaccatcctgcaayagcagtcataggagaatatgcctcaatcaaaatcaggctaaaaatttgtttcaattctgcrtgtgagctgggaccttaagtctttctggtcgctatttggtaggggaccaaatgtggccagtcacactggaaaagtttattttagattgtcccactttgtgacatgcactaggatcttttcatgtggagagttcattttttccctatgaaraaagagattcaattagtttattcattttgtaggtaattttgagggcattggggaaaacagaagtaggtggtccctcgaagcaacttgtacaataaaatattttggcctcaatttgacacaaaatgatgttgtacattgctgcacataagtcccatggaaacttattatgttataaacaacaagagacactcttagaagggaatacttggctcctttccagtagagttcygaattctggagaaacattcgactgcatgttttctagcaatgagatattcgattcagtccttgagtgtatgtgggtttcagttttgtttgagttgtggctttttatgaaatccatagtggtagaattttcaagatggacgcagtaaacactggccagtcttctgactcagtgaaataattggtttcctggggatttccatacctgggtttgccaaagccartaggaaacatggggaaaccccatctctaccaaaatacaaaaattagccaggtgtggtggtgggcgcyggtagtcccggctacttgggaggctgaggcaggagaatcactggaacccgggaggcggaggttgcagtgagccgagatcgcgccactgcattcmagcctgggcgactgagtgagaccaccctgtctcaaaaaaaaaaaaaaaaaggaaaagaaaacacggttartcacaagttgccttgagtctgttgtgaatatgccaatgtttattgatcactttgctgctcctgactctctttataagaagaatcatcttttgaggggaatatttaatgaactatctccataacctcataaaacagtcaataaatgtgtaatttactttttctctgatgcttaatttgtctttgatgcttcttagaacacaggttttctgcttaatttagctcatcatcaagagagaattccgggaagctttagggcattttaattcattcccaaagaacatttcatcatgtagctactggctcttttttttccctccaccaagggaatatagactgattttccttatttcccctctgacatctttgtaacagggtgattgactcatccctctgcttgaagttagtcttgttagacctaccgctgggctctgagacagaaccttaaatgcggctgatatctcctgtgtttgggagagaaaaggcaaacttcgggatttaaaataaaatattttttaaagtaatgcatttgtgcctcctctaatcttttgcggcttgatggggaaatggattcttccttgccagcacttattggatcttctcccagaagccaaacttgcagagtggaaactggctgcttatagacagtgtttctgctcattgtcaagtctcaattaaccacacagtggtttgtttttgtttgttctgtagaagaaaattctttttcatttttgtcaatataaagaattgcctttttaggaaacaaatatagttatgccttattttcttgagtataaaacttagacatgtttactctccttctgggcaataccagggcattggaacaattttaattccactggtccctcatcagtttatttttgaaatttaatctaatagacttttaaacacataagacattattctatgttwtgatcatggttcatttagatatgtctacatattcacatattctttgtgaaacgttttttcttgtatcttctgcccatttgggatcatcatcttgtacttcctctagaagttcctttcatgcggtctactggtgggaaactctttggagtttttatttttgtttttgtgcagaaatgtctttgtttgtttaatgtagtaatagatgagaatctacatttcctccattctggaatgatattttcactggatataaaattttgtgttggtggttattttcctttagcacactgaagataaacttccaccaccctctagcatctattgctgttcttgagaggttaactgttagtcttaatacagttcttttgatgataatttatattccccctccccccaccgacagcatttagtatttttttcttacattttgtgcagtttttctatagtgtgtctaaatatgtgtttgagatggctagatggatcactttcctcagttctgcaaaaactctaaactatcatgaaagcaaatatggcttctgtcattttttttctttccttctaagattccatatatatatttgcatataaaataaaatgaacmtttttactccatctcctctgtcaatgaattgtttttagtattttccatccttcgtctttctttactgctctgtgggcaattttttttcctacactttttgcaatgcaccaattttttgtttaaacttctattctatgcatccactgagtgtttaatttcaggttttgtattttatttccagatgttctatttggtttattttcaaatatataatctgtatgtcttagcttgttgcagggaagctttcctgtgagatttctcactctgggaaagcctmagctcttgactgtaggctcctcacctttcaaggctatcaaagggtgaacacacaatttccatcatgagcaaaagcctatcagggcaaaagcagcttccttgcttattacctttctaggttcaatgtccccttcagtttgaccctgatcattaagttgttgtagttctctgggtctttaaagatagttttaatggccaggcatggtggcttatgtctgtaatcccaacactttgggaggccaagacagcaggatcacttgaggtcaggagtttgagaccagcctcgccaacatggtgaaacactgactctattaaaaacaatacaaacattagtcaggcatgctggtgtgcacctgtaatcccagctaccctggaggctaatgtgggagaattgcttggacctgggaggtggaggctgcagtgagccgagatcatgccactgcactccagactgtgtgacagcgcaagactctatattgaaaaaaaaaaaaagctttagtatcaaacccagcttcttaatttttttcagtggaaaggatggtccaaataacctaatcagccattaccagaaatagaaagtccccacattgcatttctgaaatatttgaattagttaacatctgtatcagtcaggkttcaactagaaaaacagagccagtaaaagattgtgtgtgtgtgtgacagtaattggcttatgcaattttggtggatggctatctgccccgttctcaatgctgtctctctaatgatggaccctagcaggcaggcaggaaaggaaaattacaagtaggcttggtgactagagtaaccwgcagaagctgagcctctttgtcacagagttgaacatacacacatacacacacacacacacmcccctggcccaggagtcagacaattaaaggaagacccaatgggcaggggaagtgattgcaggctcagctgctgcttcccatcaaccagacacataaatcaacagatcagcaacaatgcctgagtattacacaatgactgctgactcccccatcagccctccaattctcagaagaatctccatggaacccacaatagctggaaacatacagaaagggaactctgggaaatatagtttggctgagacagttggcacrataagaagcatcacactgttaagtaaaaatcagaaaatgttttatttcaaaaatactctgtgtctcttgaaaaattagattctaagattataatagaaacatgcaaagaatttctaaagctaagaagaagctgtcccttagggctgcatggtactccctaggctgtttcaaagattkctattgtctattggccccataaggtaactgagtttgagatttaaacaaaaattaaaacttagattcgcatggatgccrttgattcctcccccttttctttaccatatcaactttctttccccctcctttgtccatatttttctttcttgaggatgagaaaatgtggacatatggtgataaatgtactggatagagggcagaggctcagaagagaatcttccccacctgctagagtagggggctacatgttggtggggttcagcgtcttcccagcaaacaatgattttaacaccgggaataggatgaggtggacttttatcatattggctttcatctgcccacctgccatacatgaaaagtccacacaaccacggatggaaaaccttttgggtttatttccacttctacttctgtgtgcctgtcattgggcatgatttctgtgaattttgctaatactcattagatttttttaatcctcaatgtatctctgttttttttaaagccctattttgatataaccaggatagtgaaaattatcaaacacacacatccaaamcactttaaagcaactaatgtaaaattttaattgwtttctagaaaccaatagctgatttaactatgaccttcaatattttaaagggaaaagatggccaacctcaaaccaagagaaatactctcatcccttggtatctatggatggttggttccaggactcccctcagatacccaaatccacagatgctcaggtcctttatataacattgtatagtatttgcatataatctatgcatattctcccatgtactttgtcatttctaggttatttataatacctactacaatgtaagttctacgtaaatagtgttatactgtattgtttagggaatcatgtcaagaaaaaatgtctatacatgttcagtacagacacaaccatccacttatggttcttctgaatagttttgatccaaaagtggttgaatccacagatgtggaacccatggatatgaaggggatgactgtatttacctacagaaaatccaaagaggaaatctactagatgctttgagatatttgatgaagaagtacttggagatgagagaaaaggctattgcatgagggcaaatgcaggcatactgggctgaagaaaacactgaagaaatttttccttccaaataggaaagcagttgccaagaacagcattacagtctctgttttccatgtattatattatatctaaggccatattcatgcagcaaattcaccacttggagtgctgtttatacattttctgtcaacagaaatcaacagacacaagtgttctgtgtttattataatcattagttgaggttaatctttgatttgtcaaggaggtgtttgaatttcctcaaataatattttcagattttraagagtcacacacacacacacatatacacaataacacatttatacagacacacgaacaactttatacaattggagagaagcttagcagattaaccattttggcatcaaaatggatttcgccctatctaattatgctagtatataaaaatttgtgtcaaagagagtagccagcagcatgtgcctgtgtttggtacataagagagaatagaaaatacattgttttctatctttggctgagaaagatttgtttcctttttctttgcacctttcgtattatccaaaaaagaaaaaagcttactcttaggttttgcaaatacacagtgagctgttacaattcttaagtttcttattgggtctgtgttttaggtggaaccaaaaaaccctaggacttgaaaaaaatattgtaaagcagtcaagacatctttataattgttgagtaccaactgcagtgcaatcactttagtcaaagcctccatcatctctcccctggatttctaagtagcctccaaactggtcttcctgctgccacatgtacacactcaaaatctattctcaacatgtcacccagaggcatccttttagaacacaagttaaatcaggtcactcctctgttgaagacccttcaatggctcccataatcctctaaaagtccaatacagtctaactccacttttgctgcattttttcttcccttcctccttgatatactctctgctcaggccacactgggctcattgctaggccccaacaagacaggcgaatcccaccttgagccattgtttcctcatctcccaagtgtctgtttgggcaactctctcctgtctttcaaatgtttgctcaaatctgtcagaggctttccatgaccactttattaaaatttacaacccccctccaccactctcccatccctgccatcctctctcctgtttattctgctgtgctttctgtttttcatagcatttgtcaccttctctcattcagtcatacccttctttcctaagtgtgtccttgagtactgccccacccatcagaatataagctccacaacgggaagaggctttgtctgtttcgttccctgacgctcttgagttccagacatccaagaacatcgcctgccatatagctggtgtccaataaatattttttgaatgcatgatgtatgtagagggctaacaacattaactttgtatgttaaaaaatagttctggctctttgcggggagaaaagtagtgcccttaagcccagactccttggactgtgttgttcactgaacaaacagctgtcaatcattcatcactatcttttctcaagtttcttgatggtagtgggattttgtggagaatatctcaaaagtaacagctgtgatcatttttaacaactaatttttacagagagtggggaggccgaggagaactcaatgccaattccattgcatgtgtgggaggccaggtgccttgtcacactgggggtgttggagcagataaaggcaaacagaggagttaaaactgtaytctagaaggcactccaagagacgtcccagacaaataattggaaacaccagatgacttagaaatcaatttcattgccacaaaaatgacagcctccctttttttccacacagggggaaggttcctcctcattcttgtcggaaacttgccatgaggatccctctgtttcccccaactttactccccccaaccctcaagctctcaagtggtgaccaccgtccttccggccaggtaggactggatgggaggggtcgcttttgagagaagggtggtgtgtagccatccagttttcaggcatcacggacttgctcstttgtccttcatcctccctttctctacattcccatcttttttttctgctaaagttcccagccacacccatgatcatttcctcatcctttctgccttcctctggtattaatttctccatcattgtgctctctcttcctgacataaatctcattcttccatattgtcttcttcctctttctccattttgtttctctattggcaaatttggcttcctttttaatctggattttctctcttgcactcagactattattcccactttggaaacatttttttttccatttctgcttctcactacactgttttcccgtggtcctattatcttacaatccagtgggatcaagttaactctcaaggagtctgtttcaatccactcccctcaacttaccacagccctccttttggaagtccagcaaaatttactttattcccacatggtatttagagtgaatggggacagcttgtgatttcctgattctctagaagcaagagctcttggaaatatctcactaatagggatgcttgggccaggagctctttgtcagagcaaacttcagcttgaaaatcagagcagactttaacttacccaaggagatgcatcacgaaaactattatattcccttcactaataagaaaactagcataagccattccaaagagtgtgcaattcttagaaaaaagaagcattcttgtgattataaataaagcaaactttattctaatgtaatgaaaataaaattctacagtgagacttgtactgtttttgtcttcaagtatttgttsatctgtgaaataatgcagtttaaaaacatgtcaaagaattactgaaaataactctttactgagaaagaggtatgagttattcctcttcctcgacatcagttgttgctctggctcagagcttttcagacctttgtgggtatctgaattacttggacatcctgttaaactgcagacacttatctaggatgtctgagtggggccggaaagtctgcctttctaagtagctcccaggggatgttgatgctgccacagttccagggagcacattttaactggccaggatgtagtacattcctacctccaggcttaagcacctggaagaagcttgaagcaactgtcatggcattttaatgtattttaactttttgacccaatcacaagcctgggcctttgattttttttttttttttttctactgcctgtaacactagaaagagggacacagggaatgccatgtcagaacaaagtcacaacatggctatgaattctgttcatgtcctctcaacagtgatcattttgtttctgtattaccttgtaaygaaggccatattggaaggtgagtagaggaccgacatataatatcaatttctggcttctacaagaaggcatcagggagaccttgacaatttcttcttcgtttggatataaatgttaagactatcttttaaatcatcagtgatgagcaccattcgatttttttgttgttgttactcttgttactgccctggtagttttgtgttttttgtttgtttgtttgtttgtttgtttgtttttgagacattgtttcgctcttgttgcccaggctggagtggaatggcgcaatctcagctcaccacaacctccacctcccgggttcaagtgattctcctgcctcagcctcccgagtagctgggattacaggctccctccactacgcccagctaattttgtatttttagtagaaatgggatttctccatattggtcaggctggcctctaactcccgacctcaggtgatccgcctgcctcaggctcccaaagtgctgggattacacgtgtgagccacggtgcctggcctgccctggtagtttttaaagctattgtgaaacatctaataccacaagtagaatatcttattttctcaggggatgcaaatgacagtgggtggaggagctaagaacacatgacttaggttttatttttcaaaacaaatgcaatagagacaaaaatgctgcatttttgttgctgtgctctttcaggcttgtaatagcgtgttcacaacttgtattccctttagaatgtcaactgagatacccactggggaaaaatatttattttaagaaagagacaaatatccccacaatacctagacttcaaacatttaatcatattgttagtttgtttggtccctttagctttccacatataaaagatgacataaaaataaatatttcacacttttcatgtcaaaataggtctcgtggctaaagcagaaaaagaaaatcccattatagcattttatatttgaaaaaagaacaaaacgttcttttataatagtgtatggaaaaaagatttttgtactaattttaatatttccccaaatgttttttgcattcttgttctttccttaaacatyttcattcatacactacagctgaaaacaaaatgatgaataaaaagtaatagtacataaggccgggcatggtggctcatgcctgtaatctcagcactttgggaggccgaggtggatggatcacctgaggtcagaagttcgagaccagcctgaccaaaatggtgaaaccccatctctactaaaaatacaaaaaattagccgggcgtggtggcaggtgtctgtaatcccagctactcaggaggctgaggctgagatgagataggagaatcccttgaacmcggaaggtgatgttgcagtgagccaaggttgcaccattgcactccagcctgggcaacaagagcaaaactccatctcaaaaaaaaaaaaaaaaaaaaaaaggaatagcacataaaggtataaagctgtcatgtgtttgccaaargataatgttttctattatgatagaagattggccccaagagtagtcatcacataaatagttggaattttacattttttaatttgtgagtgcaaatcttcwttggtgaaaaaatatattccttgttatcagctagaccttaataggtgaagctaagtaggtgagttatacttttaactgtggtaacccattttttaaatagctacaaatcactgtagagcgagatataaaataaacaaaaaagatgtttgctcattttatgtatacataagtctttagataaagagctgtagaatgaccaatttctaaaaacaccaatgaaacattagaaaattataaatatatgccaagtaattattaatgcctgctttattctaggatatgccaatttcaatagaaaacacaaaagaacagaaaacatagttcctacatgctttgaaataataaaggtcagtttaaggccgtagaaaggcatcaaaatatttttctgacacataatactaaaaacaaaaattagcatttatggagcacttactgcatcatcaaacacctttaaagcacataacatgtgttatcttcttattcttaccactgtacatttggagaaactaaggttcaaaaaggttaatgaactttactaaggtcagacaagaagtaccagaccttggacacaccatgtgtccttcagctttctaagtatatgtctgaagctaagattttatgatctagatgtcaaagtaggtgacttctctttcttatgttgacatggataaacaagcaataagggtacaacacctgtgcctcaatatacttatctgtaaaatggaaagacgacgagcctctttgttaaagaagcatatctctttgagtggctagaagggatacacaccacacatgtataccaaacactgtttcatttgctggtggcatagcccagcctccacaagatcgtggctaaattgtgccagagatttcacccccaaactgatcacaacagcacaaggcattaaacatcacaggcagcacgttcacattgctcaaagtcacttgtttttagcaaacttctgggagaagaacatctctgaggactagattttagaaaacctccagctctgtgaaaacaggactcacctctaggaaaccacaattagtcacagtttctgtcactgagaggtgggcagctgttttccgtgttcatcgcatctgctggggaagcaatgccaagcagaaggaaagggagacacctgaggcacagtgtggcctgcacagttgggttaagataattttgagtcaaccttccctgtctatggctgctgaaaactcatagttcccctctctaaagcagcaggattgaggaagggctcacccactctcacctccttccaactttggctttcctccttcctctcatctcctctacttgcaagccattcggcttatacatgtcaatgctgtttcaacaacagactcagtgggtttgcttcccctgaggtcttctttctctctctcctcttcccattcctcctcttaagtctgtctcttgccccagccttagaacagaatccttgttaactaacccttcttctgtactatacaagagaggagttagagtacacrttgggctttgcaacgggtctgctttcatttgttaagcaattgttttttatttggatttcatttattcatttaaatatttatgargccctactacttaccctcaggatgctaggcattctaaaggaatatcttgctagagaaacrtctccgtttagattgtaccttaagtttcagtcacagcacagaaaagggcttctttggaacctgtgacaggtgaccgtcttctccttttcctctgcagttagattcagggcgactgctttgggctaaattatgaaagacttaagcaggagtaaagagatttttctgaaagtaaaaatatctaaatacctaaatagattcccgagggctgttgtgtgtctctttgaagatctttaaatgcggagacaaagaaggcgtctaccagcagagggttgcgtatgtctgagtgacctttttatgatctcttttgagtccgtgaaggatgcgattaattaaagtcggaagtttgtcactgaaataatagttatgagatccagagaattcaaggtgttggaggactcattaagtagttgcataaatatcatgctgaaagatttaatgagaccacagggtcacttatagaacgatggtgcagagatgacctagaaaaaaataaattagaatcgatattgtgcttctgaattaacagctatagattgctatattaacacctgagacataaattctataattatatcttaatgatgaatattgatgttcttgtcacggaaaaaatgaaaattgctcacatttagtattttacttatcaatagtaaaataaatgtatatatgcgtgcttatttctgtgacatctgggaaccgtgaatgctttaagtagctacaattaaatgaatagtgttttttttttttccttttaattcaaccaatagttattaaatgcctactacacagcaggcactgggctaggtgctgggaaaaaacacagatgcacccttttccccccttcaagttgattatagtatagtgctatccaatagaattttctgcagtgatggaaattttccatgtctcagtgtccagggcagtagcaactagccacaagtagttattaaccatttgaaatgtggctgatgcaactaaggagttgaattttttattttattttaactgtttatatttaaatataaatataaacagccacatgcttaatcttagtttctaatgtgtaatccaccgttgtgtcaaaaaggattgcactgggacaaaagactatgttcatcattataaaagagctgtttacatgggaggaaaggctgacacataattgaggaaaccaaggaaggcttcacagaggtggcagtcactgagctgagacctagaggagcagataagaaggacttcctcatgacaatatgaaaaagcctgagatgcgagtatcatgttacttgcatcttgtggaactgtatgtaatttcatcatttgcatgttgtgttactctgctcagcttccacagcaaaatgtcacagactgggtggcttcagcaacagaaatttattttttcacaattctggagtctggaagtctaagatcaaggtgcccgcgagattcgtttctggggaggcttctcctctgggtttgcagacagtggctttttgccatgtcctcagatggcctttctatgcacatgcacagagagagagagagcgcatgcacacgctggcacttcttccttttcttataaggacaccagccccatcagatcagggacctactcataggagctcatttaaccttaattacttcattaaagatcctgtctccaaatataatcacattgagggttagggctttgatatatgaatttggggtagacacaattcagtccataaaggaagtatatctctcacacatagctcacacaaattctgtagaaaactatcatctatttacctagcatctggtgattttaatcactgcttttgacttgcatagtgatagataacatagggttctagaatagtaacaggtataaaaaatacctaaaccaaagtatccacctcacagaactcgaatgtaattaaatattgcttaagcaaatattaattttcctttattctttgaagacaaaccagtggtgagctggagcttactatctaagctcataagagtccattttaaaatttttcagggattttgtgacctggttattcaacacaaccattactacaaattaaattatataaactttcaatgaaataaatttattcaaaacaaatgtaacaaatactcataactcatcatttaccaattttttcctagarctttgttgaagcactttttaaattttttttaagacagggtctcactgtgtttcctggctggaatgcagtgaagcgatcatggctcactgcagcctcaatttcccgaggtcagttcaatggatcctcccacatcagcttcccacrtagctgagaatacaggcttaccaccacacytggctgatttttttttatttttagttttgtagaggtggagttttgccatgttgcccaggctgatcttaaactcctgagctcaaagcgatcgtcccgcctcagcctcccaaagtgctcggattacaggcatgagccaccatgccyggctcacttacaaataatttaatacctctcactattgccggtgctctcactattgctggtgctctctaggtactttgcatctttacatctactacgcaccatsggtagtggtggctctgacagtctgctactgtacacctcctcccaacgccttattcaaggtcacgactttgttactttgagactggctctgggcaagtatttacaccattgaaaatcaacaatctctaaaactgggccctttcattttccaggagagccgtatattaatcatttaccggcataccactggcacaaaccttaccctctttcatggtacagggttttcccagtatttatctggagttcctgttgcagctttccatggttgaaacattattacccatcctttaaaaacaaaatgaaactttttactgaaataaattaccttctttaaagcttttttttctgtttcctccattagacagagcctgtactgctctgttgatctatgaactttcaggccctcagtataaaatgttttaaggacaacagaaaagtcccctaaaacttacacctagcattgacaacatttttctagccccctcagcaatgtcttctacctaaaattgcctcagctgtaacgtaacatacctcctgctgctagtactagctcacagctaatactaagcgtaacacctgactccattttacaggggccactttttttcctctaaaagttttatgtagcagtaagtgaaatagaatagatgctggggtaaacagcagtttccagattaaatgttattttctgtaggaaacatttctctccaatgttgccccttcacaccatccccaaacaagtaaaaagttgctcagactttgaaaatgtaataccatctggcagaactcacattcgaccttttattaaaactacaattatgtcacacctgtgaggtttaaaattcaaggctccggaagttaaagcgaygtgtccaaggttacatggaaaattcttgagagctcacagtttcctgccctggcctttcacttcggatgtacaccatagtacgtgtgttttctgattagagctctcttcagttatgatttattttaccatcataacattttgggaggctggtatgagggagagtatagaagaaggaattcaagcagaaaaggttaaatgatttacagttttcgccctttctccaagggaaatttatgtgcccccaaattttagaatcatgaatttagattgaatgagaatggataaaatccatttacagtcaatttagattgcataagaatggatgaaatccttggcatatctaaagaatggaaaagggatcccaggaggtagttctggataacttttaacttgaaaacgtctggtagaggccgggcatggtggctcatgcttataatcccagcactttgggagggcgagtcaggcagatgacttgagcccaagagtttgagaccagcctgggcaacatggcaaaaccctatctctacaaaaaatacaaaaattagctagctgtggtggtgcatgcttgtagtcccagctacttggggggctgagagatgggaggattgcttgaacctgcgaggtcaaggccgcagtgagccaagatcgcactactgcactctggcctctggcctggacaacagattgagaccctgtctcaaaaataaataaataaatagtctggaaggatagaaaaagcaagtgagaaacaaaaaagggaccacctatgaggtaggaggaaaaccaagagtgtcaaacaaacccagaggaaaagcagtgcatgagtatgaagggcatgttccccagtgtctaaagttggtgaatgctacaggagagtcttctttggttttagtatccaggaggtcattattggccttgatcttaatgaggaatcagccaaaaggtggggaagggaaccaggtaagagtggattaaacaggagaccaggaacaggagacagcttatctaacactcatttggaggtttagactcgaagggaagcagggatctggtctagtaatggaggaaataggagggaaaatccatttgagaagagattaatgaatccttctaattcatggttcggtctagtttatcatgaaacactaaatcaaatgaaagagttgcttctatagccctgtgcacttccatcagcagattttatattgagttgtgcagatcaaccccattgccaaggaagaacaagaaaaagatatttcacctacattaatggttggcagagtggtttttccctctgataaattaatattcaatggaggaacaatatgttaatgagtatacagcatatattattcagaacaataacaataaaggatttctgtagaccttgtttaaatgttaggttttcttttgctgttgagtacatgaacagcaatacttacacaacttacatcatgatcgtcagagccgatacagaaagccacaggcctgcctggctgctacactgaggtgtctacagaccaagaggcttcacatgtgcctttctgtaattagtatttactcagcctcctatagcagggaaaatattttgcacataataaactcatatatttccttacccattaaggggtaatgtacttaagcacattttcctgtaggatttttaccagcaaggtcgagtcatagctccaggagaggaaagaatgggactcactagaagagaagatcctcattagcaagtgaaaaattttgtaaaacagggattacaagagaggaaggtatttttttttcaaatttttcaaattcctttaacttcttctaacatggaagtcagatctggggggctagagccttgcttgctatatacccaaagatgacagaactcaggataagacatagaaaaagagaaaagcctgcccccttcttcctcaggccttggaatcgttggaagaagaaggggagagagagaatagagcaggaaatgagactttgtatgtacctctctgacttctaccctccaggcgaaaatccggaagattctggagcaggctcatgacacctcatatcttgtgtgtcttagaagggacacgaaagctcttgcatgtcctggtgatgggaaatggtggtgtgagcgggggctggtgtgagcgggggctggtgtgagcgggggctggtgaaagctgggacaagacaaagaggctccctctggtgttgacttcataactgaagtccgctggactcaagtaatgagtggacttggccagactctaccggggcatctcgccccaaatggccagcagtcttgtgtccatggagaaatctagaccaaccatttcacagcacagacctatgaggatgcagagagcagcctggcaggtctaagtctgtgcctttctcccccttggaagacacactgatttcctgaatagatttacccaccatttgggagagctgaaaatgggaaggacaactttacaagcttcaactttacccaaagagactgactcatgcaaaaaaacgtgtaaaaccaatcctatggggagtgaaatgttgaagaaaccataaggaaattgtctatttcctttaacagttagaaggactagggcagcttcccttcctgtcatgggaagtgtggctcctacgccctctgggagagtggtttgagaagtgtttccgctgtgacttaaattatagccatttcccgagcaggcagcccagggactgtggtaggcagtgccagctactcggagtcaattgaaagggaattggtcgcctgggaggtttctaacctgatttcaggtttcctggacaccgcgtcctctcctgacccaacacctgctgtgacagatagatgtttgtaatgaggtgaataacaaacagtctcatgaacattaggtcacatggaacaaaaggcacactggcttaggtggagcctgcattttcctgtttttctaatacatttctctaccaagtctactcactcgcggaaagctttggcaagatttttaggcaaagcctttaaactcacatttttttgaagaaaaaaatgtttgctatttcatggctgaaagagagactcaattctgctgttacattcagaaatctgtttttttgtttttaaatgtctgtttcatacttaaaatctcagaatatcttactgagaccagctctaaagtaaactatttcaccacactcaaagaagacccaaccatcataataaaaggggcagaaagaaacattgggaggtgatggatttgttgtaaaaatgaatgagggccaggcacggtggctcacacctataatcccagcactttgggagcctgaagtgggaggatcacttgagccaaggaaatcgaaatcagcctgggcaagatagtgagaccctatctctaaaaaaattttaaaaaattagctgggcatggtaacacatgcctgtagtcccagctactgaggaggctgaggcgggaggatcacttgagcccaggaattgcaggctgcagtgaattatgatcacaccactgcacagccagggcaacagagcaagattctgttttaaataaataaataaatattaatgaataaaatcaaatattcctaatagacaaactggcttttgacttttctggtggtatttcaattgatttttcctgtagcggaattcataggtgaatgcctgccacagcaagggtccagtgtgaatgaagctttctatgtgatttgtaggtttttcctctgccctgatgtgactaccagaagtggggttcagctgggagttttagaaatgactttttctttttatttaaattttgtgcctaattatattcttagatgtattggtcagagctttatcatgatcattcgtatatctacagtccctcagtatttaagtcttattagcaaaagtaaatgtgaaaaaggtattgtgtgagattttacaacagcccaagatgaagagtatagatgtgtgtggtgtttgtcgatggcattatgcttctatccttgttctgacaggattctggccttttggaacattctgtctaaggattgaagctaatttagttgagaaacctaaatattacatttcgagaatgaatttaacacctagatttccaatcttgaaattacaatagtcactcacttatcaaagagtagagtagaaaatagttctttccttttaacatcttttctctcttaaaattggaggacagggatttataagtagtgttccatctatccatccatccatttatccatccatccatccattctttcatccacctatccacctatggtatgtacttgcatgtgtgtgtgtgtgtgtgtgtgtgtgtgtgtgtgtaaacatatttaaaaggcaggtttactcattgcttttggtacagttctctaaactaaagaagcttatgttggtacttttattgtccatgaaattatattatgaaacaataacaggtaggaaggatgggttcccataaatatcctcttactctctttgcattttgtatcatgtgcactactaatctcttacatttgttaatccattgctatggttttgacataagttggactgacaccttcatttagcagrtgtagaaagaggcccagagaggtccacttacaggcaggagtagggccaggccagaaatctagtctcccgtctttttgcttttcttagcaaacagattccccaatgagcagacttgattgtgtcttgctgcacagcaatccacactaaccatacaggtgtaatgtccattatctaaaaaccccagtccgctttgatttcggatcatgtgcttcccttctctactgtgcagatgtcaggtaaacaggtcatcgctgcactgcttcattgtttgttccagtcttcttttctctgggttccttcctttattcattttcagctgttatgaatttatacacaattaaagggggagggaggcatattaattgaaaaattgatgacataaccttgagggctttgctttaattacctccagtgtccaggaatgacagttcttcagatttatcttctcttccttaatagaggattttcccactggacagacttctggcaatatctggtgttcagactgtagtgccatgctctgctatttttattactcacacaaaagtgcgttgatgggccatgggcaagttaaatttatcatcttgcaacggtgggatgaaagagccattgctaaccctggcaaacctaaggtgtacaatttcacaaaattacatagatggtaagaggtggtgttgacacaattggagctgacactttcatttagccgacgtggaaagaggcccaagaggtccacttacaggcagtggtagggccaggtcagaagtctaatcttcagcctccttgctttgtactcccgacctcaaacccraccactctcttctcccaaccataatgcatcttagtgagttacagtacaacacaagatctagaaatatctgactattaaaaaattatctgctgatcataaaacaattgaaaacatagagaagaatttagttaggggctagatgtagtgtttaaaatttgaaaatcaatagttttcctctatagcatcaataatatctatctgtctatctaattatgtataatatgaaacaaaacaacagaaaccataagatatattaatagaacacatataacctgtttatagatattcctaaggaggattgtggcaaagattcctggaagtgatatttaatggtatcttataaaatggtagtgaagagaaaagtaaaacagtggcaaagaatatgaaagatgagataccagtgtataagagagcaataaataattaaaagcaaacaaatgggaaggaactgatctttcagaaaaaaccaggagatacagctaagtgcccagagcacaggatcccatctgagagggacactggaaagagaaaaccaagggaggtaaattatcaaagaaatattataagaaacattttcacaactgaagaatattaattaccagactgaagggccaaactgagtgcccagccacaagaaagaaatgacccacacttaggctccaaactggaaaattttggaataccaaaaacaaaaagaatttttttcaacatttccagaacaaaaactaccactcacaaattgaaagtcagaatgagatcaggcatctctacagaaaatgaaagtttgaagagtaaagcaaagcattcaaagtcctaaaataatttaatggggaattctgaagccatactatcaagccagagaatagaacaaaaacatgttcagacatacaaaatactgtaccatctatatatttttctaaaaggcaaaacaaattctgttctttctataagcatatatatgaatatgaatgaacagagaatttctggacatctacataccaaacttaaaccatggtttacctgggggaggggactgggattagggaggtggccaaagggtgctttgcagctatccatattgtttgtttgcatgtgtttactgaaataatgtaattatgtattatctgggtgattaaaagtattcttcatgttaatgcaagataatccattagtgataaaagttagttttaaatgagagcttgtttgaaattctaagctttcctctaactgttcatctggaaccacttctttcaagtgccctttctatttctagctttaaaaagaaatccaattcaggctaaaaggagccattatagtttcttgatatcatcacatttctgttaatgagcccttcaaacttgattggttcttagtagaattacagtgattctgaagcaatcctgaagtcacctgtttccctctgccatagaaaatgccgcatctgttgctgatataatctaagataacaaaatatcaagaaaacaaaacagagagacctgagcttccaatgaaaactctgtataactttttaaaatatgtttaaatgcatcaatgaatgggaaaaaagtagagaacgctcagaggacaaggtccaagtgaaagcaggtaccagagaggtgagcagagcatgcaagctgtcctttatcttgaaggtgtctatcagtgtcagcttggtagaacttggtattgaaacttggtgtagaatagaggaggaaaaaattctccctgagaattcatgattgcaagctggtcctcactggggggtttgaagcctgaattcaccccacctgacaaactcagggccagactgaagggccaaactgagtgctcagcaacaagaaagaaatgacccacgcttaggctccaaactggaaaatttcagaataccaaaaaacaaagagatttaatttaaatctgtctcatcctggaaatcctctgggctcctgacataattaatcagtttgtttaaaaaggaacccatctttaaaccagaccttaaactattactacagataaagttccaggaaattcaccacatgaaagcaatcacaatgaatacgaagaaagtccatgagtgagaaagagcaaaaataacagacagcagaatgacccctacaaaaacttgagattttggaattatgagaaacagaatattaagcaagtacttttaaggttgacaatatgagtaaaaagcaactgactaaaaaaagcgatgaagcacatttgcaaacaaacaaattgattctctataagtgaaaaatatatttaaaatgcaatgcatagttatagcaacagaaagagaattagtaaatttttagtgatctatataattagcaagaatacagcaaagtatcaaagacatggaaaatatggtagagagatcaagaggcacgaaggatagaatgagaagaggtgagagcaaataggtacaggagattatctgaagaggttatgtttcagaattaataaaattaattctggattaattcatagattcacaaattcatagattaagaaatctcaagcatagtgtattttaaacaatgccacatctaaatataagtatcatatttaagttccagaaacacaagtatcatttaacaatgaaagtaataaagagatttttagcacagcccaggaagacaaaagatggggagcaaggatacagtgaggactgagggtttcccaccagcaaatcttcactaaaggaaatcatatctccatatgctagtcagacaaaaagatgcccactattatccctttctgttcaatgcagtaagacaagaagaataaataaaagatacaatgttcagatattaaatgaaaaaatatttgcaaatgatgtgaataactattcagaataatctacagataagttaatgagttagcaaatatgctgaatataaaattaatttataaaaatccatttcatttccatatataagcaacaggcagctagaataacttaaaaaatatataacrtcataacaagtaaagttattattgggtataacatcaaacaaggtctattataacatgcttatgaattggaagagccaatagcataaaaataagttctggccaacatggtgaaaccccgtctctactaaaaatacaaaaattagctgggtgtggtggcatgtgcttgtaatcccagctacttgggaggctgaggcagtagaatcgcttgaacccaggaggcggaggctgcagtgagccaagattgtgccactgcactctccagcctgggtgacagagggagactcagtctcaaaaaaaaaaaaaaaaaagttctcccaaattgatctatagattaaatgcagtaccaaaaaaagtcaacatttgtagaatttgacaagctgattccaaaatttttatggtaaagcaatggcccaggaattaccaagatgtttctgaagtgggacagaacataaagattcatcacatatcaaaaatcattctgaatatgtagtaattaagatattagtgggatactggcagctttaacattggcacaaatawgtgatctatgaataagcgcacactgatgtgagaacttgatttatgagagagatggcactggagacatgtggagaaactcaggcttttcaataarcattgaaagaactattattattgatatggaaaaaaactaaattggattcctacctcacctcacacacaaaaatcctatctatgtggtttcaagaattaaatatgaaatataaaactataaatctttagaatattatgtagaatacctttgtgcatttgggaaaaggaaggtttttctttaccaatatagaaaaagaacaaaatttaacagaaagattgataatttgggctaaattgaaggtaagatattctgttcatcaaaagacactttgaagagagtaaaaagacagataactcctacacttaaaacttaatcaaaaattagtgttatacatcatcctttgctaaccatgagggatttgttctaggacccaccccgcccagataccaaaacctgcagatgctgagcacctgacacaaaatggtgtagatagtctcaaattgatttccagagggtttgcaccaatttttacttccaccaacagtttacagttgtcccagatgcaccatatccttgaaaattacttaatatcattagacttaaaaataaaaagtagcaaaacatgaatccctggtttagttggttaaataatggtccctcatattcctaaacacttcctcagatatgccagtgtagaggtataaaatagtgtaacactgtggtttatttatatgtattataaatatatattatatatagtaaaacctattcatcctcctatatatattaaatcctctccagattacttatactacctaaaatgccatataaatacttgttacactgtattggttataatttgtattatgttttatttatgtttttttttttcaaaattttttgagttacaattgggtgaataggtggatacgaattcaaccagcagatacagagaacccatggatacagagtcaactgtattatatagtattatatatactctatattatagtaatatattataacatagtattatattattatatatgaaattcctacagattaagtgaaagacaaacagtagaaaaatgtggaaaaactcaaacaggtgcttctaatatggaaaaacacaaacgattggcaacatataaataggctcaagctcattagtaatcaaagaaatgcacattgaaaccacagtgttatattattttatgccttcagacaggcaaattttttaagtctaacaatatcaagtgatttgcaaggatatggtgcatctgggacaactgtaaactgcaggtgggagtaaaaactggtgcaaacactctgaaaaacaatttgagattatctagttaagttgaaggtgtacagtcctataaccagaaattcctcatcaaggtagaaactccctagagaaattgtagcatatgtgtatcaggagcgttgtgccagagtgttcatagcaacactctctgtactagaaaaagaaatgaaaaataacccacctataatagtagaataaagcaatgttaatatattcctacaaaagaatattacacaacaactaaataaatatgacttgtagctacacataacaacttggataaatttcatcatcaaaatatttagttaaaaaaacaagtgggaggaaaatatatacagtatgattcaatccaataagtttaaaagcatgcaaaatgaatcaatattttagtatacaaatatgataccaatcaattttttaaagtatgagaacaataaaaccaaaaaattcaagactctcattacctctgaggagtcagggaaggagagaggattttataaactagtcagtaggtgtttatgcttcaatgttctttatatcttatgactattttaccctcttttatatgtactcaatattgaagagatcaaagctatcttgagtagaggtaaaagaaaaatttttttagttaaaaaatatatttaaggccgggtgcggtggctcatgcctgtaaacccagcactttgggaggctgaggtgggtggatcacgaggtcaggagttcgagaccagcctggccaaaatggtgaaaccacatctctactaaaaatataaaaattagccagacatggtggcctgcgtctgtatcccagctactcaggaggctgaggcaggagaattgcttgaacctgggaggcggaggttgtggcaagctgagatcacgcctctgcactccagcctgggcaacagagcaagattccgtctcaaaaaaaaaaaaaaaaaaatatgtatatatatatatatatatatatatatatatatwtaaatgacacttttaaaaatggagggaggagagtagttatgatatatcagtttactgtaagaataattttgacagatgggatattttcgcatgtcagcatcattcaaattttttattatgttaaactgattaacagtaattacatataaaaagtggacattcaagtcattcagataaagccactaccccgctctgtgggtttgtcagaaggtgtcaagtcctaccttctcagtaggcgtctacacagcctggcgctgtatccctctccacccgccccctcgcagtgtrcactatacttccactgttccagctctttgtctgtccccagatggaaccatgcttctcctgtttctgctgctaggccacaattcctccagatatctccacactggtacctttttctgcagttcttggttcaaatgtttctttgcagagagactttctcaaatggcagagtagtttctatcttttttccttttttttttcttttaatgtgtggcaccatcattctgaaaatatcttattcttgtgattacttgtttataacttgtttcgtccccacacaggggccgcrtctctgttatttctccaagcacctggcatagaggagatattcaacaactttatagaatgagttaatattttgcagactaaatagttgggcaatagaaggttgcatatatattcttattttttaaattggggaaacagtaaagttcagacccattcactttaaatattcatccaaaagatatttattaagcatttagtatgtgtcaggcactgcgctgcatactaagratacagagtgaacaggaaggtagccaggaaccctgtgctgggaatggacaggcctccaggtgcctaagaagatcagagtaaaatcaggaaccaaatgatctggaagctaagttgccaaaatactgtgggtaggattctgggcatttttcttcaataattctatagtgatacctaaagccagtgtggagattaaaggatgagactatcagaggtaaggggagctttaggacacaaagctagtcattgcaccaatgccagagtttccacgagaaagaaaaactaaaaagcagcaaaacacaagtccctggattagttggttaaacaatagtccctcatcttcctaaacgcttcctcagatatgtcattgaaaaccccagctgggaagacccctctgagttccaagactgactaatgaaatgatatttctacctttgatctgttgcaataaaattaagatgtgagtagaagagaacagagatatctctataaagttccctgttacagctcagtcagccctttgtatccatgggttccacatccatggactcaaccaactgcagatcagaaatatttgggggaaaaaacggtgtctgtactgaacgtgtatagatttttgtccttgtcgttattccctaaatcattgagttaggtattatcattattccctaaatttacattgagttaggtattataactagcctagagatgattcacagtgtataagtggatgtgcaacgggcatatgcaaatactacaccccttttttgttttttgttttttgagacagagtcttgctctgtcacccgggctggagtacagtgacgcaatctaggctcactgcagtcttcgcctcctgtgttccagtgattctcctgcctcagcctccctggtagctgagattacaggcatgcgccactgcgcccagctaattttcgtgtttttagtacagatggggtttcaccatgttggccaggctagtctgaaactcctgacctcaggtgatctgcctgcctcagcctcccaaagtgctaggattacaggcctgagccatcatgccccgccagagccaccacccctgcctgcaccactttaaataaggaacttgtgcatccgtggattttggcatccaaagagggtcctggaaccaatcccccatggatgcctagggacaactgtattatattaggttgctaatcaattcgtgtacactttacccagttttataccatattgaactattgatatttgatttgacatacctgtggccatttttgaacaaggccattctgaactaatatgtcttgatgtgagagcatattccctagtggcatctttgtttctatggaatgctctgattcaatttatatccctttgatttatatcctgtttccatcagggaacaagctctcagcactaacgccttctacacaggaatgcctctaccatctctttcagatagttcagaaggcccttgaagatcttacacattctaaataccctgggacactttccaccatatcacaaggtcattacaattgtctgccagtgataattttgttccttaggttccttaacatttactcctggttctcggtgggtttgtcagcatctcacagggttggcaatgacacccactatacttctctctatcccgccttggggaatcagtttaacatcttatctccttgcttgttggaattgacacatccagcattcagactgtccatgctacatgtaggataaccaacaaacaaaattgcgttttttgaaacttaaaagctcaatacctttatttactattagactgcagattgttgggcctgtaagtaggacacacattgcctagagtggtccggctctgtcctttgccatctggctgcatgaatcaatgtcagctggatacaaatatatctctggaaaggggacattgggaaaaagggtggatacactaagcatagaccccagaacctgttctcagaaaaatattttcatggtaaatcctgagatattaaaggacaggtttaaaatgctggctgcatgctttctctgtcttttattttcattggatgctagaatttgaatgggccctgtttctgctttattaatccatattttgtggcaggagaaattcaggagaactcasgaatggcaggaagtggatgagaaagagtgtgtgatagaaactgcaagtagccttaagggcaaaacaagaataatgctactgagatgatgaggcttgcatatccagctggctactgtattctggccaccagaattggatttcagcttggattttygaggcttagcagtacaatgaggactgggattcataaattataattataagtgttatttattaaaaggtagttttggtctcagaaggaaccaaataataataatgcatgcatcactgaaagataaaaayccataaaaaataattggggaatatgagataaggggaaaattgagaataagaataaaaaggtaacttggagtaagggaggaaaaattagtaagccaatcataacacacaccccataacatcctggatattggttgatgtctggatattgagttcatgggtcaacactggccacagaggtgaagcatcattggagtagcttgggcttgcaaggaaggttggcattatatctcttcccatccccagatgccaccatagactcacctacactatccccaggtcctcattgtactcattttattcattcacacgttttttgaatgtattcaatatgccagtgaccaagttctggagaaaccatactttgtaaaaagtagacattgtccctgctccagtgaaatttacccccccaaaaaaggagagaaggaaccaataaacaaatgatctcctgaactaattgtctagctacaaacccagacaagttatctgaaagaaaggagcatggtgccaggaaaacccagactggtctgagcaaggtaggtataggggatcgaagatcaggcagaacatcttggagcaagtgatatttgaactaagagccaaaggctgagtaggaattaactaggtaaatggtataaggtctggtagagtgagaaagwgtgtgtggatgaagagaaaccctttcagatacggagaataatacacgcaaagtccctgtgataggagggaccatggtgtgtgcaaggaactgaagagtcatggtagatagaccacagagcatcaggaaaagaatatacaatggagccagaaaggtagacagaaatgaaacccataaagccttggctgctgcattaacaattttggcttttatcctaataagacttaaggctggctgaaggtagtgatatgatcagatttagactttgaaaatatttttattgattaatgtggggagcaaattaaagggtagaaggggcaagcgggttgcaaaagattagctagggatattatgttagtgcaggcaagagactctggcagtgtggagtcggtttatgacagtggtgatggacagaggtagaaggatgtgagaaacagggcctggagccggattggctgtaggatacagggaaagggaggagtcaaggaattgcctagacatgtggtttgtgcaactgagtggattttgactcccattcctgggctaggtgtcaaactgccaaactgggaatgagggggagggagccatgacagcaacgttggacatagtatgactgagatgttttcaggcatctagagaagtcatgtggatggtgaaatgtaccactttggaattgagaagagaagtcttagctggagataaaagatttgtgagtcatacataaaatggaaggaaagtggagagaatatagcatgacaaagaaaagaaggcctcaccaggcgcagcagctcacatctgtaatcccagcactttgggaggccraggcgggtggatcacgaggtcaggagatcgagaccatcctggctaacatggtgaaaccccgtctctactaaaaatataaaaaattaggtgggcgtggtggcaggcgcctgtagtcccarctactcgagaggctgaggcaggagaatggcatgaacccgggaggcagagcttgcagtgagcaggagatcgcgccactgccctccagcctgggcracagagcgagactccgtctcaaaaaaaaaaaaaaaagaaaagaaaagaaggcctcagatggagccatggagagttttcaaggagcaactaggcctaggattattctaaactcagcactaggattgtaagggcaagtgtttattttctcaccattaacttaaacttcttctctattgttttgtgttacccatgacagaaaactctcactcatctctcactctagaatttcctcagttaaccctaaatcatctttgccaatgatgatagaagtttcactctaaatgggtttaatcaagatgaaaaatataatcgcatcattttataatgaataagacttcacaggtatgctaaatggttgttaccaaagtcatttaaataatagtgattttatgcgtctgtgtttcagtggtyggcttctctggccttgacctgtgagctcagcatgaagtgctgagatttgatttaagatgacctagagtttatgtactgtcatttacttggarattatcactttgcgtatttcagatgacatctcttaggtcagttttgcaagttcattatttcaagctgtctaaaggaggtataggattttgtaacaagtaattaaggaaaccaccataaaagtttaagwttatactatatgatagttttcattatccaatgctgcattttttrtaatagacattgaataggagggaactatccttactaagtggtaggcatttttccccatgattatttgttcactgaatttggaagtgatggaattccaatgaagagctatatcaggatcatatgcacatgtgcagtataggtatttgcatttgctatgtgtgtttccctgtgttcgcgatgtaatatataaaatcaagacatcaactgttgtctccccagagttatrgctatataacttaagcagcaaaggaaaggatttaggggtccattttaatgtaggcaagagataagaccattttttcaagttaataggaaagaaaattatggagctgtactgtccaaggtggtaaacactagccatacagggctatttaaatataaattattgaaaaattgaataaaatttaaaattcagtttctcagtcacactagcacatttcatgtgctcagtgttcccatgyagctagtggctgtggtattggacagtgccaatatgcaacttttccacaattayggacagttctattgaatagtgccaaacaagaacagggttcaaatccaggccagtgcctctgtttgcacagccagtgcactaagaatgattttgacattttgaacggattgaaaaataatcaaaygaagaagaatattttagagcacatgaaaatcatttgagattcaaattctartgtcctcaaaatttctattgagcacagccatgtgcattctgttatgcattgtctatgtgttcacactacaacagctgcattgagtagttgtgacagagactttatagtctgcaaagtctaaaatatgtactccctggctctttaagaaaagtttgttaactcttgagctaaagggaggaaaggagtagtatcacacattaccgtcataaaaaatattctgtatagatttggaaaatgaagtcaataaggagaagggaaagtgtatctagaattcatgcccagatttgatggctgtgggatatcctgcattggggggtgtgatggtggatgggttgaaagctctggaaacgttggcaatagcctttaacatgtatccaaaggctccatcaaaccctcagctttctcagtgtctttgcaggttttttaggatactctcaaaagctcacttctctctgtaattcaccatcttccccattgtaaaaggcaaattaagtcctctcaaaagtttgacaatatgaaacaaggaaattcagttagtctcttgacagcaatgccaattatcttccttttttttaaacattctcttaggcgaatgcctaagacaatggaaaattattttgcagtgagacccaagccaatccagacacaagctgctctcattacaaccatctcttctcatctcttgaggatgagctcactaataagagtacattatctcttattgggacaggcttaaatamatgcaagaacttcattaagtcattctctatcagaataggagctattgagaatttctgcagaactaggattgtgtcttctctacmtatgaawtgagtggtgtcatgacraagcactctagggagccctgccaacctatttgataatgttgatggacaagattgtatggggagtggggagaaaaaacaccttttatattcttccctgatgtatgtataagtagttstttaggaagagatgaaatgcgtggctttgtcctgaatagattcccttaggggacacccagggaattcctaggcccagtggaattaatgttctagaaagagaatcatgcttctgttgcagagcccccttcttaatcctcatgaatcctagttaataacacatataataaagtattcttattgatgcctgtaacttcctttgaaatgcacccaaaaggataaatgatatagacatatgctaaagcaagtatggtgaaatgctacgggtggaatctatgtggtaggtatatgggtgtccactgtaaaatgatttcaactcttctatatgtgaaaagattttcataacaaaatgttagggaaaaaatcctcctggaatacatttcatgtaagcctctaattcctcagcattagccacaagcagaactgtcttcaaaggagtaaatcatcaggaaaagtccgtgaccccaaaagagtgctgtccaggttttctcaggcatggctcaggttcaggcacaaatgcaagttcccagttcccatctcctcagtgtgtgcccgctgacctccctgcaacagttctgcccattgaccagtaggggataatycagatgarcaccttcgtgcttggaatatgagcacttagacttctagattttaaaaggatttctgagcccgatcyttacacacakgctttagtttgtactgtctttctgtacatcctcagttaagagatgctttctggagtgttttgtaratggatttgaagacttctcactgcttcagtacagaatgccctggcaatgcacgcctggaaggagtccatggactgatattttctagccaaagggagctaaaaatcagccattttgacatttggatttttcattgatgtgtcttgtttatttaaytcaatttaatrtgaaagagtagagagggtagaacaaactgttcagcaacgtatagatcattaggttttaaaaccaaataaaaagtactcagtgtaaaaatttgcctgactgaaaggattttgaaattattcttgaaagctctgaagcacgcagaggcagctttggatgtgatggatatttttgctgcatagagtatccagtgccaaagagatgattctgtcagaaaatattacgaagccaacctagctttgataattgcttcagattgtctacatatataatcctaaatctcttttcaaagtacttacactaccagtggtctttgatttataactgctggtccaagagatggcctactaataatataaaacagggtcttagcttcactgcgtatcgtttccagaggatgtgaatcttaagtcaatataagagatgtgtgagtaggaatgagaactcttagaaatcataggaaggggttcaagtcacagggaacagcagatgtagctggcctaaggcaaagggaacagtgcaggatcagaaagaagtccattccaatgaaaagagctgagaccaagggaaaccataatggggccagagcatgcaagaccattgcaagaagcatcaagggcttggagctttatccagaagacaggagcagccattgagagggcatgctccagcttttgttttagcagaatctctttgcatgtgatgtggaaaatgaattggagaggggaaccaggaaacctgttaggaggctacttctgtaatccatgaaatggcaatattctgcttttatgtccctgagaagaaagcataggtaaggaccactgaatacacatttggtagaaaaagaatattccccggctaaggattgggaagataaaacaatcaggaccacccacccattacttcattttcctttatgtatccgatcaagtaccctttctaaaagaaggtaaactttacagttttttttttaatttaagcatctcattagaacctactgaatatgagtctccatgtactaattgtagtaaaatctctctgaaggctggcatcagtatgtctgggcaggatgtatattctagcccagattttgcatagatgtcacaaggagtccagaatcycttgattttcagacatagccattagaagcacactgatcttcacaggtggaggcctccactgccatcagtctattactgctgcttaaattcacagcaccstggacaagaggagaaggtagcctagctgtttcattggcccccgcatctctctgccacaygatggacagccatatcagattgcattagaatgttgactgcatgttaactggtgatccttcttcctctcawtacttattttaaaatcactctaaacgccctgctcttattrctaattagattatttggccttggtgtatagtgtcttggggtcatcagtatgaaggtcaagtcacgcaaaaagagtggagtctccaatgtggatacacccaggaggtcactctctccccaggctgtgtccaagtagcataggggagcacagggctctgtccccatgatgtactgtccttttccatgacattggagatgaagctggacctcaactctgcacatgcatattcctacaacttctcagagtcctgtggataatgacggaggagagaaaccatgcaggaaacagccccctagagcacccaatctggatctaagtttgtcttacatgtttaagaaaaatttgctttaatttattttactgtattaattgattaatttttaaagaaatagtggagtccatcactaagacctcaggccataccttagatattgagatgttgaataaatcccaccagtttattttattgtaatgtgcctcatttttcctaaaaactaaaccccaaaatataaaagttttcgttgttacttatttatttattttagagacaaactctcactctgtcacccagcctggagtgcagtagtacagttgtagctcaccatagcctgaaactcctgggctcaagcgatcctcccacctcagcctcccaagtagctgggactacaggcacataccaccatgcccagctagttatttatattttgctaaatgaatttttgaaataaatttcacagatatttccccattttcagttgaaatttaattttctttctttctttctctttctttctccctctctttctttctttctttctttctttctttctttctttctttctttctttctttctttctttctttctttccttctttctttctgtgcttctttctttctttcgtattgctccttgtgtagcagggctatcccataggcagggtgcccagggtagtgaaagtttaattttcagagtttttaatgccagaatccgacttatgaattcactcagtagatattacatgtcactggcatatgaccttttaatagatattttattggcctaggaatggtaaggtcagagacttgagtggttccacttctaacagcaaaaagaaactatttctggctataataaaatttagcatcttaaaatttaaatagaatagttgtttatacttactcagggaactggagggttatatgggatatttaaataaattgtggaacacttggtcctgaaaactgcccattataatactttaaactaattaaatttcatttaaaagtttcaagcttcctgaacatcagggaaacgtgaaaatacagtcatgggttatagagactagcatcaggaaaaacagccagaaattctgaacttggatctcttcgcatgtccttgttctgcttaagaaattgcttaagagatgaccttgataacattttaaaaatttgagtgcgaagtgcaatgtattgcctttccatggattagagcacatgataactcttgagccagattataggaatccctatcataagattaggagaagtgagagaaaagaatcagaatcgaaagcctgrcccacaggtgactcccttgtctaaagaaaacgcttggtcttgctttcagcacatggcttcctgaaaacgaactttaccttaataagtarctgtttaaaactttacttattaatttgaattagtttgagtccttagggaaccctgcgagggtttagttgtcttgattacaraggcccacatccctcagaaagtaccctcatgtcgscagctggacaaccttaaggattgtcattgtggaatcacggcacaatccaatttcttatctcactgttatgagttgagtggtggtcaccaaaaagacatgtccttatcctgtttcctggaacctgtgaatgttcccttgtttggaaaagagatatttaaagatgttataaaggtaaggattttgcaatgaggagattatcttgggtcttccatgtgggccctaaatccaatgatgtgtgtattagtctgttctcatgctgccaataaagacatcccagagactgggtaatttataaagaaaaagaggtttaatggactcatagttccacatggctggggaggtctcacaatcatggcggaaggcaaaggaagagcaaaggcatgtcttacatgacgacaggcaaaagagcatgtgcaggggaactgtcctttataaaaccatcagatctcatgagacttattcactatcatgagaacagcacaggaaaaacccacctccatgattcarttacctcccactgggtccctcccattactcatggggattatgggatctacaattcaaaatgagatttgggtagagacacagccaaaccatatcgatgtatgtccttaaaagagtgaggcagggagagatttcacacagaaagaagaggaggaggaggcaatgtgtccacagaggcagagattggagtggtgcaggctcaggtcaaggaatggtgacagctactaggaagtgaatgaagcaaggaactgattcccccaaaggagtgtggccctgctgacatgttgatttcagatttctggcctccagaactgtgaaagaatacatttctattgttttaagccactcaatttttggtaagtcaatatagccgctgtaaaaaactaatacgctaacaacgaattctgtttcctccatttattcataccttccctaatgtctgcttttccaggtgaagtatctgaaaggtctttttcccttccatgctcttgcccatccttctggaatattctctgtggcagttatgcagacctttacaaccacatttcttgtgggttgtatgtgtgaaatcttcagagctcagaaaaaaaaaatctgatcaaaagcaacatttgaactactgaatttctttcttttcaagttcattcattcaatattatttgttgaataaatattcagcaaatatttattgagcatgtactatgtgccaggcattgttctgcatgctggagaagcctggggaagtgaggggaaagatgaacaaaaatccctgctcccattaagttttcataggcaagcaatacataaaataaagaggtaaagttatagcatgttggatgtagtaaaaagaaactacagagaattaagaaagaaagagggatagggaatagttttctggtttaataggatgattatggaagacttcaccgagaaggtgacctccagaaaggagatatatcagtcagagttcccccgagaaattgaaccaataggagatattcacccttacatatgtatgtgtatgtgtatgagatttattgcaagggaattggttcatgtgattatggaggctggcaagtccaaaatctgcagagcagatgtcccagtttgagttcaaaagccacaggctgctggtcagcacagtggctcacacctgtaatcccagcacttcaggaagccaaggcggccagatcacttgaagtcaggagttcaagactagcctggccaacatggtgaaaccccatctctattaaaaatacaaaaattagctgggtgtggtggtgcatgcctgtcatcccagctactcgggaggctgagacaggagaattgcttgaacctgggaggcagaggttgcagtgagccaagtccgcgccactgcactccagcctgggcgatagactctgcctcagaaaaaaaaaaaaaaaaaaaaaaaaaaaccacaggctgctgtagaataaaaaagaaccaatgtcttagttcagaggccatcaggcaggagaattctttcttactcaggggaatgttaacctttgttctattcagaccttcaactggttggatgaggccctcccacattagggagggtaatctgctttgctcaggctactgatttaaatgctaatctcatccaaaaacaccctcacagaaacattcagaataatgattgaccaaatatctgcgcactctgtgtcccagcaaattgacacataaaattaaccataacaggagaggagttgagtgagccataagggatctgtgggaagagtaaaatttctaggaagagtaaatttcaaaagctaagggcctggcttgttgaacaatgaggcagcaagtgcaagagggactgagagccacaagagatgagtagcagatgaattcggagtgcccttgaggtgaggctggtagcaggcttgatagaccatggacatggctttttgtctgcttttggttattttgttagacctatttcagggtctccaccrttgtcacattctttcctttttaagagtattttttttttctggttatacccatgaaaccttattttaagtccctaaccacaggctttagagatctatgctgtataaaaagtaattcatccaattctattatgacttatatatagcaatctactcatttatgaaacaaagaattccaggcatatcttgtkttactagcctgtcctgagtattgtggttcgaattcatttgtggactcttgagtagggctgtctgtctataatgacaatgcatatacatgtagaaccagcttatgagagtttatgttttataaactgcataatagatttaaaagtttctccatacatatttcatgattcccacctcagagggcacaggaaatggtccaaagcagacgactctaacttaaaatgactgacaaggcatctgggtcagtgagctttggctgcataacaaaccacttcaaaacttagtgacttgaaaacaaatcactgttgagacaataaccatgttactgctcacaagtctatgggtcagctgaacctttctgctgctttgccttgggcttcattgatcccagctggtcttaggcaggtatctgtgttcagctagcagatcaactgaagtctggctagttgaggatggtcttacctacctggctggcagctgactggctggcagttgggacagcaggagtgacggggccctgtgtctctcttcttctagcaggctaatcaaagcttgctcaaaagcaggagcatagacttcttaaggcctaggcccaaaactggcatattgtcactttgaccacattttactgtccaaagcaaaccccaataactgcccagattcaagtgggaaagaagtagactttaagtgttaataggaggagctgaaaaataactgtggccattttttcaatctatacataatatgctaattaattgtatgtgttaacttgactggtccacagggtgcccattcacttggtctgagtctgatggcctgagaatgaggagagctgatggggtattacacacacacacatacactattgattctgtctctctggagaaccaagactgatacagatttttgtcccaagagtggttctagaggaagagaatttttaggatgagtttcctgaattggttctgaggtttctggcattggttctctcatctgattaggtttaacgatgctaataactctgtttccattaataaagagggcactgatagatagtccgtggtgtactctgtcaatagagatatataaatattaccattggatactcctaatcaaccacttataagaagcaaagattttggtgactgtgtatatgatgcttttgaacatgattggcaaagtaacaaatgtaaagagattggcttctattgtcatcgaacaaagaatgagctcagggtttgaattcccaggtcaaatgctgcatacatgatctcaaagctgctatgtctgccctcgaggagacctttatctcctatagccttaggactaagatcactgaaaatcaaatgcaggatctcatcctgtgactggctgaaccaacacaatttgaaccctcagcctcacaaggtgtctactgttaaagtcagtgtattaactaggaaggaatgygttgctcaaagttggaatggagatcagcttcagccccgatgaagctgaggacattgagcccctaaattatgatgagggttctttgccagcagaagagccctctccagcctcttctaaggggattaatcctgcatcaccagaggaaactctaagggcctccctcaaggcagttgccatgcaagatgatgctgattctattcaggacccctctttgtttctagacctgtaactacattcaagtccaaagaggcccctaaaggtgacgtacaaagtgcaactcatgaggatttatgctatactccaaataagtattaagtatttaaattttctaatttataatagaaaagtttggaaaaytgtgagggaatgcatattaagaacataggataatggtaggagaaacacaaattagatcaaaatgaatttattgatatggataaaggaagcagacagcatgcatttaattttgcagctcaggcatttggaaagtgctgtaatagtttgtttagtcagttggctgaaacatgggccagaaggtcacccacagtgagcaagttggaaatgctgaacttcccttggtttaatgtagagggagggattaaatgacttagagacattgggatgttagagtgggtttgtcattcaagaatgactcactcayattgggagrgtcctggagacatacctttcaccataactgtgggaagtaagtttgtgagggagtcccagcatccttgaagagctctgtgacactctactctgtaggccagaacttacaatggaaactgcagtcactgaattgagaaatctaaatgtaatgggaataattggatcccagggtggcaggggccaagtggcagcactcgaccgtcaaaggcaatgtggccgtgattaccatgatgaacagtggagtcaggcagcaaccaaaattctctaactcacagagaaccatggcactggccagttgatcatggtgttcctggaaagtaaaagagataggctggtgactaaattcttttttgctctctgtaagctgaaaatttctatgtcaaataaaaaaaaaaaaaagtattacctgaatcatgaaagcatagagtcactatccttcaaggaattcccatacttgagccagtttatagacccaaaaccctttcaatgaaggggaggctgagtctctttgaggaaagactcctgtatattactgaaaatttatactgttcatctttctcccatccttctccaaatggacctatggtgttttaccaggtgactatgcattggagaaaaggaaataatcagacctgttggagactactgaccactggctctgaactgacacttattccagaaggcccagtatttcactgtggtccaccaggcagagtagggctaatggaggtcaggtgatcaacagagttttaattcaggtccatctcacagtgaagttcatgagtctctaaacttatcccgtggttattttcctagtctgaaatgtatacttggaatagataaattccctgacagaactgctatattggttcttgtgacctgtggagtgagggctattacagagggaaaggccaagtgggagccactagaactgtttcaacctaggaaattcgtaaacgaaaagcagtaccacattcctgaaggatggcagagattagtgctaccatcaagaatttcaaagtcgcagggctggtgagtctcactatactcccattcaacttacttgacatgtgcagaaaactggatgatggagagtaacatggaaagtttaaccaggtggtgactccaattgcagctgttgtaccagatgtggtttcattacttgagctattccctggtacttggtatgcagttattgatctggcaaatgcctttatttccatccttgtcaataaggctcgtgagaagcagtttgctttcagctgtcaaggccagcaatacacctacaccgtcctacataaggggcatatcaactctccagccctatgttataatttagttcacagggatcttaattggctttcatcactagtccattacatagatgacattatgctgattggacctagtgagcaagaagtagcaactactctagttttattggcaagacatttgcatgtcagagggtaggagatatatctgacaaagtttagggaccttctacctcagtgaaattcctaggagtccagtggcgtgggacatgttgagatattcttctgaagtgaaggataagatattgcatcttgcccctcctaaatcaaaaaagacggacaatgcctagtgagcttctttcaatttttggaggcaatatattgctcatttgggtgtgttactcccactcatttatttagtgacccaagaagctgctagttttgagtggawcccagaacaagagaaggttttataacaggtccaggctgctatgcaagcagctctgtcacttgggccatatgattcagcagatccagtggtgtctagatttaatattatgtgtcatgtcccaataaagcttggaagtagatcttaacaccattgccatcacccacccacacacatccctacaagtgaagaaacggaaacctcaaagcaggtaagtgactggtcasaaaaatcacaggtaataaagccaggaatcaaacattatcgcagcatgctagaaagcctatctgcttttgatttctcagtcacattattttttagtaattcttaaaaaaaaaaaaaaaaagccttggccaggtgcggtggctcacgccagcactttgggaggccgaggcaggtggatcacctcaggtcaggagtttgagaccaggctggccaacatggcaaarcccggtctctactaaaaatacaaaaattatctgggcgtggtggcacrtgcctgtagtcctagctatttgggaggctgaggcaggagaatcgcttgaacccaagagatggaggttgcagtgagccaagatcgcgccactgcactccaacctgggtgacagagagaaactcnnnnnnnnnnnnnnnnnnnngtttgcattcacgtcacagagtgaacattccctttcatagagcaggtttgaaacactctttttgtagtatctggatgtggacatttggagcgctttcaggcctatggtgaaaaaggaaatatcttcccctgaaaactagacagaagcattctcagaaacttatttgtgatgtgcgccctcaactaacagtgttgaagcttggaagtagatcttaacaccattgccatcacccacccacacacatccctacaagtgaagaaacggaaacctcaaagcaggtaagtgactggtcasaaaaatcacaggtaataaagccaggaatcaaacattatcgcagcatgctagaaagcctatctgcttttgatttctcagtcacattattttttagtaattcttaaaaaaaaaaaaaaaaaacgccttggccaggtgcggtggctcacgccagcactttgggaggccgaggtaggtggatcacctcaggtcaggagtttgagaccaggctggccaacatggcaaarcccggtctctactaaaaatacaaaaattatctgggcgtggtggcacrtgcctgtagtcctagctatttgggaggctgaggcaggagaatcgcttgaacccaagagatggaggttgcagtgagccaagatcgcgccactgcactccaacctgggtgacagagagaaactctgtctcagaaaaaaaaaaaaaagcttgtgtggtggactctaacctaatcagggctgatttatatgttgtttttttytcacatattttcctcaatgttctgttcatatcacatagaatcactgagaattcttctctgacattcacagggcccctaagtactgcttcacagactgaactgaagcaatattaatgggtctcytcctagataagcccaagcctcaagcatagccctgcgcctcagtcagccaatctagaaatagggcaagcttctaaagatgaaagggcacagtctctgcttttagtaatctcactagggcaatatagccaagtggaatgaagagatgagacaagggctagactgtgtgacatgggccataggttgacagaagctccaaaaatagagtgagtgctctgaggaagctacacagtagcaagaacatggtgagctgggtggaaaacaatgagttaggtcttgcaggatgcctggcaaaggtgggacgtctgtagagggactggcttgagcaaatggtctcagaacaagctgtggattccctcttttaaagttccagactttcataacttcactttggcctgcatgctttccttttggaggcaatatcttcataaatgccataagaggaaattcaacacagaaccctccactgatttcattttctatttgaatttggcagagacccctttaagaccgaatctcatcaagaaaaatataatctgagctacatattgtactaaatcacttcccccctttttaaatttgaaatcagcttttcttttatatatatttattttgagatggagttttgctcttgtcacccagctggagtgcagtggtgcgatctcagcacactgcaacctctgcctcctgggttcaagtgattctcctgcctcagcctccggagtagctgggattacaggtgcctgccaccacacccaaccaaaatacaaaaatacaaaaaaaatttttgtatttttagtagagatggtgttttaccatgttggccaagctggtctcgaactcctgacctcaggtgatctgcccatcttggcctcccaaagtgctgggattatagctgtgagccactgcacccagccatcagcttttatttcatatgcatgcatagcatcctacaacaataactttaaaaaaaataagwcatcaccattttctatgattgcaacctatatagagaaatagcctggtgttatcctacaagacaatttccttaaaatgtgtgagtaatggctattaaatcattttatggagccatttctaaaayaatactctttgtcactgttaccataattacttttagttgtggccatattttaaagaacagaatgctttatcgtgactgttataaatacaaattatttttccccttgtgggaatcatcaggctaatttgtttaccattttccttctaaaacagatcattattaaaaggaaatcagtacaatgattgtgattaagatcaacagctctcttaattctttgttctgttgaatatcaagttttttctgccttcctacctctgtctttccgtaagacaaatccttttgctggcaaggggtatatgtgtgcatgcaactcctgacttatatctccactcttacacttgtgctaattgatcttaaaattaaagtccaggatgccaatgaaggaaataagctctgaaccacgcaggtcacagtttctgttggttgtatttgtgtcagggagctgtcagactctgcagtttsaaatttaagttctcaatggactctgagcgcatatccttgatgtgtgattcacacctgtggtatcatcatggggtcattttattgaaatgttgaacttgtttgcaggggccttaattctttagctttctgcaaaacctagttatgtgatgtgttctctgtttggggataatagagagtaaatggaaataagacattaacattgcccaacccctattatagttggtgttaataatctttgcctataggtttggaagtaccttggcttatataaccactattcagataaaacaargaaatgatgacatcagtgtaagattgaatgagatttgaccactgcacatgccatgctttgcaatagtctaaaaacctggacagaatgatcagaaccatctaactcaagcccagggataagcaaacaatcagtaaaaaatgcttacatagaaagcgcatgatattttaatatgaatttttaatatttaattaattttagtggctattgyctaccttttatcaaataaacagctatttattattagaacttcttgctaatgattactgattttgactgtttgtaagtctagccttacaatttattcagaagtgtggttttaaacacataaagtgcttcatggyaatgcaaaatcttctactgaagtgttttgtattatttcgatttgaacttaagagattatgtggattctgtacrtaataggttttattcatagacttgatagtgtagcaggacgagccgcagacaagaacccctcagacaccgagttgtagaaggaaagggctttattcagctgggagcatcggcagacttatgtctccaaaaactgagctcccggagtgagcaattcctgtcccttttaagggcctacagctctaagggggtatgagtgaaagggtcatgattgattgagcaagcaggcggtgcgtgactgggggctgcatgcaccggtaatcagaacagaacaggacgggattttcacgatacttttccatacaatgtctgaaatctatagataacacaagcagttagctcaggggttgatttttaactaccaggcccagggcgyggtgctgggctatctgcctgtggattccrtttctgccttttagtttttacttcttctttctttggaggcagaaattgggtataagacaatatgatgggtggttgcctcccttaatagttaaatgatttggcaataacaacaggccgaaatataaaagagaaaaatttaggttggtgcaaaagtaattgcagtctttgcaattgagagtaatggctaaaaccacaattagttttgtaccaaaatatgtatttggatatatattctttaattgatgttaacttacacattaagtttttaaaatattagaaaacctacaaaatctgggttgaaaatgagtatttgaacttgaagcatggcaacctttcacccattttgttttaccaaattgtaaataaatcataacctggtaccatcacctagacagaaattttgtggaatatctacactataaataatggaacccctgtaaagtagtaactatttcaaagttaggatctcctggctttggcaaattttatttttgtgaaaattaaagttgggcattggcaacccaataccttttagtgttccactagaacaaaattaaatattaggccagtaatttgaygcagtkgtatccaaacttttccatttcatgccctaaaaattagacactcacaacccccatcataggcatattcacttatttgtgtgttcatttttacgttgtaggtattactagactaacacatgtgttcatcataaatgawtgtataatatatatattttaaatgataaaatataaataatgagaaagaataaagatgaaaatratgttttattttgtttgttaatgattcaaaacaaatctttgccctccatatagagagtccatgtgtttgaatagactttattattttcaaaactcctcacttaacactttgatacaggaatccaaaactctgatcttaagtttggattttcttttccatatttggttttaatggctgtcactgctggggaaaaaaaagattcctcacacagatttgaagattaaaatggaaggtgtgcatcctttgccgaggctactgcttcattacactccttttattcattcccatctaccagttgtaaaggtttgactttctgatggatgcttaatttttaagtgcctgctaattacaatggcttgccactttcattaacatgccatacacttaaggcaaaactcactgttagctgtgagaaagtaaatacatatttcaaacagtcttcttcataaaattactttttaaatggattctcctgcaatatctgattgttttcacctcagaatgtaggaaaggagaaaacgtcagctctcaactctgccgttgtccttttgtttgccgttggcacaattgctaatgtggttcatctcaatgtctttgcagggtttagtccatttggtgagggtttgtttggttaaaatagataaggtagcctgtaaatccattgaatctgagcatgtgtacactgaatgtgttgaaacaagctgaaaagtcatcgtataagcaagggcaccactgtccaagcccttgaacgtgtgggacaggccaggttccatggctaatgcctgtaatcctaatgctttgggaggctgagccaggaggatcactttagtccaggagttcaaggcattgagctatgattaggccactgcactcctgcctgggtaacaaagtgagacctggtatcaaaaaaaaggacgggggaggggaaaggtgtggtgccctcttctttcctcaggtctcaagccctgtaagtcactaacaaccttttaacaaactaatgtggtgccagtgtcaataggtatgagtaaagctaatttcccttacaagtgaaattctagtacacttttcccataatccaatagatcatctttccttttatcctctgaacatatgcatgcatcttaaaagactacggatttaaagtactagattaggccaggcacggtggcacacacctgtaatcccarcactttgggaggccgaggcgggcggatcacgagatcaggagattgagaccatcctggctaacayrgtgaaaccccatctctactgaaaaaaaatacaaaaaattagccgggtgaggtggtgggcgcctgtagtcccagctactcgggaggctgaggcaggagaatggtgtgaacccgggatggggagcttgcagtgagccgagatcacgccactgcactccaacctgggcaatagagcragactctgtctcaaaaaaataaataaataaaataaaataawgtaytagattaygtttttcttcccaattaaacagatcatgagttcttttggtgactagggtgttgtggcattttggaggcaggaaagatacaggaagttcccatgctataagccttgtctctttgaacatryctaagcatattagatctgttaatttttgcttcatatagtttgaaggtataattattgggtgtatacatttttagtattgtttctcaaatacattgatctctttattatgaaatgttctttctgtattttcttgccttaaagtaatgctgttcgatacagtagccattagccatgtgcttatttaaatttaaattaattaaagaaaaatataaaaattcagccccgcctttgtgctagtcacatttcagatgctcaatagggctattggttaccctatgggatagcacagagaacatttccatcattacagaaagttctattgggtcgggctgccttaaggctacttcatctaatattaaaacaactatatcaagggtttttttggttgacaattatatggagaattaaataaatcctgaatcacagatgaagattttagcatatccctctctgttactaacaaaataagcaggaaggaaaaaaaaagaaaatcactaagcacacagaggatttgtttaacacaattaaccaacataatataattcacatatttaatgcattacattcaacagttatataatacaatacgcattaagtacgcaatgcggacacattggaagatacacctggctgccaagtgtcctgtagggaggtgttgattgtagagacacacagcaggggctatataattccataatcaggaaacccagcaaaactggtatcacacgaaggaattgcaactattgtattagtccattctcacacatctataaagaactacctgagagtgcgtaattaataaagaaaagaggtttaattggctctgcagcctgtacaagtagcatggctggggaagcctacaatcatggcagaaggtgaaggggaagcaggcacttcttacatggctggagcaggaagaagagaataaagggggaggtgccacatacttttaaacaaccagatctcatgagaagtcactcactattatgagaacagcaagggagaaatctgcccgcatgataaaatcacctcccagcaggcccctcctccaacactggggattacwattcaacatgagatttgagggaggacacaaatccaaaccatatcacctatggtttgggttttggtagcacaacactggtacaacctactactcagggatcctcaaactttaatatgcatgctaatcaacttgaggttctattaaaatgcagattttaatagagtargtctaggtgcactttgtaacaagtacactttgttactgactttaaaacgagctcccaggtcatgctaatgttactggtccgtggaccacactttgagtaggaagattctaactcaaaagcccaaactagtagcttaaacaccaaatcatgacagaagctgtttcccctggcttgtatcatattgattaacacagtaaagaattagctgctgacatgtacaaagtgtgaagtttcacataagcataagcacctgaagcgtctcttgaagtctgggaagatccggccagggcaagtctgcttccatacatggtccatacaaaagtccactggagcagagtagaggccactagctttcgagagcccatgatttatccttcaccataagtcccacctccactacactgacaccttgccaaccatccatctcacttctttatttgcctttctaaccttctgagacaaggactctcaacctaagctaaatattggaatcagaggagctttgagaaatactgatgttttggtctcagccccaaagatcttgatatggtcatttcaaggggtgggaaaagcctgggcattttaaaagctacccaagtgattctaatatgaagccaaggttgaagacttctgtttaaatcaatttagtgacactagcaagattctcacacaccatcctcagacattctgattctgaagctcaggatcaccacttcctaatatttgcaggatctgagacaaaagaaagctctcaatctatagcctttcaccttgtctttctacttcccacccactcctatactttcttgcaccatgaaggatcttctgtatatagaattagacacacatccaagatctgtccttactccctttcaaacacccagcccttggtcactcttgaacttagacctttgcaaaatgactgcaaggtctgccattagaggaagaggaagagggcctaaaaaggggtcttggggccagttgggaagggaattttggtatcttgttgaagtgttttctgacaccaatctcttctccaacatcggctgaatgtcgaaccattcaattcaattttgatgcacctggatttagggcagaccccacagcttaagtcccacaagactgcccccacttcaggtgccagttgcaagacttggaccacccatacttctgaccaaccagctgtaagtcagaggttcccacaacactgtcctcagcttcaataatttactagaacagctcacagaactcagaaaatccactttacttacatttagatttacagtttatcaagaaggatacagatcaacagccagatgragaggtatataggktatcrtagtctgctytgtgctgctataacaaaatgcctgagactggcaatttatacgaacagaaatctattttctcacagttctggaggtttgaaagtccaaaatcaaggcgccagcaggttcggttgtctggtaagggctgcatcttccagaggggaggaacgccatgtcctcacatgatggaagacagaagagcaagagagaccaatgctatcaaaagcctttctaaggaccttaatcacactcatgaaaaagggccctcttgacttaatcacctcttgtttgccccacctgttaataccatcacattggccattaagtttcaacactttaactctagagggaacacattcaaatcatagcacaggacaaggtctggaagagtcccaagaacatgagcttatgatcctacggagttagggtgtgctgccctcctagttcatggatgtattcaccaacctggaagctttacatcattatttaagagtttttataactcaatctttagctctcccaccaggttagtgagggaggctgaaagttccaaccctccagtcasttgatctgtctggtgatcacccctatcctgaggctctccaggggccctattctaaatctacttattaacataaattcagatatgattgaaaggggtttacacaaggcctccttatcactgtgaaaaacccaagcgtcttaggaggtctatgccagaaacctgggacaaagactaaatatatttcttatatcacatctgggtaccccagcattagggaggccatgtctccatgtgcaggagtcatagtcttgtgtactaagctactcacctcatgaggagtgtgtggatgaaggagggctggggggccatgagggcccaagggatgggcctgtcttgcccacatctggaagtccgggatgaggactgagactctctttgtagcaggttccccccagtgattctgatgtcagttgtccacagggtgcacttagaaagacaaactctgcagaaggatcagagctaaagaagaatagcttcccctcttttctctctgctgcctaacatttcttagtactagtcagagcttgggagccacacttggaatttcaaaagaggaatttttcatgcttttctaaatggattgcattttgggggcttggaagccaaacacttagaatctgtaaacagtttgtcctgggagagaatggctgcaggctttcagaacaagagagggaaatttaggctgactgcaccctctgcttctcaaagctctttctgctaaaatgctatagttatatgtggtcgtagaaataaaagagaagccaaacactcaagtgggcactgcttcccattttttgamtaatgagagattattcaaaatcttgatattgagttcttactacctacccaagcactgagctgtcttctrtaatcatccacaatatctatgatgtcagctccatcattatcattttatgtaaggaaactgagatgcagactggccactggctcaagctcatacaactattcactgacagagttaagaaccaagcagggccgggtgcggtggctcacacctgtaatcccagcactttgggaggccgaggcaggcagatcacctgaggtcaggagttcgagactagcctggccaacatggcaaaaccccatctctactaaaaacacaaaaattagtagggcatgatggtgtgcgcctgtagtcccagctatgtgggaggctgaggctggagaatcgcttgaatctaggaggtggaggttgcgttgagccgagatcatgccactgcactccagcctgggtgacagaacaagactccatctcaataaaataaaattaaattaaaaattaaaagaaaatataaaaaaaagaaccaagcagggctgagcgcgatggctcatgcctgtaatcccagcactttgggaggccaaggtgggcggatcacgaggtcaagagatcgagaccatcctggccaacatggtgaaacctcatatctactaaaaatacaaaaattagctgggcatgctggtgcaggcctgtagtcccagctacttgggaggctgaggcaggagaattgcttgaacccaggaggsggaggttgcagtgagccgagatcacgccactgcactccagcctggcgacagagcaagactccgtctaaaaataaaaaaaagaacgaagcagcccggccctagaactcatgtgctctaaaccactactctaaaccagctctttaaaacacgtaagtgtaaatgtgcacagatttcaatttagagctrtgtgactcccagcagatttcttttttcttgagcaaaggagatgccactgtgaatattaatgtctgtcatagccagagcagacactcttcagcttttgggcaaactaaaatgctcaaaaatacccacaggcacaacattttctaatcgtgcttccagagccaggcagtgtgttcatgcatgtaagacgctgtataaatgtaggtagtagcaccaatagtgctcatgaattatggatgaagaggaacatccagagtcaaacattcctgagaaagcagaccaggctccctttactgggttaggaaaagataaaaggctaaacttcccaaggcagttgactggtgatttttcattctaacatcygaaaaaataggaataaagttgctatggtttgaatatatgtgtcccttcaaaattcatgctgaaatttaatccctagtaaaacagtattaagtgaggactttacgaggtttaggtcatgagggccttacctccatgaatggggatagtgcccttataaaagggcttgagggagcctgctttgctctttttgcccttctgccatgtgaggacacagcaaaaaggtatcatcttggatgcaggagatgagccctcaccagacrccaaatcttctggtgccatggtcttggaattcccagcctccagaactgtgagaaataaatttctattaattataaattacctggtctaagatattatgttatarcagcaggaatgaaccgagacagcagcctatttcagaagcctgtctctgatgctcctattccaaccaaaatctttaagccagagatcgcaaccagtaacctggctgaataatccacaaacatggtttattgtactcacacattgttataatgtttttttcttagtgttctttcatcttcttgttgaacaggatgccaactttaaaaataaggagatatcctttaaaaatgtttccttgctttawttgaaatattcaaagacctggctcactggggccatgttccaatggacttggcagcaattagctggatctgaggagtggaatccccgattagatgaccttgtgtgctccctttagccacagtcaccatcactgtttgttaccttatactcacataccaccactgactaccaccagtgcttttcactctttttctttacctctcttcctcctaaagtcatttgcatttaataactgctaatttcctgttattcaaggtccctagcaatttatgatatatgtgtttgcttatataaacttgcttcaacaggccacagtagcctaggaggtagtcattgcttgaagatttatactgggctgcaaaataaccctgagtgtctactcaactttcagttcgaagtgccttatcctgtatggtagtgggttacyttttgcatgccaaytccatcatatggtagcagatgcctgggactttttgttgataaggattccaaggctatctagatggcctggaagtaccactaagattgattagtgatgtctgccatagtcaccccagctgctgctatccatcagaagtcatcagccctgtgcttccatctccatttctttttttggttttttttttttcatttttttcattttttttcattctgagtgtcatcatttaggagactcacacaaaagtaagagaatctttctagggaaatgttctcttttctttgcttgaactgaagttgcaatttagaggcagttacccttaaccctggcatctttttcccccagtacaagtgttcatagaagcaccacatgtaacaggcaaaagctggaaacaacctaaatgtccatcaacagtggcatgggtaaatgaagtgtggtgtattcacatactttatagcaatttttaaaaacccgactacagctatctacaacaacaaaaaaagaagccagatgcaaagaactatagactgtatgactgtttatataaagttgcaaaataggctgctgtctcagttcattcctgytgccaggttttatctctgcctcctaattattctgtcatttcagccacatctggggttactaagtgtcatttctaaattgtacctactgacattagcgaatatctttttgctggtctcccaaaagaaagatccatcatttttctaactcctaattgaagaacctaagaaaattgctgtgttacaaagtgttccttttcatcaaccacaaaacaatcctccaggacagagttgagcaaaaccaattctgtccaatccagtctgagtctaatgacagaaactactctgagttaccttattcctgatattccaggactgacatcagggcctctgtcccaagaagtggaggaaggcagaactcccactarccatatcccagcctccttaagatgggcctgtggtcctgggaaatctgctcttctaacctttccttygtccacagaagccacatcagtagagggtcagttacagacaaggggcacacagtgaataaggaggcactcacttcttggattaattggcttagtgtgagaaggctcacttttacatcctaagattggaaagtgccagaggcccccacaaatctccaaaagcatagtttgctctccaattttctcaactctttcccggtttgtaatgtttattgttttcttataatatttaccaaccatcttacctcaccaatgctagatcctacaggtaacagaagcacagtataccagaatgatcacatccaatagcccctggctggctccaggtgtcatgaagtracctctgattttgttactgcccctgagtggtggccagaagttacattatgtcagtttacagtgtggcagcccccatatccattggggacatgagtgtcaggcaggtcaggtgagtgtcaccacctggaaagtggaagcatctctaaaaacaacttccacagaatgcatgaatttacagatgatatgaaaacatgtgcatattgaattttctgaaaartggcttatcacaaaatttaaaaaaagtatttatcaaaggaactttgggcacataaggaaataaatccaatagtatgctcatgacaattagttatataaataaaataaagtaggttattagtccatataagatagcctcaggaaaaaattaaatrcccagataaaaagtatgcagcttgacaaatttttacagaatttatgaaattaccacttgtgtcaagatacagaacattatcaacaccccagaaacttccctcgtgctccaacccagtcagtactacctccatccggaagtaacagctattctgatgtcagtcaacacagagattagtttttctgttttgcaactttatataaacagtcatacagtctatagttctttgcatctggcttctttttttgttgttgtagatagctgtagtcgggtttttaaaaattgctataaagtatgtgaatacaccacacttcatttacccatkccactgttgatggacatttaggttgtttccagcttttgcctrttacrtgtggtgcttctatgaacacttgtactgggggaaaaaaaatgccagggttaagggtaactgcctctaaattgcaacttcagttcaagcaargaaaagagaacatttccctagaaagattctcttacttttgtgtgagtctcctaaatgatgacactcagaataagacgctttcttctccttccacagtcccctgtgctgaggcattttatgtgattgtgtgtgtaagcttcaaagcgttattcaacaaagaagcgctgttctcccaagctctaaccatttactcgtaatgggcatatggtatttcgagtgctgtactttactatttcaccactagagggcaagaggagccccacaatgcttgacattgccagatctgcagtcaaaatgattaatcatgaggcaaaaacaagaagccagagggaaaaaaggaagagctcacaaaggcaaaataaacatccataaacttaaacttycctgggtagggaagatctgaaaaatgtcacccatgagccactttctaacactcgttccatctttctttttccagtgtgcaaaactcaattgcacagtcctcagttgctgaaactaccacccaacagggtgggactagatcaggcagacagatctcagagggcatttttttttagcactgcctagagccttggttattaggaagccgagaatcttgcagagstcccaggcctcaggggctctgaacaagcaacagagagttctgtgatttcttcttcattctaagtaatatttcttccaataacaccatggtgtttactaaaatcaaggcactaatgagtaaggctaccagccccaacacctctcctttttctcctcttctcccgggtccaggcccttctacctgccacaaacttaatcaagattacagaatggagatgtgttgttttttgcaaggggaggggagtagggaaattaattacgaagccaagttgctgttaaactatttataataaatttctactggaaaaggacctttggctgacaatcgttttcttctgcctcggcatgaccaaatacagtaagaattcaaaaggaaaactgaaaagcgaggaagagcccacagctggagcagtctgttttcacgtctccacgctggcgaacgacaaactcggcaaggagcctcctgtgtatttcctgtcctcgttatctcagttcttgctctgaagggctaagaagccttcaccgttagccaagactccttcgtgcttcagcttaattttccttgcataattttaaatacagatcatgtctacagtacagcaattaatggatagcctaaagacttattatttcaaactaattgatatgtaggaaaagtttaaataacataacggagaggggaaattttaaacgatgtatgcacaatgaatttaaaatttctctctgttgcagatggtagcaaaaacatatgattaatagggggatgtgatcaaaatgtagaactgacttggaaatctttctctttttgwtattcttgagcatatgattggaaggaagaaagattcagacatttcagaaatggggtaaggggtgcaggggagagcagattcttccccccccactcactcccaccaattctagggagttatctcacaagataaaagaacacctgagtatattttgagttgtgctgttaggtcagaaataagaaatgggagaagaatgccattatttccattctaactctttggtcaaatccccctcttgagataaacttgagagagaagtctacaaagaccaagttcacccagctgcagcagaacctgttccaagtcaccagcactcccagacccaggattccctccaaattctaagaaatgtgctgtgatgaatcacctcactgacacacaaaaaaacaaaaatctttctaatttccccattcacattccagcaagtttaataggaaagtttagaaaactcatctgaagaaagaatactcttcaaatgggagagagcaggaacattttgttctaagaagggattgagacctaatgatgccagacaacattttaaatatcagaacacagcatttgtaagaaaatagaatctgcttcaaccataaaccataaggggggaaaactacctttaaaatgtattttcttcatatcaaattcatgtcataagaatatctgaatgacttctggccaagtcacttaaattttgtggtcttcagtctttttggtcttctcagatgtaaaatttgccacagactggttattttttagaaccctttcttcccttctgttctcctactttatttaggtagctctacacacacattttgaaaattggatgaacaacctccttctcattggtccatgcaagaccatattactgtatttataatataatacacacccatatacaccacaaaaactacaatactggtttctccccctctggtaccctggcctttcattctccaccctctgcccttcaaggtaacaatgaatctgaaacgtgtgcatgtatatattcctgttttttatatttacatggttatagatatacatgtgcatatatatcatgcatatgtattcctataacactttatttttttatcttagttgttttaacttcataaaaatggtatcatatggagtatcatattgaaatatgataatgtaagttaaaggaccatactgaacctatactgtataaaatttgggggagcctacaatttttcacttaaaaatatgttgcttactttgggaggctgaggctggtgaatcacttgaggccaggagttcgagaccagcctggccaacatgataaaaccctgtctatactaaaaatacaaaaattagctgggcgtgggggcacacgcctgtagttcccagctactggggaggctgaggcatgagaattgcttcagccagggaggtggagtttacagtgagccgagatcacaccactgcactccagcctgggcaacagagcaagactgtgtctcaaaaaaataaataaataaaaagagccagacacaaaaaagtatatacattattattcagtgtatatgaagagttagaaaatatgctatcttgggtaggggacaggatggctagtgattggaaggtggcaggtagaggtcttatgaagtgctggtattgatctgagtgctggttaaatgggtgtgttcactttgtggaagaaaatcctaagtccatgaatttgttgtatcagttagctattgctgtataacaaattccaccacaaaactcaggggcctaaaacaataagcatttattattatccacaagctggtgagctgggaagttctcctggtcttagttgttctcacttatgtgtctggagtcaactgagcatgaggtggacagctctgctggtgatactggttggacccgctttcatgtttgagggtcacttggatgtaggttggtctaatatggcctctgctagaacgaccggatctctccacttagtctctaatctgtgaacagacacgcccaggcttgttcacttgctggtggcagggtttcaatagcaagagtagaggcacatgtggccctttgagaacaactcagcactgcaacagtatcacttttgtcatatcctattgacaaaacaagtcacaaaakaggagtgaagaatggtgggtttttgaaaactcaatctaccacacttctcttatgtgaacttctctctgtgtactaatgaaaaaaatttaaataaagtatatctaagtataaggtatctatattgttaaatgttgctatagtttattttgacttattctattccatgaatgtatcgcacttatccattctactgtcagtttgcatttagtgatgtccagttgattgctgttttaagcagatctgctgtgaacatgccatctcatatctcctagtatgcaaactctgtaccagaagttttcttggttgtataycaaactgtggaattactgggccatagggaatatgaatcttccattttacatgatgatgctaaattgtcttctgaagtaactataccactttacactttcttcagcaatatatgaaagactgtrttaccctgacacttgccaatagttgatattaaygtcagacttcctaatatttcctactaagatgagtatgaaatgatatctcaatgtggtctagatctgcctttttctgatcagtgaagaaactgaccatcccttctatttagtttgtttttgttttgcctttagccacatgttccttcttaagcaaaatgcctctttgtatcttttggtaatttttttcaattgagtgattggtcttctcattacttcataacaattctttatatattctcaatactattcttttgtcagatgtgtttgttgtgaaaatatttgcccagtttatcacttgcttctcaccttattgagggtgtcatttgaataagtttcataattttaagtatttgaattaaatttttatttaatttttattgttagctttacttgaggcctatttagccaatccttaactacccyaggatctgaaatagattaaaggtttagcagtcaaaacataaactaaatactgtttcatttgcactcacacacacacaccacggcctgctcttgttacaagcagttttggtaatgyggctcctgtgttcattatgaaatatttaggtatggacttgtcctcagtmatagcatctaaatatcacaaactcaggaaatctaaattgttctgacaagttacaagaataatttcaaagaacattttcttttggcagtagaccctgatgttgtgtagtaatggaaatgtttaaattccaatgataggacagggatggccctggctagaataacacaaaaatcattcaaatctaaatggcataaggctgcagcagtccaagtgagatccctcggggagtcttggaccttttccaagatgtaggctctcttcagtgtgagtgtgcagagattgtatgattccactggggtcacttccactgatgggttcaatggactacagcactgaccttcacatggcttgttttcatagcttcgagtcctaaagggagatagggtcataggaatatttcaacagtgtaaacagctcacaagtcttccttgctcacttacttagaggtgaccagatgaactgaacataccctaatgctaggctcttaaaataggatcttgttttaaaaaggggttcagtagacaaagaaggccattccctttttcccaactcttgttctyagggtagtgttctcaaactctggcaatttgagtgtgcaaaaaaaaaaaaaaaaaaaattagagtagtggaagtgggacaratagttcctctttagcctcctgacatacctcttgtttggagggataagataatctctcagattgccacctgggcaaggaaactgggcaacacacttccaactcagaagccctgaggttggtggcctgctacctctttgctggtccctcttcctcaaggtttccgctttggaagtagggactgattcttaattggttcatctacttctaaggccagcacttaggaagagttagcttgttcttgattggctcaagaactttaattaataaagaagcaccgaatccagaatatttataaataacatctgctcacaaatagaacattgttccaaatagttcagtctaaacactttcagcttcaaatccacattaagaaaatcataacaattacctttaaactcatgtttccaaaaatgtgatgtgtatgtggattacctgtggatcttgttaatatgcaaattctcattcagtagatctggagtgggcctgaagtgatactactggtcctaggaccacactttgagtagcaaggctttctaaagktctgctctcccgcacagctgaattgaataacttttccttctagagatggcatcatggttagcttttgaaaaccttttggttttttttttaacttcagtcttctagtaattcaagaaagctggctattttttcaatctttctggatgttttaaggatctccttctaattctgaaatgttgctcaggtatttcttgttgaagtcttttccacagggtagactctagcttggggtctattggagcaagttaaatgtcttcaaaggtgatgggttattcaactgaataaatgttttctagaatgtggtgaaacctggaaaatacagtgggagtaggagagggaagaaaaaaaaaagacataatatacttttctccactctacctaccatgataatacatattaatcttgcctttattctttctttattgtatataaaagcttccactaactttccattctagggagtcattgagagaatataaatatgtgggctttttgttaaagcctgataggagaagagattattatawgtaattggagactgtggagtcagaataactgmgtttgaattctgacttcatcatttaccagctgtgttgcttaaccataaaatgctcayaatatttactccagcgaataatgggagaattcacagaggtaatccttgcagataatccctgctaatcatttaacctagtgccaggatatagtaaatgctcaataaatatttatagtagtagtcattgttatttgataactattacagaatagctcccaagggcctactgaagaaaagctttgtgcttaagacactggcaataagttcatttccatrtggtgtaacttgaagctttggttttatagrttaactcagagacaagtcctaccacagtgattcacagttcctgaattcaaaacactgtgcatatcactgatttggcatttcaccttatatgactagctcrtgttattatttaactttgccttggctcactaattttattttcagtttctaacctttaagaggtaacagttttatactrttcaagactccccaaaccaaataccacagagccatttgtttacattagtaggtccccaataaatattcattagttatttcactgattaattaaagtaatccattcatctccacagggactcaggctggctgaatcaggagagacatcttcagatctattcctctttgagaaattagtataatgtcagtgcattctcatgtgtttcttgaattatgagctccctgatgtctaaagaagactcacagggaagagttcatatactgacagaacaatcattaattagttttcaaactagttttgatttgaaactaagtaatttcaatcagttttttgactttcaactcagtgttgtgacatcatggtggacacaactttcttagaggtatcaataccatcatcatgtccatgtttgatttgacagacaaatattgcaattttattctgttggacattttccaaagaagttggttactgatttattaaataaatatacatattttagggtagtggaagaagaaggtgaatagaaattaatgggtgagcaaaggtgagggaaaaccaaatcaccagttttctttctgattatattttaatctaaaaggctatgtttttaatcaggttatatgtcttgataagtggcgtttctacttaaaaaatgttggttgtatttgtatcccaagtaggaaatgcaaacatacttgtataaagcaaacaagtttaacttgtgtgtttgtattaatgatatgtgatcaaggcacaggaaatgttagtaaagaatcatacacttattatgtttgtttgggacagaacaaaggataagtcattagttggtgagttcagtcattttctttgagataaaacatttggttaaaaggcaggctagcccaggcatcatggctcatgcctgtaatcccagcactttgagaggctcacgcctgtaatcccagcactttggaaggccaaggcaggtggatcacgaggtcaagagattgagaccatcttggccaacatggtgaaaccccgtctctactaaaaatacaaaaattagctgggcatggtgrcgcgcgcctgtagtcccagctactcgggcggctgaggcaggagaatcgcttgaacccgggaggcggagcttgcagtgaggtgagatcrtgccactgcactccagcctggtgacagagtgagactctacctcaaaaaaaaaaaaaaaaaaaagagatcaacttgggcaatgtagcaaaaccccatctttataaaaatctagaacttaaataaaattaaaaaggcaggctgatggaaacaatttaattaacttgatttactgggaaacattgatttattggaaaaacaatgaaaatgtacattgatttattggaacttgattaacttgacttattggaaaacattgaaaacatacattgggacaactggatattagatatttattttaatgcagaagacttttctttaaaattgtatttcctttaaaaatagactggcattatgttattatttaattattattttaatgcaaaagctattttcttaaggatactatttatatttctgctactgaatacagcacagtaatatatttcctcttgtagaatacatttagtcttgttttgatgggataaactgcttttgaatatactcactatgtcatgcatgatttatttatttaaatttcagcataatttttcttgacaacctgttctttcacttgaaatgttatgtaacaaaaacaccaggaccaactggcattttagtttatccgtctattccatatgctgctggatgaagcggaaaatgaatgtgtatcatcactatgctgggcacattttattcgcagcctgtcttttctcctgtacatcaatttctcttctccgtttggaaatagcttcatagcaggttaggtctatagaccttaacctgagtgatcacatataatgtaacaggaatctaattggctatggttagagtcagggaccaaaatatattcaaacttacttggattgctgcttgaatataatcacttcaagtccaggtagaactatttagactcagaaagaaattgatttttttaaatctaaacatagttactgggtaatttatgatagatctccagcccaaacatttcataaacaagtcaaataaggtcagcatgcatcaaggactagggcacattaatccaaaactacaagaaaaccctgcaatgtgtccactcaatatatgccagccaataaattcaaactaaggactaagctaaggtcttcatttgggttcccccagaaacaaatcctgagatgaggatttgagtataatagtgtttctgagcagtggtcccaggaaaccagcagggaagtagagaagtgaagcaggaaagggagggtagcaattaaaagtgtggcttttctcagacaagttacaaatgtgggcaactggtgatcaagcccagcatggaattctgggaaaccatgtagactatgcaccttagagttatttcttgcaaagggtgagggagctggagtctatatacaccaactgagcaggcagtttcagccgtttttgcaccctgcaagagaaagcaagctgttggaattaggacagtctgcatgacaatggttaggccaaagagctataaactgggcactaacaatcattagcttcaaattggatgagaagttcgccaagattataatgctagagtctccataattcaaatttcagtggcattaaacccacacctgcatctgacaataatcaagtatgtttgggtttagaaaatattttccaaactgacactacttttttggcaagacttagccattaaatacatgaatgatcctcaacaattcatgtaaatgagaatcacctgcaagccttcttcaagctctaaatcaatagttctcacactttgggattcatcagaatcaggtaggagacaataaaacacagatgactgggctcccacccccaaagcttccgacttagtaagtttagggtgagcctgagaacatgtgtttctaacaagatcccagatgaagctgatgctgctgttcgggagacctcaatttgggagcttctgctctgtataacctcacacaccgtacttgctcctgccctaatcagttttgtattttaccattataaccaaaagaagtacattatattcttcagataaagaaaatgttaagaggccttgattttcaatctacttctaactggaagagttaagcaaaggaagttttttctacctctgaagaaggcaaaccacacaaagttggaatcttctatccagagttgaaaaccctattatacttataatcatttttttattaacatatactgaaagatggtcattcatagcaagaactcataggtaaagattaagttggtagggtttctgagtggcattttacatagcactatgaaaaattatgcacatgattatcttttcttattcatcactgatgtatcaagagatatcttcaattttcagaatgttttatttttcttggcatacaattagacaaaatatttcagttttcaaaaaacaattcagagttcttattatttttcctcttttagttattttaaaatttgatttgaagtgctgcaaagagaaagggggaaatgatgtggtaggcctttgatgaagttaagtggcagtcgcctggacaaatgtgcaaaaagactggcattcagtaatatccagctcttctggtcttagatgatttctattctgtgatgccaaggagaggtagtcactccctcctttgtgttacatttgtatgttgcatataattttcccatgtatattgcagtataccatgtatgttgcatataattttacatatctcagcataacaccttattattttatktttcacattctcctactagtcttgggacttcctgaagccagggctgtgtctcactcatgtctctgcctagcacctgtcacagtgctaggtttgcagaagtacacttgataaatttttggacacatgaatgaataaatcaatgaatgtgtgagggagaggaggccacaaaaagcgagtagatgtaaatagagaatgagccatgaatcagtggtattggccattcaattcagtattccaagtattgcagtatgttcccatgatttggaattaggatggctctctggctgacatgtcaaccaagaactagaacaggcttgttagaactagaacctagaagatttttcctgtcactggtaagattagctgtagttttctctaaagccatttacccttgtgtaagtaaggatgcctatgatgcatcagaatggcttttaatctcctaggttgagtgatctgaagaaacccccaagttttgggaagcagcgccagaattatatatgtcaggatatggttatctgatgggaagatggaaggagaaagtaagatttagcagaccagctctgccttgtgaatctaagcagaagaaaaacgaatagtgttttaaaactaatttgcaattgtactgaattgaagtcaccggttcctgtccttataagagtaacttcactgcggccatagattctgtatataccttaatccagtgataacaatggaagaaaagggagttttttttcatccttgcactttccttgtagaggagaaagagataaacattgatggaaagtaaaagttcccctgggctttataacactagctctttctttctcatagttataaggtagttataaagtactcaagatttatarttargattattctstaattctactttaacttcagaataaccaaaaaggcccccagaaatttaagaggccatccttatggcataaacattggctaataaagattaatcataaataagagaaacactcatatctgcatgtatattcatcattcccctgacctcaaaataaatcatgcaacacaaaatatgtatgtgagaatgtattggttagcataatactggctgctgtgacaaacagtaccaaaatatcaatggcttcatacaatagaattttatttcttttttgtacaatagtccaacataagtgtttccagttgatgaacagtttatctcatcatggcaattcagagaaccaggttcctttcataatgtggctccatcatcccctaggatcttgctggaaargggaaagaaatagtagagattccccatatgtccccaaaaagccctgccctaacttttcattggcaaraatttttcaaatggctatgcctggattaaaaagtggtagggaggacttgtaaacattgtccttggatttggcagctgcacccagrcacagcagacaccgtggacaggtgcctgcaaattttgaggataccgacttattttctgcaatgtagaccaaaatactggaatccaaacctgctaaatgtagaattattctaaattgactgctactcacaaagaccctaaagataaaatcagtaaagtgacgactttgtattccaagtcatctctgtagacctcttcgagaaatggatctattaacaaaaggatctgggctagaagacttacaaaagaggatttctataaaaacaacttgctattcaatttatctgacttttcattccaaacccgatgtgtttagcacagttacatcaccacacttacgtgacgaagaaggaaatgggaaaagagggagatgtccaatattctctagcagatgccttttattcaagaataggatcaaaaatttacctgggggtaagraaagtgtcttcctcttcccagtgatagttgccttgttaaagactttagacaccagcgcaaygtggttaagtctccactagtgcaacaaagaaaaggatagaggccagtccctgaatagggaggccccagcagactttcagatggttaactatcaagtccaaagacagacagatggaatacattacccaaatactccggaagttgcaaatcgacctgcatggtgttttgtaaatttctaatttaaggcaacactgacaaattagaaggtttaacacaaaatccagatttctggattcttttgaaaaatcaaaagaataatctagttartagaactagttagtagaactagttagtagtaatctagttagaagaacgggtgtctgctstctgtaaccacccagctcctgtcactcgtttgccttttgatctggccctgcctcagtttgctctccctgagaaatcccatcattgttttcagcttcaccttgrggggagaattcaagcacaacaagcaggcttctcaaaatgcctgtgaggccaagaaacaaatgtctagtttcctttcagataaaattgtaaatactcacccaaaaaccacagcaatttaagcaggagacataaacatcatatttagaaggagggactatgtaattaggacatactcccttaagcatcaaaatcaattatcctgataaaaccctaggacggctaaccactcttgaaatatacatttataaaaagaaaaagaaaaaccaaaactaattttaggtgatcgggagaaggatgttctccagggacayarctgagttcattctaggacatttgattcagcctgtcccttgttttgtaaatgccatgcacaggctttgagtcgagaaagtggttgtagctagggctcaagttcagtaattactaatccttggttaatcttaaaaggagttatcataaaggcatgcaccaatgaggagactctgatccaagctgaggccaacacaagggcaggacccccacaggaaaaagcctttggagacccaagacttcctgaagaggctgcttcatgggactccaggttctctgagatggttgcttgcaccgtctgcactattgaccttgcttctaatgtgactcggtgtaagaactgaattcataatgtatgttcagttctttctggttggtggcattccacctgattgaaaagaaatacatccttcatctaaaaataattagcctctgaatggccttttatttcaattgcccggagggcttttattgattttttttcagggtttgtgtggttaagagaatgggattcttctggtggtgtctttcttagcctctctcgaataggctgtcatgcccttgctcctcatgtgcggctaaatcagaagctacaaagtagtgacttgcagactcagttgggccttttattggactcttggtatatgttaaaattgctgaatttgagtgttttacacaagaaatacaattccacttggctacagattccactacttctcaattgccttataccagatctcattcacagatttgtgttgcttcttgagccccatagatatttgagttcagagattctgaaattaatrtacatgtattaagttaatacatgtaaggtcctaggaacagtgcctgccacacaataagcacttaattaattttaatgttactattattatagtaaataattattttatggttctatatttccttgtttattagcaatttactaggttggttataacccragagatttttttctttttcttttaagctatgatttytccttattccagttttccatttgcttgttcttttttatggtatccgattctttacagaagtattctgattaaattagactgtacttaatggaaaacagaaaaacaactagctgatcaaataaacatttcctaaactgaagaatgacacagagggagtgaaaaaccaggatcttccaagtatgacagacacaaagaaaagcctgtgatgatttagaaatgtgctgggctaattgcagctggttgagggtcctcgttgttttccataaaacygtattgtattatgaagaggacagcaggtcaataaccctgggccatgggacccctcttcagcatcacttttcagtaaaagacaattcccgattattttgtgaaagcaactttgaaatcctaaacatgaaaggaaaacacattggaatgttttgttatattcccctcaacacacaagaatatcaggttcctgagaccttcacacatcctgtttttacatagtgaacagttggcctggaatggtggggatggagccctggataggaggcaagaatttatttattttacttatgtattcattttgagacagcatctcactctgtcacccaggctggagtgcagtggcaccatcttggctcacttcaacctccgcctcccaggttcawgtgattcttgygcctcagcctcccaggcagctggggctacaggcaccagccaccacacgcagccagtttttttttatttttagtagagatgggatttcaccatgttggccaggatgatctcaaactcctggcctcaagtgatccacccacctcggcctcccaaagtgctgggattacagacgtgagccactgcacctggccaggaggcaagaatttagtattcagatcttgattctgcgctgaaccacttggatggtaggctttagtctcctcacttcatgattgatgggatttgatgaacaatgtgctgaatgtttattctctcaagattataaaacaagtatcttaagcttccttaccccagagcacaggatcttcaaagacttagaacatcttttggtatttcaaatacaatagtaactttctgtttgacaaacgtctttgggttattatcttgattwtttttttttattatactttaagttttagggtacatgtgcacaacatgcaggttatttatcatttttgtamaatcaaaatttgtttcctaattcacaatcatttttatgcccagctgagtcttccaaaagaaaacacctaactaaaaatagaaaacttctaggccttaatcgcaggccccataaggagaaagtattccagtgctgacataaaaagttcagggccaggaactcacatattagctgggctgacgtggcctgctgagtagcataattattgtcctaaattgtagtataagttgcttttagggtaagtggcttgggtatgtatataaagcaataagaattttgctcctggaaaatggtaaacaactcatttcatgtcaaggccacagaacttaatgcacacttttgagagaaattataagagtcatggggaaatgcaacaataataccaaataacagacacaaaacttcactggcttacaataataaacatttatttagttcataagattgtggggttcagctgatcttggctgagtgtggcggagcttagctggacttgttcatacatctgtggttcattatgggtcaggcaggtagctctgtagctctgctgatcttgactgacttacatctctgggtatcagttggatgttgatgaatctaggataatttggggtatgggactgggatgactgaggtgactcaactcttttcctygtgttaaatcttctactagagtagtctaagcatgttcccgtgacatgccataggaataggagtgaaagctaagtaagggcttttttaagcctctgcataggccatgcctgctaacatcctattaaccaatgtcatcgcatgaccacatcatcttcaaggaatggagaaatagactcctcatctctcataagagaagctgagaatcataaagcaaaggctctgggtacagggaggagccattaatccagtcaatctaccacagaggagagaattgacgaggtcctggtcctggttttgctactagccagccatatccttgagaaagaccctaacttctctgggccacagattttcactaaataaaagaaaggatttgagtataattgctaaagtcattttctgagacgtcaaagtcatgaagggtttgactatgtaattgttaaatgttcttttttcaggttcctacagtaatctctagacacctgtgagatgattagaaattttgaaatatatttcaggactcagaggaggtataaaagcatggactatgttaggagttttcctctgtggcggtttcatggaatatatgcatatatagaggagttcacacctaagaactatgtcagaatgcatttggcttttgacttgaaataaagtttaaaaaggaaatgcatgttaggaactgtgcttggtaaatcacatggtctctagtttctgtctttcctcttttattgattcagtatttggatctacttagyattttgcctacctcgtccttgactcctccaaccttcctttctggcaacttagcaaccctcattctgcccttcacccaacagccttatcaacactttgaatctaaatctgagcattagcattccagaagtctgaagatatgagatctacaaaagaatggtttaatatttatctagaccctgaagtaatgttgttgaggaaggaagagaatgcacaaaaggagaaaattgttggaagacctttgtctaaagtggtgctattcacagtgtggttcttagaccagcagcaacagcatcaccttggagcttgttagaaatgcagggtagcatgccccaccccagatcttctgaatcagaatttgcatcttaacaaaatccccagagattttgtatgtacattaccttgtcacttttaatgtgcatccatctgtgaaattagccrtagattatgaaaacagagtatgtgagaattgtaatccctctattgtaatctatggctaattcatgaaagtaaatgtgtgatmatttaatttttatatattagagcagattcaaagttgagattcatgttttctatcacatctacatacttacatatatacctgtagattgtgtagggaagagggaatttacagctacagagctgtgtctccccagtgaatgtcatctattgtatgtccaatggaggaagtgttgagagcttctgcccaaaataaggataatactaaaggtattggcagatkctacaaggctcaatttttaagtctcatgtccttcataaagtatttcccatattaccttaaggctacaatacagtcttcattttcagcatccacagtccatcttgtgtgtggcactcattcagtccaatgttttattttccccgtatccattgcttgtcacctaggacggattctaatttctccagtcaccacaacaccaaacagggccttgcatgggtcagagtgttcaaaataccatttattgacaaatgcatcaaaatcaacaamaaaccagaatatagtcccaaaagagaaatccaccaagtaccataactgaccaaataatgactcaaattaactggaaagaacaaggactggttcataggcaggactttagattttttttgctgtaagtgattttttctctctttttaaaaatgaggttacayaatattaattaataagcaaatcagagtatgctaagcatttaatatgtatgatcttgtttaaaccttttaacagcccaggaaaattggttttattattcctatgttatacatgagacagttaaaattccaagagattaaataagctgagcaaggtcatatttcataaaatgcaagcattctaaaccctatgtggagaaagaatcttatctatcccaaagtgaattgtctactttrtgtagatctatggcatcagtttaacttatgttgccttcttagccctgtgtaacaggttctattgctagtkggtatttgttcacaagataaaaattaattttaatattattttgaagcaaatataattatttaggaaaatctacccaaaatataggcatgcaycaaactccagcacccaataaaaagcagcagtaattgatttccattgtgaatggcctgtattcttctacattggcatggactatccagtttacttctgtttacatctggagtattttcaactttgacctagaaatacactgatcaccatttcactcctcatctttagatttcagttgccaatggcaaccttgaattacaaagttgaacaaaagctgcattttacttgagtggtttgtaattttgaacttgagttcatgttttctaggagttgtttgtctataggtgtcagtcctgcccttggttgccgaggaacccgaacattctgaatttgctatgcctctgctgggactcagtgggctttatcagtttctgaacagtttttgctttaawttattgggactgggtactcaattcacaggggtaatatgaatttggaaactgcactcattcatgggtttctaattccctttgtggatgtttttcctcaatgtgctccatgaatcatttgcttccttgcctcatctccaaggttgtggattgggttttcctagttcccatttgaagggtgggcacccctggctctattcagggacttcaggttcagcactccaacacccggcatcctgaggcctcctcttccaatctctcctcgccccgcaaaatggagaatcaattctgttaactgtgagttcctttgttatttctgcgacttaaggatttcttttccttatattcaaactcagctgtaaacttaagtgaatatgtatgtactgtttcattttgcctttccctatgtttggaatagaaaaggaaattttcagtcagccatattgactcaaagtcccatggcaatttattctaaggaaacttagtggaaaacaaataaacaaacaaaaactgaaatggttaggatatagcatgtggtcactttccaacaatccttgggtaacatgactaacctcagtctataaatttcttatgatcctgttatttttattcttgaagcaaaattcatgagattattctaaaaataagatgaggccttgcacgtttgctcaggcttaattttgaaaccattcattctatgaatgtatgattttaatgcatttcccattgcttttaatatccacttagctaactgatgatgttgaggttaaaatactatagtccttgcagtaattctcgtaaaattgtcctagtcactgtatcccacattcagagttctacatttttcttttttgtattttatagaaattatattagattttgttttcattttagaatgctatttttatgctaaaaatgaaataatcacattaccataaaagtgagaaatagaawaaataaagatactcataattctaacacagtttatattttagtgtttcttttcaaagtcgttttgtattctttaaaaaaatggtcatagttattatcacagtatgtatacaactataggtacattttttcacttatcacaaaaatataattatttctccctgttttcaaagccattggtttatattatttgactacctcatagttctttaagtgagagccttatgatttttttacagaaacacttacgttttattcatgtttttgctgtttcttggcttktttgttagttttactattttccctgatctttagcagtaaattccaaaatattctgagcaagataattagagtaccatattattattgctgcctctcaaaggctaggagatatatttttaaagtgttaaaagactataaggaattaaattttaaatatatgcagcatgtattttacatctcagaattgctaagcgattaaatttcaaatgttctcaccacaaaaaatggtaagtatttgaggtgataaatatgttaattggctttatttaattactccatgttgtatttrtaaatcatggcatcattctgtactacataaatacatacaattttaaattgtcaattttatttatatatatgtgtatgtacacacacacacacacacacacacacacacgcacaacagatgctcccagagaagaaaaagaataaaataattgaaaatgtctactgagaaaacaaactgaaacaagtgatcctatgtctatatttaaggtaacataaccatacaaagaatataattactttcagtgaattttggcagagtratataattgtgcatccttagtaggatatatttgatgaataaaaagaacttcaaaaaagtctcaagcttcatttgcttattttattgacaggtcataatattgaaactatttctggatatattaatataaagcaaataaataaatatgctaatgctatctgaaagcaacctttttaggaaacgtatgcttcagtstttatgggtgaaatgtcatgatgcctgaaacattttcaaatgactcagcaaaaaatatagagatagacaatacataatgcatatgtggcaaaacattgaaattaaggtagttttcacaggctggttttgttttgttttattttttggttgctttgcctgtacaaacaatgctaaatcaatgctatttttcctgtacaaaaataaatatcttagtgtattcattcttatatgttggtggttttgtttctgtgggccaaattcccaaaaatggagttgctgggttacaagcctatgtttgccttcttataaattttgtcaaattattgcccaatgtttcaaagtgtcaatttctcagaatgttattgcttctttaaaggaaatttcttttaaatttaatgaattaaattaaattaatcaatataataaatgtcccttgaaaaggtattgtgctattgcatttctctaattgttaatgagctgctttcatctatatttcaaatatatatagttgtattgtatatatattctttgtattttatttcttttcctatgaattgctttatttatgctcatttttcagagaaatggattattttcatctagataaagatatctatatttttctttcttatgtttttctgtcttgcttaaaaaggtctctgtaccccatgattatacagttattcacaatcacaattatacttttggcacattctcctagacagaagcaaataacaagcaaataacaatcctaagattgttattggcttcatattttatattacaaagtggtatatatactatacrtagtatatataatatacataatataaatattaatatatgtaatacattatattaatttattatgtttatattataaaatatttatataacatataaaatatttttatatataaatataatatattaatatttatattataaaatacattggccttatattttatattaagatctttcatacacttcattgggcaaaatgacctgagttggactctggaattccaaattttgaaaaccttgcaaatatctgtctgcacattatccagctgcatatttttttttaagttttctcaattcttctttgttattccattgtggcttattgttctctggtttcaatttgtttccttaggaaattggtttgattgtctctgattcataactcagtaatctgtcttatatttatgccacatttatgttatactgggttttgtttgtttgttttctgattgtaagctaaccttcaagagtaactttgcttgctccttggccttcacttattttttttatctaaaagctttccttaactakatcaaatctctgccttttttaaagacagaagaaaagaatgtcagagtcagaaaagcatcccaagtacaaaaatctttgacaacacaggaagaattgaatacatttgaacttgaccgtattgccttttcctgcttaactacccagagttcacaaaaatgactagtgggcaatgtcttttgaaaatcaagttaactgagaaatttagaatttgagcctgactagtcaaattaaagaactgggcctataataaaacaaactctgacaacactcttctttattaatatctgagtataataataacaactcatcttaaatttagaggttaaattcaatcatgttctttcgtctttcttgttcattttccaaaaagaggtcttatgaacttaagattaaacaaactcaagtttgacaatgttatgctagaaaggctccaaggcatagcctacaaaatcacatttgtcttgaaaatctatctgtcctgtggtgattttttttccaagaatatgctttgaggccacagcaatgaaaggatggggccagctgwgttagcttatgagtattttatgggtccaggccacataatgagactactttctgttcccctcactcaaagttatagccataatactgctgcctaacaaccaaccataaaaatcagtcacaaaacaagcatttgctaagttratgagtctatgaactggttctggtctggaccaggctcacctgatctcagtaggcttgttcatgcctgtgtttagctggtggtcagctaggggtgagctggtttagaatagcttcacttttatatctgatagtcaattgaagtgatgcaaaaagtataataactgggccatgtgtctcctcttctggcaagctaggctgagcttgttcacatgatggctgagtaaacttctaactgtgagagcagaagcacacaaggccttgtgacgtctggactcagaacagcatatacttttgacacattctcctagacagaaccaaataacaaggcctccccagattcaagaagatgagaaatacactccgttctttgctgggatgggatgagctgcaaagtcacaccacaaaggttatgattacaaggaggggtgaagaattwctgccatttgcacgaccaatctaccattcccacctaacaccytgtttcacttgcacagaatagaaattcaacacatattagagtacaaaacccagaatatggcaattagatagtatgatgctgaacctcagaacagaggcaatcaaaaggaagccctggtgatctgtggaggaccatctaagcctaggattatggggaaggaaaattaggaagaatctaaactggaattccacagttggacctaacttcgggagtcccctggttaaagccagatttaaatctgttaggggaaaggttataaattctccatgagcccagtggggctgatgaatgtgatttgaattgattgccaacaataaaaactcaggctcttacatgaagatgtggatttctgacttcaatatttaatctgacaagcatcagctagaactgagttgtttgtactccctttagacagggcctgtcatctctagctcttcagaaaccccacaaccccctctttcttgcacatagcctgctacttatttacatgacttgcctggcccctgtaacatctgagtttgcaacccttgggctggaatagctctagaccactgatggatggggctttkttggaacggagccagaattaccctgtattcttttcatattttcttacaatgaacaagtatttagtttataagaagaaaaagcaaaagctctaacttggaatgtaataaatacaattttgaaattagttcattaataattgtatggctktttaaaaagagtgaaatatrtggcacttaatatgtcatgaagcagtgacttagtttagaatataataaaatctactactatcccatgatgaaagtctactacagttataacttagccacaactgggtcaattattataaattattaaaaatcatcatcaaaattaaattactaaaatgtaggtttttcttagaattaaattatttaaaatgttaaaaagcattggtttaggtatttgacattttcttgtattttacttcttttgttaataattaaagaaatagtacttatcaagcactatgggrtcttgtccaccaatgagcattaacctgagagaaattatctgctaggtcaggtacaatatatccatagctgaaggtcccccagttcaacctataagagaacaacaatctgttgttttcttaaaacaggctcacttgcttttcttccttccctatcttccttggaaacacatgtgttactgaattaaaattgaggtgaattgatgatgaggtctgaatggtagtaaatggacgctgtcaaacaacaggctaagatttcattcatgcaaaagagtacgacattgtaaaagccccacttccttctaaattgttggaacagcagggaaataactggcaattgtcttcttcctgtttgatgccccagtgactcgtatgtgccaacacggagagtagggccctgtacaaggtgctccatcatagccacatgagtccagggccctgagcgccccctcacagcatgtttcctcctcggcttataagaatttatatgctagcaaatagattcataaataccccacattttatatgtagggagaatagttgactttcaatactcagcctaagccatttttaccagataccatttttatttttattttttcattttctatttttatttatttttatttttctttgatatttcaataatttttataaatttttaaaaatttcaacttttattttagattcagaaggtacatgtacaggtttgttacatgagtatattgtgtaacatatatgtatgagtatattgtgctgaggtttgggatacgaatgatcctgtcacaaaaataataaacatagtacccagcaattagtttttcaaggcttgcccccgactccctcccccactttattagtccccagtgtcaatcaytgccatatttatgtccatgaatacccaatgtttagctcccacttayaagtgagactgtgtggtatttggttttctgttcctacattaatttgcttaggataatggcctccagctgcatccatgttgctgcaaaggacatgatttcatactttttatggctgcctactattccacattataagtaccatattttctttatccagtccaccattaatgggcacctaggttgattgaatgtctttgctattgtgaatagtgctatgataaacatacaagtgcatgtcacacacyttttgatgtgaaaaaaaaaaaaaaacaagtcatttaaactagatccataatctgttatctgagattcttggggcctgttgtttttcagaattttaacttttctgattttagaaaggcaatgtgatgcatataccatgagcataacactccaggcagacctgagtaatcctcaaaatcaaacaaattaatatgtctgcagttaagttcatgtatagtcatatgacagggcatacatgaaattatacatatttcatgtatcagtatcatcccaatatcagttcatgtcaatgagtctgccacaaatttgccagaaaaagaaaaagaaaaagaaaaaaaggaaacttctcggatttcagaactttgggatagataagggattacttaatataaattaaataatttagtaatggcaaaatttatctgtcacagaagtgagagtgaaaggagttgaactaaaggggatgctcccaagctgctgacactgtctagaaggaggctaagactcaggaagacagatgtcctggagattgacttcaccctggcattccagggatcagaacaagccccagaggctgccctgaaagctgcagatggaggatgcacagccaggatcaagacaaaaagtagaactgggggctgagagtagaacycagacagggagctatcagagtggccaaagcagattaaccaccttggcatcccccaagagctattgagaaacgcaggagctcaggccccactcaggcctcctgagtcggacagaatcaagatcaaattccagacgatttgtgtgcacttaaagtttgaaaagcagggggaaaaatacaggttttaagtccatgtcttaaaaattgcctccaagctaataaggaggtgtgggggaagcatttaaccttgcatggtgtttcaaggattattytccctgctcaccaattgataagcagagataattttctttaaaattcaaggttttctcttggactcagcacagcacagctccctaccagacaactctccctgttgcccccgttctctccctgtctaccggagaatcccagcttttatattattttatgactaagacatccacgtaagtctccatttgaagaaaggcttccaggactttaaaacatctgaaaattctccagggcataaaatagacacattaagagacagtttaaagggtagctaaaatagtttacaaggcaaataaaaattagaatgaaaaatgaatcaaaataaagtggtggcaaaataagtcaaaataaaagttcaagttggttacacgagtttgtttactttgtgaaaatgtatcaagctgctccttagaccccagcattggcttccaggcctctgactaaagctgcacatctcaaagtccactccacactgctctgtctattctactcagcttcttagcttcccccagccaggttcatggctgaccttggaacgctcacctatcaatatttctcaacccctaaatgtaagaacctcagatcattttatattatttctgacacatttttctatttttctttctttcttttcctctttttctttctttctttttttttttttttttttttttggttttgagatggagtctcactctgtcgcccagactggagtgcactggcgcgatctcagctcaccacaaccactgcctcctgggttcaagcgattctcctgccccagcctcccaagtaggtgggatcacaggtgcacgctaccatacctagctaatttttgtattttagtagggatggagtttcaccatgttggctaggctggtcttaaactcctgacctcaagcaatccacctgcttcaacctcccaaagtgctgggatcacagccgcacgccactatacccagctcatttttgtattttagtagagatggagtttcaccccatgctggtcttaaactcctgacctcaagcaatcgcaatcaacctgcctcaacctcaacctcccaaagtgctgggattacacgtgtgagccaccacgcccagactctgacacctttttcaaaagacccgtgtgtgtgtgtgtgtgtgtgtgtgtgtgtgsatttgtagataccgctattcatcttattctgagtctttagccttattgtgccacacataacttgaagttgactttcagctacagacaaatgatgtgtccaactaaactttgttacatctcctctataggtgaccagtgaatgatattttaagtdaatgtattcatcagccccttttgtatatctctttcagagagtttctatgggagtgggtatagaaacataaacaacttcaagtcatctcccctcttgatgtctctcagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaacccagcggttatttcttggggtcagagtcaaccttcttttgacagggaaagtggtgggagcgggcataatgccagtctttagggccatcatgcctaccctgacagggcacatccatgcctgtaaaggatattgggatgctgcaatgtgtgtgccagaggacacagttgtccttgctatcattccaccaccctccatccaggagtggaattacacttgccattgtttgcgtaatggagaccctctcttcctttctctcttccttcctttctccctgtcttccttgaccaaagttaagcaaggcaaaacagtcaaaagttttytgacataagttgcagtgacaagaactgacagagcacttgatgtaaattttcttataaaacagattttaaaagtgtttacaatattgataggataagaaatgtatgtgtgagttttatgtaaatgttccagaggcaccccaaatgcaatgtattaggtacttatttctgtgttacaaatggctctaaaatctaggggcttaaaacaatcagaattatctcttatctcttagcttctcaaaaaaaaatgtgtgggtacctagtaggtatatatatttatagggtacatgagagagagatgttgatacaggcataaaatgtgtaataattacattagggtaaatggggtatccatcacctcaagcatttatcctttccttgtgttagaaacaatccaattatactcttctaattatttttaaatgcacaataagttaattgactgtactcaccctgttgtgctatcaaacactagatcttattcattctgtctaactacatttttgctcgtattaatcatcctcactccctcttttccccaactaccctccccagcctctggtaaccatccttccactctctatcttcatgagttcagctattttaatttttatatcttaagaataagtaggacatgtgacgttcgtctttctgtgcctggcttatttcacttaccgtaatgacctctggttccatctacgttgttgcgaatgacaggatctcatttttaatggctgaatcgtactccattgtatatatgttatcatgtttcctttatccagtcatctgttgatggacacttagattactttcaaatcttggctatgataaacagtgctgcaacaaacatggtagtgcagatatctcttcaatgtactaatttcttttcttttgtatatgcctagaaatgggattgctggatcatatggtagctctacttttagtttcccaatgaatctccaaagtgttctccatagtgcttgcactaatttacattcccaccaatagtttacaaggcttcccttttctcctcattctcatcagcatttatttttctctgtcttttggataaaagccattttaactgggataagatgatatctcattgtagttgtttgatttgcatttctctgataatcaatgaggtagagtatacccgtttgccatttgtatgtcatcttttgaaaaaatgtctattcagatcttttgctcatttttaaattggatggatttcttttctaaagaattgtttgagctacttatatattctgcttattaatcccttgggagctgggaagtcttaaaatgttttctcccattctgtggattgtctcttcactttgttgattgtttccttttctgtgtagaagatttttaatctgtgtgatcccacttgtctattttccccccagttgcctgcacttgtggggtattccttaagaaatctttgtccacttcaatgtcctggagagtttccccaatattttatcttagtagtttcatagtttcaggtcttagatttaagtctttagtccattttgatttgatgtttgtatatggtgagagatagaggtcaagttttattgttctgtatatggatatacagttttcccagcaccatttattgaagagactgtcctttctccaacatatgtccttggcacctttgttcaaaatgagctcactgtagatgtagtgatttatttctgggttctctactctgttccattggtcaatgtgtctgtttctatgccagcaccatgctgtttgggttactatagctctgtagtataatttgaagtcaaataatgtggcctccccagttttgttctttttgctcatgacagctttggctattctgggccttttgtggttccacataaattttaggattttttttttctatttctgtgaagaatgtcattggtattttgatagggattgcactgaatctgtagattgctttgggtgatatggacattttaacagtattgattcttccaatccatgaacatgcaatatcgttcctttttcttgtgtcctcttcaatttcttgcatcaatgttttgtagtttttatggtacagatctttcagttctttggtttaaatttattcctaagtattttacttgtagctattataaatgggattatcttctcgatatcttcttcagattgttcactgctggtatatagaaatgctattattttttgtatgttaactttatatcctgcaactttactgaatttatttctcagttctaataatttttggtggagtcttagctttttacaaatataagattatatcatctgcaaacaaggataatttgatttttcctttccaatttggatgccatttatttccttctcttgtctgattgttctagctaagacttaaagtactgtgttcaacaacagcggtgaaagtgggcatccttctcttgttccagatcttagaggaatgacttaccatttttttcaattcagtgtgatactagctatagatttgtcatatatggcttttccttctgtgtccagttttgttagggcttttatcacaaagtgatgctgaattttatcaaatgttatctcacaggttttttgagtcaggaattcagagagggcaaagcagatatggcttgtctctatgatatctggggcctcagccagaagattagaggtctagggctagaatccactcacacatctagtggttgatgttgtatcaagtgggagcctagctggggctctggggtggaatacttgctcatgccctttctatggagaagcctgggcctgggctttttcacaatatggtagctggattccaaggaagagcctcctgagagagccagacagaaaccatcaacatttttataaccaagcctcaaagttacatacatcacttatgccagactctattcattggtgctatcacaagcctcttcccagattcaaggtgcagtaacaaacatagaccccatcttaccttgggaacacagttgatcatcctgaagaagtacatgagggatggaatgaatatataggcatgaccatctttaaaaaatataatctgccacacacagtatgcatgaagccgaatttgtgttaccttcaaagctgctccacctcctttgctttctacatcagtgaacaaaaccagtattacaaatcacactccagcctacacaaccttatggaccattccacctcataggctttttaactaccatttctttcaactgcttcatccatcctttctctttctcttaaatcactcccccagtacacgcacacagacacacaagttcctttggttccctcctttccctggctaacttctatttatcgttcagtttataacataaatgtcaattcctctaggaaccattcttggatccaccaaagcttctgccaggccccttcatctattctcccaatgcaacctgtatcagtcacccactgctgcataacaagccacagcaaaacttgatgtttgaaataactaccacttactattggttgtgggcctatggatgggtagatggctctgctgatctgagctgggctgggcttatctcagctgggctcatctatgccgctacggtaagctgagagctatctggtggctgatcatggctaggctcattgacatgtctggggccttggctggaacaaccgggctgatgtgactctaattcataggatttctcatcctctgggagataaaatgggtatccaataaaatattctccaactattaaaaagagttaaatactgatacatgctaaaacacagacaaatctttaaaactttatgctaagtgaaagaagccagatggaaaaggtcacatattgtataaatccagttgtatgaaatgtatggctttttcacatgtcagaggcaggatataaagaacacataaaagtgctcaaggtctcttgaagtctaaactcagaaccatgcaccatcacttccaccacattctattggtgaaaataagccaaaaggccagcccagataaagaataaaaggagcctccaatgtcacaaggaaaaagatgtagacacagggttgttactaaggtaatcaatccagcaatgccttgttatttcttccacatagagagtgcatgccaactccatgtaatggccttcttactaaatacatcctccatggacacctttgatgtcagatgtcatgtctcatttacgatgaatctgcacactcaccctaatgtcataacttaataaatattgcatttacagtgaataaatccatttgcttatctagctattagtgctacattagaggaaaataaacaattggctaggtacaaaggctcatgcctgtaatcctaacactttgggaggcagaggtggttggattgcttgagctsaagagttcaagaccagcttgggaagcatggtgagacccaatatcatttttcctattttaaatataatttttttccctttcctaaaatagaaaaaattagctgggcatggtggcatgcacctctagtcccagctacttgggaagctgaagttaagaaaatcacttgagcccagaaattcaatgctgcagtgagccatgattgtaccattgcactctaacctgggagacttagagcaataccctgtctcaaaaacaaacaaacaacaacaacaaaaacaaacaaacacaaagcaagaccagaaaaagaaacaactgatatctcaattatctcaataataaatgtcattaagtcaatgctacaatgctatttaggtactttctgagtcagcaacactataatagtaaggctagactacacaggagccacactctttgcctttgacttagggtaccaactccaaaacatgaaagagctagtaactgatgaaaccaaatattattttctgagacattggtgaagaaagtggggcttaccttagatcctggggttaccaagcagactctttttgcccataagagaaaattcaggagcaattcttgcccctgaacattcatgtattgttaaattgcttctttgaacactctggatattgtatctgtttgtttgttttatgtttctctctgattctggatcttttattctttttaatattgtatttaatttttttagaggcacggtctctaaaaaaggcatagtctcactctgtcacccagtctggagtgcagtggtgcattcatagctcactgaagtttcaaactcctgggcccaagcaaccctcccacatcagcctcctaagtagcggggactgcaggtgtgcacaatctagctaattttttaaataacaactttataattcatgttccataaagtacactgttttacaaagtacacactccagtgatttttagtgtaatcacagtttcttattaatcatcaccctaatttcagaacattttcatcaccccaaaaagaaacctcatacccataagaaaacacttctcattccctcccccaaacattctctcttcagcccgtgaaaaccattaattctttttctgtctctgtggatttgcctattctggacatttcatacaattgaatttatacattatgtgaccttttccatctggcttctttcacttagcataaagttttcaagattcatctatcagtatttaactctttttaatagttggagaatattttatcggaaatatam

SEQ ID NO: 10617 - DNA, 393141 bp, Homo sapiens
  misc_feature (1)...(393141): n = A,T,C or G, or insertion/deletion polymorphism (see Tables 1-2)
tctacagtccaactataaactccatgaaactctacctcaatgctacacaatttccaaaagttcagtaaatacactttagtgaactgaataatggagtcctttccatctttctatttcccaatgtgatagaaaacacactcacccttcccctgttttggagactccagagactgaggcaagaggatcacttgaggccaggagttcaaggctgtcgtgccctataattgcacctgtgaatagccagtgaactccagcctgggcaacatagcaagactccatctctaaaaaaagaaaaaagaaaaaagaaaacactttcctcccttttctcctttttttctcaaccaactatagaactatttttcatttacctgtaattcttcaaatacaccctcaaatgccctgtcttaatgtctttctttctgtgccttccccttgttgctcctctccaacagagttgtgtccaactcagatgatctggccaacatgcacaacacccttctccttatccaccatttgtgattgatcttagggggctatttgacagaccgtcaaggaaatggaaactacttgggctgagggcttccagaaaagttatttggaaggcatctaggctagatgcagcccctcaggactgttccaccttcttctgcctgaaaagtgaaacatgactcctggaggtggaaaagctatcaagcaactgtgagaatgaaagctgtacattctggagcatggagccaagacatgaaaagagcataactgagcttccacagtggccatgtactgtctactcccaggttccttatcgttagagataaatacacccattgtgtgaagaacagtattgctgatacacaagtgtgtgtcttacttttaggtaaatcttcttctcaggctcccatatccttatattcccacaacatttttgtgtttatttaaaatccttttgtttattcatttatattgcctgtaagattctgagccattgctacacaaggactatacctcatgcatatttttccctagggatcctagagtggamccacaatataacaggggggaagtgaaagttttctgaattgaattggatttaattcttccagtcagttaatgggaaaagcaatccacagggggctggctgctcttcagcctttcttaactagtgctcttcttttgctacagtgatgtgttgttgcacaaaagcctggagaactcatcttgcctcatataccacagaatagggatttgttattttgtctgccctacatccattctctttggcatctttttttttttttgtattaatcattttctattgtatccttttggagaaccccttatccccattttcaatccaagtttccagttggcaaatattggcacatgaccaggccttgccattcagtatatgccaaacatctggccatggtaattgcctcagttgtgagtatgtggcccaagataggccagggccataattctgtatttattttttgccatttggaaacgagtgtgctttgtgttgagattgacaatgataaagacaatgtaaacctggagctgctgggaatcccaggatggagatcataagtctgtgaatgaaaccaaaacagaggagagcataaccaagatattgagggtggggggaagtactaagtcccatgagtgatatttaaattcatgggtctaagacatcatccctcaaatcagactgtcgctagtaaatactaactgtgtgtgaccttgggcaaagttacataaccactctgtttcctcatttatgaaacngagataataatggcactttcattcagttatgatgattaaatgagatagcacatgtaaagagcttagaaagtgcctgacacacagtgagtgatagtaaatggtatctattattaaatagatatttcttatccatagtttttgagttatgcacagtgataaattatctttttgcttaagctggttcgagttgggtttctttcacttgcaaccaaatgggtcttatctaatagaattaataaaaagcagaaagccctagagagttttggtttatgacaagttaaatctctttctctgggctaaggcagggaaggaggattgaatcaactgaatctagaccatctggctctccttcgttgatgtctatcagtaacattatgtgaggtctctgaactcccaacttgtaggaaaggagttttcctcatcaccatcctatttattcactaaaatcctctttctcctatgttgccagttaatgcagttaataatatccctggtatgaagatttatttttaaacctacacaaaaaatataaaaagtgaggaatcaaacatataaggagagagatacaatgaaagaaaatatttccataattaaaatatatgatcaattgtttttgatttaagctttaarctggaaactttttcagtactagttccgagyaaatgatattattatgaagcagcctacatgctaaatagcatacttttcttggtgtagatttctggagggatatgcaggggatttgcatgcttaattcccattagcacctgtcactgggatttattatccnagagttaattctccactcactgcagccaagaaaaagaaagcccttgtatatggatttaaatgaagcttttcatttttcaagatgagatgaatttcctgtctgttccttaaacacctgcagtattccaaccctaaaaagtcaaattccaataaatttttggtgaaaatttggcaaaacttgattttattcaacaactagaaaagcctactcataatttgataacttgagaggctgaagaggagaggaagaaggtttaatgaaggacttagctcaattttaaatccattggttctgattcaatccattcaatattcagtaagtatttattgatcacctattatgtacaaggtattgttccaggttctgggtatagagcactgaatgtattagaaaaaaatttctcccctgagaagcatacattttattgcagactgcatatatatatacatgtatacacacacacacacacaaatatatatatacacatatatgtacatatataaagtaagtgttatatgcaaaatcaaagctggcaaatgatattttggatgatagattgttgctattttaggtaacttgatcagtgaatgcctccctaagcagtgtcatttgaacccagatctcgatgactttagtaaacctattctcaggagcctataaaacactattatttctctcatgaggaaaaaatgtgatgatcaacaaaagtagtcaggatgttaattcacaagacaagttccatctgtacttgtagagagcaggaaacttgcctgctgtgtaaagctgatgtattgctggtgtttttcctgtcctttgtgtggtgctctcactctcttcccccttttccacctcattactctataccacttctcaaaccattctcctgccatctttaggctgaatttcagtatttaactacatttcctcttttaatctcgtattctttattttaaggaactaattgcatgtggtatctgtcactgagtacctcaataccccaaacaggagtaggcgacaatttcaaccttctttagctgtcctagactttgaggagtcttccccattgagcttttttggcaggaaatcagtcaatattgattgagtaccaactatatatcaggctcagtttaggagctgtggttgaaataatgaacaaaggcaaaatctctgtcttaaaagagttaaattctaatttaagaagacaggcaataaaattgtaaataaataacttttggatgtcgttgatgtgatggtgagtatgtgtggagatttcttagtacttaagctgttgtccttcttagtaaaattgtacatataaatataaagtataataataatcccttgtgaagtcattctcaaaatacttgacaagttattagtggcctcgatacaccataaaatatggtagctgctggccacatgtgactatttaaattaaaattaaataaaaatttccaattcacactagccacattgcatgcaagtagccacatgtatctcataactacgacctcagaaagtacagatatgaacatgttcttcattgcagaaatttctgctgaacagcactggtgtagatagcatgaggctaatgggaatttttcatcaatggtaagaacagcagtttacaattttggcgtcaggcattttacatatgtttaacttacataatcctcaaataaccctatgagatagttcctgttactagacccatcttacaaattagggaagagaggcacctagctttaatgttcaatatcagtcaagtaataagaaatgctaagaactgaaggcagacagtctggtgccagcacccaccctgttgtcaaatatcttgatgtcttggtatggagaagatgaagagagtgaagaagggttttgtgtggtggacagagtctccacagaaataagaagtggccagttttgtcaatgtctttggcaaatactaccttttcggatctccctgattcatccgagataggtcttattgcctagatggggctgtgcaggcagaatcatagaatgttagaacttaagagaactttgaaactatcaaaatatttcacaaatgaagaaactgagacattcacaggttacctgacttacccagggtaacagagtagttatgaccacagccaaaattagacctcatgtttcctgcgtgtgtgtgtgcatgcgtgtttacacatggcccccttggcaccaagagcataaaattccctgatgtattattagtttaaagacatgctaatcttgggaagtgattttctttttcccaaaatgttgtctgtgtctgtgtgttgaccttttaataaattcactttccttttgtctagtcttattttacccacccaatcttgcatccctccatcatgaccacagggattcacaacccagctacgtagacaattatttcctgtagaaaggtaaacaaattcatagcagctcgagttcttacacacactattagaaatttgaaaaacatgttataggctccaccatcactttgagtatctacaaattttgctttgcattttttttttctaagagagtttctctcggtatcgcatcaccacccttgtcagccaccaacatgcacgcaaagaaagcactgttgcagaatgagtttccgtcgagcttttagtttctgttccactgcaaaggggtcatacgcgctcagaacataaagcagtctgactggcgctgacaaccccrggacagcagccggctggggcagtgcaaaagcttcatgccttcttccccaaccaagaaggacttcagttcgagcccgcaccggcttcgtcaaccgcgagacccgaagtcgtagaccgagtccagtcctagggaattcggctgaggctttgccggcgcggcgaagaaggtggcaggcggcaggctgagctccactggacacagcctagtggcccggggcgcgcccgctgcactcccggcgtccaggtctggcgcaccgcgggaggcaggcgcgctgccactctccgcagccgcttcgtcccctggtctgtctcgcctcggcttcagcgggcaaacccacagctggtctcctgggcgctgatctccctgcaatccktgcttacataaggcgggcgggcgtgctcccgcccccggttaccccccagaggagttgtgctgcgccctctacgcctccttggcgagcgccttcgcgcacccgtgcgccctactctaggatgtgaacctccttggccacccagcagcgacagccgggacatctctccgccggcgtgagaacactgagattggagaccagagcgcctgacggtgcccaagcttcctccctccgttccctcctcctccaactccccccacttcaacccccacccccacccccacccccggtgtctgtgtgtgttcctcacaggcgaggggacccggagagcagtccagacttcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaaggtaagggggtccgccaagctccgcggccacctcccttagcttcttccttccctccttcctctcctcctccccagttctcttgayttcctcaatttgcctcgttgctttcaactggaaaccactctaaattccactttcccaactagtcaagaagctttgattataataataataatwattattattattatgtttaatctatcttctgagatgggcacgaatggaccagggacgaacggggtgtggacacgcagccgatccgtctccatacgtgtgggagcctggagtgtcttgtgccctttcagctccgcacgcgcacgttgttgcatattgcacacacggaggtttggaaagactctcggtgcgggtggctgtgtgacataccgtagatgcaccccgaagcgcatgatgcgcagaggctccccgcgctgtgccaagactggggtagcaggatcttcactgagtctctgagcacactagaccccgaagggcgctcagctaaggaaatgtgtccattactgtcaaggactcaaaagcacccgtccccctcgcctgctgcttcaggtgctgtggaaatacacagctcacccgaatccgcgtacccggctggaggcaggcccgggatgtgcatgcctctgcactcatacataccccgcttcatgcctgcttcccaccaggggatgtagaaatgaaaatcccggagctctgggggaaccggctgcttgttcaaaccaaatccgaaactccccggggtagtcgaccagtttataactctgacattttaatttaacgcctgtgaactttaacataagtgaccggggccctgggcgaagccgggttgggaagagtgtggccgggagttggggatgggtaagggaggaggggaggctccggagctgatcgcccggctcccttcttgtccgcctagtttgaagtgttagcagcagctcccagccttcaaagccgggaaagctgactggaagggagcgcagaagaaagagccaaggctgtcccctccggggtctctttcaggtcacctgggccccaaaacttctggccaagcccagctcctacttgggtctcttagcccacttcagtggtgatagccggctcaggcgaggcagctcagcttttcctggaagaggagagaatgaaggaagcttatgcagcattcagaggcaattcagggattctcccttcactctcggttactcttccttccaaatttggagagtaaagggaggctttacgatagccccaactccccaggtgatgttcagacaccctagggtttccggacagcattccctctgatcttagagaggygctgggggtggggatgggggtgttggaagcggaggagagcgcctagcataggagtgcggtctgggtggagaggtaagtgattagcaaggctttgtgaattagcgatagcttcttcggaagtaaattttcctgctgccctgctaagtggccctgctcataaatccttccttccyttctcgccagatgcctcccatccctgaggttctgctctggttttcttatgcacacctccagagttcatctgtctgtctatttaaaaaggaatctccaccgagaatcatagcttgtggatttcctaaaattgataagaagttctcagggcgctagccaagggtgcttagaggggggtgtttggaagcttaagtgaacaaccttatgaatagtcgtggaatcaaccgygcgactccctgtggaattcgcctgctgttactgggcatacaaaggactgagccatgggggtgggtggcgggagagggggacggggcacggtgagagaactgtttgggaaaaagacaagttaaagtccccaaagatgccaaacaagagataggattcctgctaagagcttacaataaccaaattaaaaagactgggtagaaaaaggatcaataaagataatcaaacagcagattgtaaatggattaatattgaaagaagaagggagaagagattaaaaagaaaagatgcttaggatagactttttctcttgcactttttgtagcgtaggcaagttaaagattggggactgattctcatcttaagtggaaaaagaaaatgtactccgttgggtgtatgcatttcactgcagttcttgtccatttcgtttatttagttccttcagtttttgattagtaaaatttttgtttgaatctcatggtctgtaaaatgcactattccaccgcttttatctttgttatcctccatgttccagggatagcagctcttcctgtgttgtctgttagttatcaaaggaaggataaagcaccaaactccactatcagctactaccttcatcactgcagtacagtaacccagcctgtttatcttgagccaccgttaacactttccttgcagaatcacacattttataaatggtctgatagtcagacctccttttccttcttattcttcttctttctcctttccttggactagaacactagcccataccctcaaggtatratttccttgtggtgatgacttaaagatccaaatgaactatttcttatgaatgaaagtccaagagcaattaacatgggaaagttactttaagcactttacaatgtggatgaggtttttattctgttgctgaagtactgcaaaaattagaagtatgtatatatatcttcagagataatcaaggaaacaacagatatttaagataaaacatagaataggcattatttgtgagtgtactgagttttgtaactgtggtttaggcagcagtcattttcaataggtccttgggaaattctctaggctgtaggcaacaactttctcctttctggctatgccctaattgtttcattcaggattgctgggaactcctagctccagggaatttgtagtgtttgtgacttccaagaatgaaagattttactagtaaaaggcagtgtgtgtgtgtgtgtgtgtgtgtkcgcgcgcgcgcgtgtgtgtgagatcagtgtgcttctgaattaggaccctcctggtttataaatgcattttatctgggctacacagcattgatatgctgcttatctagctccaactagtgttatgagtgttaacaccaccaaactcaggacaaaaaattactgaagtctctaattagattgggataattccctattatcttaattcatagtttttttttttaaataacatatgtcttcctacaaaagagtaaaaattcctttatgcatgtttgcatattggtgtggtacaaatagacagtcaacagtgaagacaactaaagttcattacaattctatcgtatactttttcattgtaggagtacagaaagtttatgaattcacattaggaatatgcaataaggaaaagtaggctagtttacttctgtttagaaaaataattttgtgtattctagcttagagaatgcttaaaatcttcaaagaataaacttttcaaacacttgcaaagaattaggaatcattagattataactgacatttattgactccctggactcctgtattctggatactgagggtaaagagttaaataagacagggtcctcgaacacctcctattgtagtttggagctggttgtcctagtcagaacttgtatgggtctattttaagcaaccccccctaaggacatgaacaaggcatgagctctgctaagtaaaccctgttagcttatttagaattattgttgagacttaaacataactgttctctaatgtatgctaggttctccaattagtgccaacagcaagtgtgctctattaggccttaactgcrtttaacacttttctgatttaggtcatggytttgcagaagcagcagagggagtcactctcagaagaaacattaaaattacaggctgcaaccactttaggaagataatggggaaaattgtgggggttgagattgagccagtgctattgccttgaagttttagcctacatatttttttagtttgacttttatatttgtggcagttaaaaacaaacctgttcacatttcctcacaaattagaaacaatggcttctatggatagagtatggtattagaagtaaagttcttaagcaattattgtgcactcatattgcatcytaggctgaatgctatttgttagaaacggaatgtaaccaggcagtttaagccctacaggaagacagaagtagaaccatggaattataattcactttcttaagtataaaagcggacacaggtatagtactttctggattcagacatccgaagatagtaaacataggtgaagctaggattctaatgtgagtggtgggtggggggttctaaaatttctacacagaagaacgtgggagcagtgatttggctggaagttgtatgttcttgaagctaagtttgcgttgcaacagcattttacttagatttaatgcaagtttcatctggctctggggaggcacaggctaagagctgttaatggtgtatgcccattctgtcagttaacatagtgattaccaatgtttcctaatactgcttccagcacctccagctgtgtgactatgagcaagacatttaacgtttccgtgccttagtttcctcatatgtaaaaatgaggataatatatactacaggttacaattagagcagcttttagctcatagaaaataagtattattccttgactttcaattctacaaaccgttggcaaagaaatctagatgtaaaagaaactaaaggtcaataattttgaactcagagtgatgatagctgctgacactgcttccccaaaagcaagaaatggagctatctgaagagatgctgcggagtagatcattgtaaactcctggacagagtacagttctctgaacagcctgtgggaatctcattcccttccacagtctcttttcttcccttctgttctctctgggaaaattaacctaatattagttctaaaaatgacacgttaagtcactsccagttaagtccttgcaagaagctcgtccttgactttctattttctcaagggatactgaaagataacttttcataaatccatgaacactattacagaaaaaaggtacaccccaggatttctgataagggtttggggaaaatcagacctttatgtgaatgtggacagtttttctttaaaagaaaatggacacaagtatatactctaaagaacataattggttttctgttcaaacaaaataaacataaaaataggtcaacacgaaggcaaagaaaattcaccagaactttcatttattcaaactatatttgcaataggaagtttcgttatcctaatttaaaacagcacagataatctagatgacatatattttggtgaaatatttgcatctaactcttattgtttaatggttattgccattctttgcatgtttggagcaaatgttttctgtcagacttttgagataaaataagagatttgtagggcattttatattacttacggtttagatttttctcctacaaaattgtcattctgcttctattattggttctggttctgcactctttcttttttaacctgatttcttaaacctatgtatggatgcttctttggtttcatttcttacttggatttgttattgcttatgtatttgtggaggagggctacatgaatatgagacctttggtattattccagtatctcttagctcaaggatgttttactcacagaaacntggtgctgttttttaatgctactttgaagtagagtaagtttgccttgagcgatattcaaacactagtgtttcccttttttctagttttaaaaaaagaaacttagtaatgggataatttatagtttctcttattttaaatatttgttattttcaaacttacagagattttaataaaaacattttatagkaacacttttatgagctaacaagatcagaaatagaaaacttttttttttatcctgtctacctgtatggagccaccagaagamtttctgccttttcatgaaaacccaaaacatatatcatgttgcagatatttggactctttatgaacaatatgtttgaaaatattgagctgaaatttcagaattaaaaaaatagttttgtgttgaagttgtactgtggttttttgttttgagcattrctgctccccaaaatgttgctcatatataatgagattttgaaatacacagaagaatgtttccagattttataagtatttaaaacatacctccccttctacatggagtacatagtgttaaagttgccatgacattaattaagttgaagttacaatttagaaagtgagctatagctttgaaagtgccaaatatgcagatatttgtccttaggtcagtatagcttttattagcaatgagcagtgattcaaaagtgccttgtgtggcaaaagtgaagtataacatctgaaaatccccatgtttggtgaataccctcttttagttaaataactaaacacatcttattgccaacgtggtagtggaatgtgagcgtgaggggagccgggtgaaacttcattatatagatatgcctgttagagttcttattttaaataccagggctcacaataatcatattaacagatgatattgattactcagatttaacaccagagttaccagtcttacttattttaaaatgttgtgaggatagggggttttatcttcattaatcatgttgtcatgtggatcctgtggctagtttcatttctcagcaattatgagagctataaaaatgcctcatgtagatgaccatggattatatcctcttctaactgacgatgtgaaacaacagaaactccctcagcacacttaacaagttcattgatgcatgctagtatttctcagttttagtcaatctcttaattgattatttaatcatggactgcctgaactctattcttatttattgttttctctctttttatttctgttcagaagaaccaccttatatgtggatatttctttccaataaaaacagaatagtgcttgtttattaaaatgcatctacagtccagttgtaagggatatatccataaatagaaatatatccataaatagaaatgcaggttttctcaaaattaaaaaaacttagagtatataataatataaaatataaatatgtagtacagaagtaaagcacagcatttgtagataaaagtgatcattttaaattaattcataaaatacattctcttagataatagaagtttagtgcaatctaatggggtacgtgatataaaagtatccacttataattacaagyaaaagaaattcatgtgcagcagtccttccttaaatgcaggagatactttccaagacccccaatggatgcctgaaactacagatagtatggaactcccatctacactgcttttttttcatctgataaccgagataactactaagtgactaccaggtggggagtctatacagcatgggtacattggatgaargagtgattcatgtctgagagattttgtcacgctactcagagctccatgcagtttaaaacttacgaattgtttrtttctgaaattttccatttaatgtttttggaccacagttgacctcaggtaattgaaactgcagaaagtgaactgcagataagcagggggactactttacctttactaaaggtaaaaggagcaatttgggactcttctattctctatgaatttgcatatttgttacttgtattcaaattcaatattttaaataattctaatatctttttggaatttcatatggccttaaaaaccctttgaagaactagatcaaagattatattttagccagtggtattccataacttttatagaaactaaaaatgatagtcagtgaaaagagcactatgttattatacatgatttttggagatctgtattattactaatcaaaatcaaacaagtaaccaaattattaccacaacaaaaactttatgattggaaatacaaagtaaataatggtaatttcactttgaactgtatgtctatgtgaaatacattgacatttgaatttcgtttttgattaagggaaaatgatatattttatctcattgaataaagtgtttggcaaatatacacattgtagccgcccagtggaagtgctcaagtttagcaagcagcaatcttgaagtcattctaaatgaaacattgattatggtgcctgtcattttatttagcaactttcctttttccttctggatctcctctgtaagatgatgaaagaataaagcttaaaaatgtgttagggatcaaattcaaggattgaaggaggctcagacattccccgccctgcctcccacagccatcacccacagagcatgcagggtggtggaaaacagaagcccatttgagtaactgctctcagaagctgaggaaaaacagacatgttcaaatgatttatttgtgctatccggaatagagaccctagatcagtatttcatcataatattattcaacaggccctctgacttgaaacttttacctaaatagagtcttgatttgcacttatttcaattaatatagcaaaagaatttgggaagtatttaaaaggtataaacttgtaagaagtttgaattttattggaactatttgggcaggatgtgcttgtttgagaaatctagatttaaatcagtgctatactagtatcctccaggggttttataaaatgctacttcctaagctactccgttaagaattgttgtcatttttatttttgtttatatttatacacacatatataaatctgtatagaattaaaatgaccacagtgaaaaatattatagtttatttactattacatggtaaaaaaaaaaaaagtagaaggatggctaggataagttttggcagtaagtatgttttcccggtagcaagggagaggagatcattttattggatttattagacgtggtgatcacatgaaagatacacatgccattttttattgaattaaataaatatggaaatatttcctgggagggtgtttccaggccgattcttaacgaaatgaagaatgacaaggagaagacaaatatagttcactaattccctgtgagcatatatgtgcttacacaaattgtatgtgagtgtgtgtgtttgtgtagctttttatgttttaggagcaagagttcattttcaaacagacttggcaatatcctcaaaaaaccaatggagtctatcaaaccaatggaaaaaactttttaacttataaaacaaattcataaagatagtcaaggacttgaaacttggatttaatcactgatttctgaatgaagaattatatcttacttttctgagaaaagttgccttgctcttggcaaattgcgaagtcatttccccagtttccaaagagatgtttntgtctcattagtgcagtggcttatctgatggaaacaagttctctcctgtcatccaagtgacagagactaggggatctccactttcactgacttgtttcaaagccgtggaggagaactgctgttgttttcctacacggtggactataatttgttgaccaaaggagactgtcgacttttatgcatgcagtgcacgcaggagtaaaatcctttcttcacatttatgaacccctctctgggtgytctctggaagagacagcatgtccctggtaagcaccctacatgaggtgacctctcatgtgggctgattgaagaagaggtcagttgtactgttcttctctgaccagaataaagtgatggtttgtttcaagctcttaatcaaatggagttatgtttgattttcttggacaccctcatatgccatattggtggctttatttccaggtttatccattacttccatttaaagctttatttaaatggatgaagataaagtcaattgcgaggaaggaaagcttgttactaaagaaagaataaacataattttattcaggatatagtgatatatgcttccttacttatattcactactgtattaaatacaggttaacatatgaatatttacataatacatcaatatataaacatatattgattattattgtcatacattcccatatcacttggcatttttgaactaggatttttaaagtgtgtaagtaaattctaggattaagcaaactgttttgaatgttttctttcatacatataccattcattgatgatgtggggttttcatagtgaaatatgtagtgcactgctaagaacagcaaaataaataataatgcattacaaagttttcagattacaagtctaaatcctaatgagggaggttgcctgtttaatgctgaatgcaagtttaaaaagagggtcttaaagataacagcggactccagagtccttgagtttgttttgcattcagtgacagtcactaaattagggaaaggaatgttcaaacaacacacttgaggaaaagtgatttttatagaaaggagccatttctgctaatagccagtaactgcacataaccccgctgacattaaaagtccattagctaagcccagtttcaatagcagctgatgcagtgtcagctaaatgtacattggaattttttcatataatgcagtaatagcagttctataattttttnccctaaaactacatacattaagtaaaacaaatgtcatctgatagtagtggcagggctgctaataaacaggcagagatttgtgatgaaacaaaagtaacagtctatataacaagaagataataaatagtagtgatggtttttaaagggagcctttgagaaaaatcatatggagaagcttaagctgacattcagaaagagttgtttccatagaagcacatattaacatgagctactttgagaaatttatttaaagtgaagtgattttttttacttttagctgagtgtctggtttttcagtgtattttgaaactatacgacgctccccccaccccaaacactgttatgtgtgtaaatgggagagagagtaacgaaattagaaaagagagcaagtaaaaacaggaatgtgtcctaatatttttaaggtgatcactataataatccttttgaaagtagtatgatgcattattgctgtctgaantgaaattgaagtttgacacacccatattatctcccccaaaagagttgcttatatatacattttttcatcttttgaatattttctaatcttcatttcaatcatctgaaaggcaagaagttttaccgcaaatttacactagtatccaaagttcattagtaagtcgtcctaacatattctctaggacagtgttctgcaactatgaagccattgtggagacaaacgagattgcttagtaatctaatgtgtgttgagaacagggcagtaattaatcagtggctgtcgtgcttacaccactataaagtattacgagaacctccacgccgaccttcccctcccctattatcagaccattagtgaagctctgtacaagtaacaacagtggagccctgcttaagcatatgaccccaatagcttgtggrtaagctttgtgagcattttcacaacggtcacttgaattctcattatactttctagtagtcagaattatttattcaatattctaaccagaggcatcacatcttttatttatttatattttaaaattaagtccatatttccttatatgggttttaaaaaaaaactctcacataacccatcatttgttggaaaaagagaaagcaaagaaaggaaaaggaaaagcttactcttaaccgtagtggggtggcagagatttccccctatgttaatagattttcatacatgcatttcttaataaaatcaagaggtactctttggtgttgttaactgttttaattcagttcaggccattgtaaaagcttattttgagtgatttgggagcttacatggtcagggtttaagcaattaaattactaaccaaaatcccatttactaacatattgcatgagggacttgatgaataatctcgtctttagcatataactcaaacattaataacagaaggaaatatgcctcagttcaagccatgggctttgatttttaattctaaacccattttatttttttcagactcaaatatctattaaaagtgactattttccatatgtttttccttttgtattgcataaaacttaattctattgtgaaatgaataaagaatgtcattgtatttggccacacaataaatttacacacatctatgaactagtattatgaaactgaattatgttgaaaataacaagatgatgccagactgactgaaataggacaattattacattagattttggaataggttttagaaaaaaattaccctgcactgttaatgcactgttactttcatggataactttaaaagtgtgttctttttttctgtatgaatgacactaaaaaaaaatatattgagtggctgggcgcaatggctcatgcctgtaatcctagcactttgggaggccaaggccggtggatcgcctgaggtcaggagttcaagaccagcctagccaacctggtgaaatcccatctctactaaaaatacaaaaattagctgggcatggtggcatgcacctgtagtcccagctacttgggaagctgaggcaggagaatcacttgaacaggaggcagaggttgcagtaagcmgagatcgtgctattgcactccagcctgggtgacaagagcgaractccatctcaaaaaaaaaaaatatatatatatatatatatatgtatgtatgtatatggactgccaacacattagagtatggattgatccttacttgattatttattatttatgcttataaaacttttattaaaatagtctttaataaytttcattttttaaagtatatcatggctgtgtttccttgagtgaatgctttaagtctctttttttccagctcaatctttctttaattgctagagaattaaaaatgtactggatgtgtgcatatatttgtatgtatgtgtgcacccgtgtgtgcgtgtttggatctgataatttcctgatataggaaatgaatcaaattactttgaaaaaaatattaagatgtacaaccaaatatattcatctgacacctgtactggccaaatactaatggcagcctttatctaagtctcttggtaaagatgaataaattgtgctaaaatatgtcctttgcaaattgcatacaagttaaaatcttagtttcacttcatattttcaaggcgaagattccaataataatagtatttacatcatagaattgtaattaacagcgtcatcaaaagtgaagaactgagaatagctcctggcaccaaataacacttaatgcacattagcaattgttgctgtgccgttttattcttatcatgtaagtctatgctatacaatgatttttcacttgacgttactatgaaaataattagatataagaatgacaaaattgcattccattagggttaccatcaggtgaaagaatgtcatatggaccaataaaagcatgttgtcaaaggtaaaattcttaaaataaattggtatgttttaaaatcacattattttttgtacccagttaggttatgagattctgattttacagtaaaactctttggaaagtcaacacacttttgttccagttttatgaataagcaagtttaggtgatttcttttttcctgtgccaggttctgaatctagaatatatttctataaaactactacttcataaattttaatgaaaaaaataagtttgtgcttttctccactgtacatttgctgtattcgtaaagacaaawataattagaaagcaggaagaatagttagcaaactttttaccctttgctaacatttaaactctttataaaggaacagaaacaattaaccttcctcactgtatcagaaattttaacacaacgaagtctttactgatactagtataaaagcaaaaattaattaaactgaaatttccaagcaaggtcaaagttctacatttgcnaggggacacattatagtataagcaaaaaagaaattaattaggtaccctactcttaaatatatatgttttgactgacacatattgcatttaataaaatattcctaaaatggactaatgaacagactagttaaactctatagtttctaacaagcatatatgtgttaatcatgatgtaattaaggagaagggaatggaaaaaatatccaaagatcatagttctacttgaaaatgttttctagtgtgtatttgtaaaatgaaagtgtactgttgcttaagtaacaactttattttgaaaaataatatgaataaagaaaaaacctttcagctacaaagaatactcattcttatttgttttggttcactgtracatttcttttatattttttaaaatgtgtcattgtaaaattaaaacaagacaaaacgtaaaaaattcttatcttcagaatgtgtcaacttgataggaagaacataacccaatatatttataacccaaattaatgcaatggtggatctttagcaaacataatgtaatagacgcattaactaactaaataaacaaggacaactcagtcaccacttcaggatgatacccccacaggaaacactttaagtaggtctataaaactgattcacttgtaattktctttgtccgaaaatcaggttaacactcttttatttttttagcccaaccctcctccccaacttcctcaagtgctgtgctgtagggaacgttccacgtttaaaactctgcagtcaacagtatggtttagtccctacataattataaaaatgttttatctttataggatattattccatctaaagaatccaacagaagcaactagaatgcttttaatgattgattaaactgcttatgtggggttttatgctacctagaacattgaatttgtaggaatttttatttgaagatttccagggaggaaaaaacaaaacaacaaaaaatatgagactatttagaatcccttctttcaggctatatctgtgttgttttctgaaataaaaacacgcctctcaaaaactaattttctgaatattaaactgtcttaggaagttctattgaatgattactgccttttttgtttttgttttcaaactaacaagaacgatgcttattttgtgccataatgtattatttatttgctattacttcatcgaggatgtagaagagcarttcagagagccaagttattcaaacaaataaagaattaaattatttcctggagtcccacatatttacatgttcacaaaaaatgtaaacatattcaaacatttgacgatgttatatttaatgatgtattatttaatgatatcacattaaatgataaaaattattttatcatttaaaatattaataaaataatattattcatattatttttcttgtttttttctttttttgagacggagttttgctcttattgccctggctagagtgcagtggtgcaatctcggctcactgcaacctctgccttccggtttcaagcaattcttcctcggcctcccaagtcgctggcattacagacgcccgccaccatgcccagctaattttttttgtatttttagtagagacggggttttaccatgttggtcaggctggtctcgaactgctgatctcgtgatccacccaccttggtctcccaaattgctaggattacaggcgtgagccatcatattatttttcaaaataaagttgttacttaatgattaaatgatgttacctaaatatttttaaaaatatgtccatttctctcaactggttcactgaagaaggttcttcctgcttcctgtcctttctcactctcctcaaacctccacactgaagtcaggaaaattctaagagacaccatcagtagaactttttttcttaaaaccttttttttttttttagctttactaaacagttacctttagaatatgatctgaacatcttaccatgactgacaggagtatttgtgctaccctctgactctattccctgtcattacaatctcccggaccatgaaccctcccaaatttggcacaggctgttccagtgcagccccagtaggtgacatcctttagggttttctcacaagccaccttgctcacttactatcagctttcgcttaagctctttcatttgctatgaacaagtgttaattcctcagattccctagtttagatcttcaccccttcttacagcaacctttcccatctcacaggagcactcttcttttccctgtgtccccagttggtaggccagcatgatgagtacaggaattgatgagttgattctggtgtctccaggatgtgatacagcttttggcacacagccagaatgtaatcgggattttttttttttttttaatgatgttgggtgaatgcatattttgttgatgcatacataacgcatcttggaaggactttgaggactcaggttggtaaagttcattgaaacttcccaggttctcttcatcacccactttgagagttactagacagagcaaggtgaatgtgaagttgtaggtggaaatcaagactatctcaggagtgagtgcttcccatctcttagattctagctaaaaggccaatctcctcaccctcagagatccatctctaacttcagactttctaccctgtgatttgggactattaactaatgaagaacttggattctgttgtagttgagcaaataaaccccagacaattgatgtgtaagcattaagagcacggttgggctctaactggtttggtcaattttgatttggtcaatttacctaaagacagaattgggaattaaagaggtgtacaagtcaaacagcactgcagtactgccagagaatctttccttttattcaactgtagaattctatcttatggaatattgacaaaatacattgactttcaagttgagtgatgaaattttgttctatattggggttattgttgtgccaaaaatcaccctatggtgtatttttcatttttctccactataaagtcaacaagtctcgtgcagggcacaatggtgtgagtgtgaggtggtgggaaaggatgcctataggaacaggggtagagtagtaaaataaagaaaaataaatatgttttggagtacatattaaacccagtgtttccctgtaattgactattgtctgaaaattcttttggtaggaccacagcctattatttttgggcaggatattttgattttttgacaaggaaatagtacagtgaaatgtatcattataaggtgttattgaataaaatattctcataagcacttttaaggtaaccaaaatatgttgtggattatgctacactgctagcaaagaggaaattataacaagtaactgcttcttgtttcctaagacttcagtaaacacagacccaacttgccctgcataattaccgcagagagctgtgcactggtctttaactggtagttgtttgtaatcaagcagcctgaatcttgctttgacataaagcagaggaagtggttaggagacagacctgtaattatcagcagcaggtgcccataatggaatgccagagagatgtttaaacattactttaggaaagacttcaagactgtcaatttagaccaaacagcatttaaggaaaaactggcttgaaaacagtcttaaaagaatacttctctggaaacaaagaaaaatttaagaatcccattaatgcaagttaacttagtctttcttccatacacctaaatactattaaattatgaagtctaaaacaaggctggactccactttcagaaaagggatgatttaacaacattagactttccggttattaaaaggtttatttatgatgtaaacaaagctttgttctttattttagtaagaatcacatgaatatattggatgaatgacacacttccttttttaaattaattttgatggtttcaaaggtcatcgaatcttgatttcatattcatatatgaccaaatatatttacttgtcaagtgctgcacaaaaatgcacctttcagcagcagttttcaattttcacttttttttctgaaaagtcctttctaaatacaacttatgaagaataataagccatatgataagatgctgtaycttcgatagaaacttgtaatcatgttataaaggaactgttaaatgtcaattgatgatgccagcaccacttttagaaatgcacttagcgttgttattttgatagtgcaatatacttcaatatttctctcaagctatgcactactgtggttagtattaacttacaggaaattctgttgtatgaggcatagactaaagaaagccaacaaaacataattgccttggtagtgttttgcatttttaaatgaagaattttatttttctttcttttccaagtaagaatacacttttgtgtttgtttttctgttgtgggagtgaatgaactttgtggaactgaacacctcctaatggagaggggagtcatgatatatctgtatgaccccattcattaccagatgtgcttagcatatatttttggaaatacttattttcctgcctaatgctaactatatatttatcattatgaaaacaaatggaaaagtcaatcattcactgcacttgccagaaatgccttcagctcccacaatagttatatgtcagaatcttgccccacttaaaagcaagacagaaaatttattctggaaatttaccaggagagaccaaccctcaaaaatgtaaaggaaaatatctctgtagctaaataaaaataaacttaagtcacacttgatgcattacacttaagatagccccatctaaaaatatatatgcaagttgcagagcatttcagttgttgttcaaagtggacaccaaatatggaagacagattcaagaattacctaaacttcggtggattaaaaaaggagtgtaaaatttttatgatttgtcatttgtctgcatattttgacttatttggaattcttttttcttacattgtcaagtaaattaaactaagcctgacattaggcacacagtttatgtagttgtaacaaagcatcaaagtaattgaatyctcgctagggaatttttaaattaatttattattaccattttttttttgagacagggtctcgctctgttactcaggccgaaatgcagtggtgcggtcacagctcactgcagcttcgacctcctggactcaagcaaccctcctgcctgagcctcctgagtagctgggacctacagggatgcaccaccctgcctagctgattttttagttttttgtagagatggggttttgccatgtttcccaggttggtcttgagctcctggtctcaagcagtgtacctgcctgggctcccaaagtgctgagattacaagcatgagccactgcacctggctggtattctaaaatttatatgaggataaatgtgactagaagtatagatgtggaactttgtatatatatattttttatgtatatatataatatatatatacacatatatacatataaatatatatacacatatatacatataaatatatatacatatatacatataaatacatacatgtaatgtattctctcaaatcacaattcagtttagtttttttaatggaggaaaaaaatcagtacagctgagatgaatccaattctggaagtattagttagtatatcccatagagagaaatgagacagaatagcataacatatggtacctgcctttaagaaacttaaaatcttgtcaggatgataaaatattacagataaaatgtataaaatcataagctggtaaacggatatgaaaaaaatgaataaaaatattttggaagagattaaaggagagataaatgtgctttgttaactttctgctggaatgaactattacctaattttcagraaaaaaaatcaagtaacaactttcattgcctttaataagaactgttcttttaactcacagaggctactggaagtgttttgttacagccatgtacagttatatcctctcatcgcctctttccattttcttcacctttcaacttgagagcctatcttccctggggcctctccttttaacagctcttgtctttaccttgaagtggggagctgcacagagtccctgtctctaatttcttgagtcgctctctacttggctctcccagggttatactacatttctgcagtgcaaaatgagcctccaatccaaatttagctgttttattacatactctgtagctaagccactttaggccagacattaccacatctctcagcaacagagtttgagtttgtcaagttgtgcacatttgttgtctcctttaaaatacagttttacgtcttttaaaacttgtttggattttgagtaatggtctcattggtcctctgatgtttacaaaatgatgtcagtgcttgaaggtaaatggtggcaacgttagatatttctccttttccttgaaggccgtatgaagggagggagaccccagtgcatgaatctccatgggtgcgaaaattgatagagttaagcacaagcagcctgtagaactacttcaaagtcagttttagaaatttctataattaactagaattcttcaggtaagttcaaatcaaaggggctagaggactttgtatgaaggactctgaaaattagattttaaattcaaaacataagaatgttttgcctaacagctttcacaaataagtttcaaaacataaacagattgttaagagatatatattaattttaaatttgatcatgtaataatttttagaactgcaatttccttactctgtaatcctcccactagtaaaagctttttgaactttttcttatgtctttgtcatttggaaaaactaagagtatttttagagtaaacagtgtataggatgcccatgaatatttctgaagctctggtattttctagttttaggaataggaatgttgaaaacaaaaatgtgggaggaatataggggaatagtgtaaagtgattttgcaatatagtgtcagagccatgcctgtggtaggcttttattaaaaatttctccatcaattgcattaaaaaagtaaagaaacttcatattctagattaataagaaaatcaccccacattctctcaaataaagtttgcataattcctatgaaattgcattcttttcatttggcatggaaattatatgtccataaaaataaatttcatttttctttaaataggtaaaaatagtaattacaaaagcaattataaatctttactatgttaaatatatatgcacacaactatgtattgaattgacagctatatgatagcaacntaaagaccatgaggaaagacggaggctgagaaatactccaatatttaaaaaaactcaagtttgcacagcttaccaattaagtatcaggagtctttctttaatttatcaaatcagtttggtcacactgatcagaagtcctgatttgcagttgtatatttttgtgatttaaagtgagttaatttattatttcccagtaaatgcaatttattaagcatgaagtataaaacaatgtcaaaggcaggaaaaaatgtttcaaagtcctaagtgaagtaaaattaggcaaatactattaacgtgtgtgatgcgtttttgttgttactaatatattgggaattgaaattgacagcatctcttgagttcagttaatttttgtcactggattgtaaaagtaacttgtttgaggatcttcatttttaggaagtttgtgaatagggtaaatgcatgggtatattaactcatttaaatacagagttttgcrtttgatttttaaaatattgtcacttaacttgaaactttatcctaaaaagctatcatactatgcctgtattaaagacatgttttgctttgtattattggtttcttttagtgctacatattcttttaataaaattcaactttcagctaattttatttattaaggacttagtagaaataattattcttttgtgtttttattgttactttgtactattggtaacacaaccatgttaaaatcattttttttcaatccacatgagtagtttcatagaaatacagaacaaaattcacattgtgaaacatattttaaatttgggaaatgagaagaccatttaggccccatattcaactttttttttaactttaattcattatacaatgtttagaatatagttttttgtggtgattatttaaatactctgggatttaatttgcctttgaagacacaaattaaaaacttgatagataatggaaatgagacatttgtatnacttactaatttggtaattttaacctatttctggccattttttgttattgcttagtagacttaaatttaaagtatagcttgactaaaattagtgtggaagaatatttatttacactttgtattgtaaatcttccttttagagcattttcttcaacaggttcattcttattaaacctacatgtctgtctatctacagcgctgcatgaaagattgggtgcattatagtgactcagaggtagggagaccacataatttattgcctaaattgggtcatttttgtgcaggaaagggaaagttattaataattgttcctttacaagtataaactgagattgtcctgggtaaacaagatggataatcaccctaccaggacactgcaagatcatgtaataccttcttaatcactaggggaaaagttagatcatgctcacagtggatttagaattaaatgtactatattctgtgtctttgaaaagtcgttgccctttcatgaatttgaagaaaataattgattagtcagaacagttatcttcttgcccatgtcaaataacagagtatgctttacctgtgcacctttagtctttcattaagcctattcgaatttttaaaattaaatgtgttttagaaagtaacacagttggcttcttatgacagatgatttttcaaaaagcctagaaattaagatttgttaaaccgggaacaagacaaacctagaatctattttgccagagttgatatagcccccttacctcccattcttgttagctcttattccaccactgggaattgtcactaattgactgtcacttttgagtrgagtagttactctatacaacaacagaacacaaaacagagaaaaccttgacagtaactttctgtaaagtttatttgcttgacacttccacatccagtatcttggactttggcaagatatattagctgtgtatgtctttttttttttttttttttaagaaataggctttgcacactgctatgaaaattgaatatgggttttttaatgtactgtcttaggtgagaacttgagtatcacatttcgagttacatgtatttcacatctttttatcttgtgggatttacaaaaatcatttgattaaaaatttctagaatgaaaaacaccagcataaatcttgactgaatagaaagagtgaataatgataagtacctggagtcatgagtttcaaaacgtagttctgcaaagttataagagtatatggctggaattttgctcaaagagaattataaagcagatataatttattttagtacttgagcattcctaggtattttaggcagaagaataaacttgagggaaacaattagttctatttactcagttagaactaatgcattaggccagcaacacaggggagtgcattctcagaattgctgctcttatgtatgttaaacttccttttggcatttgagcttccaaatgtatcccatcaactctgtgtgcagtgtttctttttttgacaggagcatttggagggagggctttctctaattcaaccaggcttcggtgacccattaatttggcatcatttttaaaaaagaacaaatgagaaactgaaacccagatggggaactgacttgccttgtgttcagaaacttgacctacccagaacatatattttacagatgaggaaacagacccccatagagctcagagttcacacaggagttaatgtagaactggggctacaactcatgttccttggctcccggttccagctgctttctaccacacagcactgcatcttcagctgcccccatgcagatttatattgcatgcctctgagtcttatgcttccttggcaaaccaggcagtcgcaagctccagtgcctactgggaccaatgaggttacgtgagtaagtgggctgaatgtagtacaacagattctgctggaaagtgtggtgaactggagagcacatgtcccgtctaaaacaaaagactccaggttctcactgcaggaatatgggcccaatatggtggcagcttccagttttccaagaaaacccagatctcaatttttattttaaatgtcttatgcaggacaggccaaagaacatgcatgcaggtggatatttgccagctgcctgacagattgcagcctccacttaagtgcatgtttcttatctccctaacagcagcaataataatcgcccctgttgcataaaacatgcaaggcatcatttatgtcttatctcttttaatcctcacaataacccagagaagtgttgaagatgaggcactgaggctctaccagtttgaagtaatgtaccaaagtcaaacttagctaaatgcagggttaggattgaaacatagatctgtctgatcccacagctttcaatcttaccctaacacccttagccttcctgatgcttcatccattgctggttgaattaaagctaccaaaaatctatagagtttttcaaagtccatttcaattcaacttttccaacatgtttttaaacgtgtattgaatcatcactatgcaaaaaggattgtgtgctctgaagaggaccaagataatttctagaatttaaatcacttctctcgtgcattaaacttccaactgctcattttgttggcttctacttgggctgacatctatttcttcttatttttcttccaggaaaaaaaatcaataaattatttgtgaaccttttatagaaatggaattaaagcttttaaaatttttattaggggattgatacttttgacatttatttctaaaggtaacattgtttgaatttgatttattatgtatttggtaattggaatgctaagtgactacgtttacatgtgtttttttgtagtacatggttttaacagcaattgtaaaaattattttgttattaattatcttgttctttcaacttccaatatagcaacatcctagtcactttggtgaaactagcagaataattttttgaaaattgatttctaatatttttattattttttctctctctccctctctagtacagccatgcattctttcacaagctatacccctaatcagttgcatagacacgtttcattccaactacagtcataacttttcatctatcctagtgcccgtttctgctacgtgcagagatgatcagttatgtcaaaagaaaggtgatgggaaatctctaaggaatggacacacagtggatgctgttgctttcctgtcctatctcctttactggcccagtgcacacatcccccagctgctgtcctgttggcggctaaaggctcacagctgcccccttctcccytctccaaggaatctcctttgactgaagcaagagctgctttgcctggtaggtttcctcaaggtgagaacaattctgttgggcagttcatgctccagagggtccagaggcttggtgaggctgaagcttgcctctggtggagaccacattcttgctcagcccctcctctgccctatcctgaccatctcactctccccctttcctgtgggtgtccctaggtgagtcacattcacagactccctctgtggagctcttcttttagggaatccaggcaaagataagacaaggtacccatcagtgttgatgaaacacactgtaattttctagaaaatgtgcctgcaactgtggggcactttcgtttcttgtgctttgctcwrgtccctggcattgcagaagaccagaaaccacagatcttggagtgtttgaatagaacaattacgagaacatgtgacatagaatacaggatagtctccccagcagttccaarcacagataaaaactcactattaggagaaaaagaaagaagaggttaagattaaaatattgtaatgatttcaaaaattattctggggactataaagccctttgtattgaaggttaatggtgataagagaatttactgtgattttagaggttgactctcaactctgaacttttaaagactaattaaaaagtcaggatactttcttttcaccattgatttttttaagcttttttttgtgtgtaggttgcttttcatgttaacttcttcataaagatgaaattgttaaaattttaatataacctctcattctgtaatttctctccctctcttcctcccaaacctcttctctctctccctcatgtctctctctcatgcacacctgtgtatgcttttacttttatatcttcattcagaatagctttcatccagcctaatctatttttactgaaagaaatattagcattgcactttaaaatcgattgtttaaagctcctgcccatttggagggtaccaatgtatgaacaattgaggattttatattttaaattattttataggaagggtattttccaaacttttaaaatatagagtattagagtattacttaatatatagaaataaataatataaactatacctttatacaatgtttaaataatgtcttttgtcacatgcatctgttcagccagggacttatttgtagatgatcttggaaaattgaatacgatttactatatacaattatattaaactagaaataaattagtggaagaaatatggtcatatttttttcagaaaaaagaaatgcacatttctgacatttattttcagtttgatattcattaagttgaattacacaatttgtaactgccagttttctcattcaccaagccaagaccaaattgaatgataaaattaaatagaaaattatgtttactttttcataattgcaccatttagtgttatcccttgcattctgtgatatataaaaatggataggaactttaaaaaatatacantcatttctttttagagtccacawttttggcaagtattttggaaggtttatgaatatctacgtagctttctcacatttttccaatggatgtttgctatggactgaatgtttgtgtctctccacaatgtgtatgttgaaatcctaagtccccaatgtgttggtatttggatrtggggtctttgagaggtaattaggactaggtgaggtcataaggatggacccctgatgatgggaatcaatgcccttataaaaagaagaagaggccaggcgtggaggctcatgcctgtaatcccagcactttgggaggccgagccaggtggatcacctgaggtcaggagttcaagaccagcctggccaacatggtgaaacccygtctctactaaaaatacaaaattagccaggcatggtggcacatgcctgtaatcccagctactcggaaggctaaggcaggagaattgcttgaacccaggaggcagaggttgcagtgagctgagattcacgccattgcactccagcctgggcaacaagagcgaaactccacctcaaaaaaaaaaaaaaaagaaaaaagaaaaaaaaaagaagaagaagagacactagatctctctttctgtatgtaccaaggaaaagcaatgtgaggatataaccagaaagagccctcaccaagaatctaatcatgcaggcatcctggtctcggtctccagaaccataaaaaataaatgttgttttaagctgccttgattatgctcatttgttatagcagcctgaacccatttaagacaatgtttcttggaggggtactaagatagagaggggcatcattattttcccaggctacayaggaacaacaggtacccaggttacaataaagaggatatactaggcygggcgcggtggctcacgcttgtaatcccagcactttgggggccgaggcgggtggatcacgaggtcaggagaccgagaccatcttggctaatgcagtgaaaccccgtctctactaaaaaaatacaaaaaattagctgggcgtggtggccggcacctgtagttccagctactcgggaggctgaggcaggagaatggcgtgaacctgggaggcagagcttgcagtgagccgagagggcaccactgcagtccagcctgggcgacagagggagactccgtctcaaaaaaaaaaaaaaaaaaatactagatagtttttctgaaaaatggtttttaaatgtggctttcttgatggctcaagaaattgcagcttctttgttccatttcagtcatttatccaaagagataatgaatatctccttaggcgaaagtatttatatcagagttcagatacaaacttccatcatattttcaccattatgcattttggagcttktcacaccaactaatataacctgacaagtacaatgagtcaatcggtgttaaaaaatgaaaaatgtttaagtgttgaattttactcttgacttatatttgaatcttacggtagataatccttatcttttaaaattaattgtattatcttgaaagaatgacacgacaaaatatcaatatacttacaaatatattttatattctatttttagaggtgatatgatctgtagaaagatctagagatctcttcctaggttgagtatttagagacttgataagctctgtgaccttgggaaagtcattttacctttttggagcttcaatttcttcattgatctcaaagtgtttggagtgttgcgagagattcctacctacttcctcttagcggaaagcataagaatccatcttgctttgctcattgaatggttttgtataattcccagtggttcaggcactgaatgtctgggttaatgactcttttgggagtacagcttcttcattatgaagtcagcatgttccaaaatgtctttataaatcatctctattaaagatgcaggcatttgcagttatgcaagacaaaaataccttcagctatgtttgcagtttaggtttgaaggaaagtagggcagacagtgggagaaatgggaaatccataaaaagtcttccctttctgttcccttatgcacactgggcaattaaaacacatttaattgattactmttccaattaattccatcactagtattgacaaaagaaactgtttgctgtgaggcagttaagcaggtaagttgaatttactttagtccaatgagttccagtcaaaatgttgcccaatcagcagctgaagtaggaaaagtttgttttttttttttaaatgtgctaatgtgtgcttatgttagcttttctgttgaagttttttgagttaacaatgcagtgttttgggccgttggtcataaataatggtgttggcagtgatgatgaaataaacttgggtccattctatgggtctcttaagggggaacatcatttaatcattctggaatgatcagagtggtgtgatggcctctaaagaggtctctggtttcccctccagatggattcttattcctctggggtcttcaaggtcatgctgaccttattgtaatagctagataccaggtcctattgctgaatgggcctcagatgtcaattactactcccctagaattttttttcttaacccatgcttgcagtttagcagactactcaagcatcataataaaattctctttaactctctatactctatgtcttgaagcaacatttcccaaatgttgatttaaccatgaagcaagtttcccaaagtatggtccatggaacactagtcctgaagggtgtaatacctaataatccatagaaaatagagactttctctagtcaagtccctcccaaccccaactctgagcttcaaaatgaaattcaaataagacactttgggaagtaatactttaactttattccaatctctctagttctgtagtaccaaggtatccaagtcaacgtatttctcactagatcctcctttaaaaaatattgtataagcttacttataaggacttaaatctttggagagcaacctcttcatcaaagagatgttaatgttttatttaattatactttgaaatcaagtaaacctcacacaaagtagatcttgtttgattgcttctttacaaatgaaatgaaaacatgtatcttaaagataaatgcctgaaaagcatttttaaagtgaaatgattgttattctgcatattgaaaattatgtataagtctcttccaaggtgaactactggagtcacagttaatttcctaggcctttctccgtatttatctatgtaacattgggacttcagatagttttctgtataaatatgcatatttaaagtcaatttaaaaaatattttgactntattttgcagcataattatgaaatcagatttttccatttatattatagttttacagagtttacatcttctcattgtatatggagtcttgtctttagtgacctcttctttaggttacaaaattaacagataaatgaggtgttgctagaagaaagggaacaaggatcatctttttgttcaatgtaaatattgggtgctagatagtccatgatttatttggagtgagaaaatgggccttgttttttcagacactatccccagtgacacataggccaaacataaaggagattgcctanccttagttctggaattctgatggagcaaggccttctctctggtgctttattagttcttggacaaggactgaagggttatgttgaataacacgttcactatctcagtcttttctcctcattaaggaaaaaagaaatctgccataatgtgatccatgattagagttaatgcagtctctaacgtctcccagatgttttaacgtcactcacgtcacttgcagagtttataaatgtgatttgtctactggtttattcctttttgtagcaaacattatctttctgcttgagaaaaaaaaatctaaatcagagactcaatgagttacttaacataatttacagcgtgtttagaaacagtgctaaaatgcagagtatgtaatcaatggcacattctcataaagaatgtatttgcactttgtaacagaaacgtgatcatgccaaaatgaccagatgtctcttcttattggtatcccgttttttggtactgtgcctccattccaacttttcatggccataaaatattttcctttatttcagtacagggttgggaaggctgtaatcccaacctggaagagtatatctttgcagtattgggttacaagtttaattttcaaaattgttatctttatcctgattttttaggagcatttcaataagattatccttttttgtttaagtttctgcatgcattggttcagtttttagttttgtgtatatgtgtttatgatacagatgggactccctctttttcctttcattgtgtgtgctaggcaccctacctcaggtagtccgatatttatgcatagtcagcctgaatccagtataaggtcactgggagttagaaatcccctanttcatggattaaaacataattgaacaacagatgaagaagatgcaaatttcaagaagtaagaattgtatttggaggaagcagggattttctgagttggatttgaggaataagataacagtatcttgcatttaaataacagtttaatatttttatcattattatcattaatcgttgtttgtatctcgctttacaatttttaaagcacggttcatatgctatgacatttggccttcacagttagtttttgagaaaaagaaacaaaattgatgttatccctagtttacagaaaggaaactgatcagtgagtgactgagccatgaacacatccttcccagtctgtgctgttgcatgacatcatgctccccggaagcctctatcctggggacttcagttcccttttcgtagtgctctccatgtgtatgtacaacaggaaacacggtaacttggcactcgctgtaggtcctttagggcacacaggaagtgtcattccaagaagagattttaaaatgcctggtcgaaatgaggccttctgttgcttggctctccaagatgataaacaccagatgcagacattgatgtaacaatgattatccaggctgatgagcatgttactttgattacaagagccatggacttagaagcaggacttgggaaagcttcgggagcagcaggagattttgcaaatccattactccctccactctaaaggctycagcgtccactatgaagagggcggccgactgccactggcatttacacacactccgcccccagctttcaccatacaccaatcaaatgtctccgaaaacagggaatttggtctttgtaatctgaaaagtcagcccagcttcgagcagtttcacaaaaattggagatcatgtgtgctttcactcttcattggacactcagtgctcagcatattttggttgaagaaatggaggatattccaaaccaaagaaccttctgtcccagtcaatactgttttcatttgcttgatatttagaacctccagtccacaaggttcacattgaagaattgtctgtgaggagccatatactgggacaaatgaagatatcatattttagttaaatatgtgctaatttaaatcacattttatttttattcaagcagtataattaactataactgaattatttttaaggattcaatctgaaaacayaggtaaacattactaccatattactgagaaaaaatgacaataaatatttgtttcctacacagatgatccagtccaaaagcatgtacagttacagttaattttttacttgatttrtcctatttcagttcactwcaacgtttttatatgaaatttaatatattcatacatacatgcacatagagcattaatatatgcatacatacaaaataccacatcattagggattgtttggttaatgtttacacaaatttcatgacatctatatacactgtttagactgccaagtttttctttggatgaagccagcatacagccctaaaataggaaaatatgatgtcaaaaagtaagaattgccaaaattgttgtttgtgtgccaaaattgaccttcgttttaggatgcattattgcaaataaagtcctgtgttaggttagatgtggtaggtgttttttccccttagatctgttggatctatgttgaacatctgttgactattggctatgcatagtggatgattacagctatttagctgcattatccatgcttaacattcactctctaacataagggaaaattttacatgctttcaattatccattttcctcagctaacaaaaactgaggctcactaaggaaaacctaatacgttaagcagaaataccttaaagttcaagctattaaaatactaattaagaattctgccattgggatttcattcagactatagggctgtgcagattcaattctttcagtattacctactaagtgtttaaatttgggcaaacccttaacattctgagcctcagtttgtccatctgtgaaacagaggcagtaacaccttacccaaagactctagcaattatttgagaagatacatgtgaaagcagcatgtactataattaagaaataaattacaattattaaattaattacatatatactactagaagcatatattgtataagaagtgagatattcttgatgctatttctaatcattgttagctttccatgttacatatataaagtatgtgtaaaacagttgattaatttcctgtcatttaagtgttataaataatatagtcctttgcaaattagatatatttaagatctttcattatggagatggagaaatatcaaggaatatatcaccatttaaatatctcctcatttagggccaggcatggtggctcatggctgtaatcccagcactttgggaggctgaggcaggtggatcacaaggtcaggagttcaagaccagtctggccaayatggtgaaaccccgtctctaccaaaaatacaaaaaattagccaggcatggtggcacccacctataatcccagctacttgggaggctgaggcaggagaatggcttgaacccaggaggcagaggttgcagtgagccaagatctcgccattgcacaccagcctggatgacagagcaagactccatctcaaggaaaaatatatatatatgtgtatatatgtatatatatatataaaataaataaataaatatatttatattgctgctcttatagaacacacaggctaatgtaagagataaacactaaagagatatatagaaaggaatttaattgtaattgtgataagtaccttgaaggaaagatacagtaaattatagaagtatataataactggtggagattgccaaagaaggcgtctcagagatgatttaacctctaagagagttcaaagaattaaggccaatagaactataaaattttgtaaattggtcaaagcataccaagttcacccacatctctgaaatatctgaacttactttatatttatacctaattaaggagcctagattatttctggtcttcccttaatttatatgcacaaactgaatatagacatttaaatataaatacaaattttgttactattccttaaccagtcaagcttatctataacagatttgatactgggttgttatttactattgacaatttttgaacaattatsttgtatgaacatgttctgtggaatgagacgatggaaaaatgaggaaaatgttactgtggaaatgacaacactggttattctcagaaagcttctttgagaaacagggagtttatttatggctaatttagcgaatttgatattgattctgaagtataccatctgcccagatcatggggtagcacatattttatataaccccaaattattcaagtgatgggctttaaagtttaaaagaaagttaggttaagcaatttatgagctctaaaattaaaatctatgtattcgcaaaacaaatgaatttcccaaataagttngacatacatttaagagacttgtcatgatggttgacaatacatgagcgtccaagaaaaatatatcgaagtttgaatatttcaaactcccagaatattcaaaaggcttttgccagcctgctctaaagctgttgcgttaatgcctgcccctccttcacctgtttctctcttaaatttgatgtgatctatctatgtatgtctatatattcagcaatacaaataaaataattgaaatttacattttaatgtgttgtcttcatgtgtcttgataatatatattaagcttgaattttgtgaggaaattaatatgatttactaagaaaatttcagcaaaatttgtctattaatgaggggaaaggaaaagtagaggtcatacttaataatgctgacagatctttatgtttctaaaagatttcagtctacatcagtggaagcaatgtatattagaatgtatttgtttatccaaccattaccttcttatcacattaggaatgaaggcaccacttagcacactgggctggtgtgcgcctggcattctgaaccttaatctgactaatgctcccattgcaagatgtaaatagattacaaagaaaaattcaatattttctcccttctcccaccagagcagcccacattagttgtttcctgccatataattgcattacatgccgggatgtaatccatggttaatggcagtcacagtcaactgtcactttgcttttagcctcggtcattcagtatgatttacatatttagcaaccatgacgagacctagatttgtcaaaccrcttgtggaggttgtgatgctaactgctaccaagaaaatttttgttgttgttgttgaaggacatctttgcaggcggtaatgcacrtagatgcagagcatctgtaatgtaaattaattaatttatcaagtatttttgtgtccttaaaaatatttactacattactggattaatacttctgattaataattttcattacctggaaattaatttttgttttagtttcttatcaattaaacaaacttttaaaaataaaaaaattacttttgcttagtagtaacaaacatataaacttgtctccataaacctggcataaaaatgttgaaaatctaatttatcacagctattaacaaaacatataattgcatataataaatctttgaaccccattgaaatgtcagagatggtaaattttaggagattttgttatgtaaaattgatatcaatttaaatgcacttaagtcatttagttattcatatgaaactctcctccctggggtaacttgaatgcccaaagattggcagaatgaaaggtgaaggcctctcattgctttattttatacatgaactctcttttcagaaccatgcctggtttcccataacacatcgttctgggagaagagggttaaacaattattagctgtgagtgaggaattcttattgtttggttgaaaatagtccatccagtttctttgtaaaaatcccgatgatctgtaagcctaagaataattgccttactccaatccacttctcataccttcatcagagtggtgtgcctgtgtgtatgaatatgtatgtaaaatacaaaagtaatgattttttactttatttttgcacaattttcgtgtgttccctcatcaagttccagcttgaacctttaaatgtttcctatcgccaacttaaaggaaatcacagttccctgtaggaatggggcatgccaggtcctccaccttctcgctcctgcctcctgcctccttctccagacccattttcatttccatattccacttacagtgccatgttctcccagcacttggtgcccagtgtctgatatgctacttccttcgcatctaacaagtagtcacatacccttcaagtttctgccaaaacaagatgatctgaacaaagcaaccttcttcccttgaatcttcttccagacaatacccagaatgtagccccttccccaacttcctcagaagaaaacttccacctcttcatttccacagtaattggtacatatttaaatttgtattgatttttttttccattgcattggtctgaatgtcgacatctttctcccacatgtacgagaaaacccttcaagggaagggagtgttgatcagctttatctcctatgcatctagcaggggacctagctaaaatgaaagctgcgttgagagcagatctggttactgttgtatccatgaaacctaaatagaggttatgcaagtatctgctgaaggaatgaatcagtgtacctactaagtgaagagatgtggattgtgttctggtggttcaacatttctctatcaatttctgtatcttggtgttcattgttttcctccatgtaatttaattatgttggacatttaacacttttaatactaatggcatgtggaggagaggcagcttccatttttcctaataattcagcagagcatttctattatgtctagcctgccataaaaatgttgacgtcagaaaacactttgatcctgatattaacactttgatcctgatattaaccctgatattaacaaaagcaatcttttgttaaagaaccccccgacaaatacaattaaaaatatgcaagtgttgctaaactctcctttgtggtgcttaggtttgtcttctgccctgatattattagcttctgctaatttgacaaggtcagcagtggcactatctgccttgccattatcaaaggttgtaaggcatttctcttggatgaatcacaaaatcattaacttctctatcactgaaagagcttcccagctattctttctgtctttctgaatcaatatccccagggtatcagtgtccttttatattcaacrgaaattatgaaatcattccacccgtttctcagggcactagctaatggggacctgaagaagactttaattgtctctgacaacaactcaaccacttttttcttcatatgtggatcctgttctgcccagtaaaagaagggacaaaccaagttaggaaaatgccgaggcaaatttcggacagtgttgaagaatattccacaggcttttattaaactcccattctatggagattatataacattcattaatgtactttataccaaaagatgttccttgattttcagtgtcagagatgtccaagttactgtatgacaacttgcctgggaaagtctggttatttgatttttctacagcacactacccttaaggtaaaaatttaaagataataaattctgaaggactaaataacattaaaggaatgtattaaaaccattttcaaatctatatgcctatgtgtatatgaagagagaactagtacagagatatatntatatgacttgctttaattctgtattctcagtggctggtacacagtgggcactgaaaaaatagttttgaataaaaaattaaggaaaaaaagaatgattattagmtatagctagtgyttttaaggcagctatagtcattcacgtatttataactgagagcagagtgtggcttgccctctagtggtctgttttagcgaactttaatcctggcctttgaaagataaatatttacttgataatagtaaagtatttatagtaaaatatttacaaatggatggtaaaataattttcatttttaataaacatatgtctaataaagctttcttttgtccattttaaaattttatggtgaaacatcaaagagaatttggaaaactagaaataaaaggactttaccttttagaaaaatgaaaatatttaatatatgacattgatattttaagccatatattattgttttttagttatacttccaatttctgtgccttacgtaaaatacggagaggactttaaattgtttttcctgtcttctattacatgtcaagtgtttcacagatggaaaacagaatctatctaacaatattgtaattatcgacgtgaaacgcaaacgcactcttcttttggaatgttctaattatggctacttaggaaactactgacaatttatatactagtgtggctgattaatacttaccttttcatgttatttatattgtttatatttgattactattatgcaaataattatttgaattaaaatggcctgctactctaacatcaaatataataatatactgagaatacaattaaatgaacatacataaacacatttcacgaaatgtatttttctctcaagaattcactaattatctagtaattgtgttcagtctaggtagttgcagttatttttaaatgaattaataacagggtacacacattttaaataatattttaagcaacaggcatttaatcagttatgtaaaagaatggatgtcaagcttcagattttttattaaatttcttcatcttatttgttgattttagcatctttctttattttagtttatgatttatataatagaaataaaggtggaatttttctagctacaattcagggcctagaaattaggagttgagggctgaaatatgtgcaaaggagcatagaattatagactaagattctgtgaggaatcaaaactttagtctgtattgcactatactctgacttactatcatcagatataacattaatagttatattgaaaagtataggtacagactgcaaaaaaatgtatggttactagaaaaaaactacaaaaaaattttctctgggcttcaaagtttttaattgtgataataatcgagaataaacttaatcagatgttattaaatattttttatttttggtattccacttatatatgtcaaaattcctacttgttagaaaattaagcttttcactcaattctcccagatttacttaaactcatttttgaaattcagcattatgtaggaatgctacatatcatttccataggaaattgtgactgtaacaccagtttcaaaattaaaatgattttcagttctcttcctgaatctagaatattcatgtctagatttctaatagtttctggaagaaagaagatgtttactcctccaataaatttgggatactatattaaaaatattctttactgtaggacatctcaaggcccattaaaattaatgtgtaatattaatctccaagatgggttataacatacagctcattctcaagttatttgaggattcctttttctagaaactttgaccaataccaaatgctgatctggttttttcctttttgggaacaaactagacttgagtaagtcactgaaaaatgagtaacagtaaaaatggagagaaacgaaaacacatcaaagaaagagggacataatgagtcacagcatgaataaaaacataatttcaaagggcattttttttagttcagcctgtctggagcagagaattcatattgacaaatactgtttattgaatttgagccaataacaagatcagattgtacagagtctaattgccaggttaagggatttaggctttatcatataatgtacaagaagccattacaagtttttaataaaatagatgataatgataataataacagtgtccatcatttattaagcacttgtcttagaagcttttctaagtgctttccctgtattaactcatttatttctctcaacagtcctttggtgtaggtagagaataacggaacaaaatgtcaattaactttcccagggtctatagcctagtggatgttggagctggcatgtgtagatccctaagcagtgtaattccagaattgttgcctttaaaccctattctatggtataaagagtatcctgtatagggagattaatctggaaccatatgaaggatggatccaagaagcagaagactggaagaaaaattggttggtcaggaggcttttccaataaaccaagtgtgagatcctaaagtgtttaatgggatgccaagaggaatggaaagaaaagggtgaggtttagagattcaaagaaggtaacattgatactaaacatttgacttaattcatggcttcacattgatccagggaagtggagttccctgtatgcgttttagctgatggtagcattaacaacaagatgayagagaaattatgataccactgacaaaactgaggaactcatacagaagaaacagtcataggggaagacgatgagtctgagttttgaagatctttagttggaaatgatgtcagcatactagaattatgtgactctatatcgagaggaataaatggctatacatagagacttggagtcttcagcaccaacatgatggttgtgatcaggggaggctacgaattttttcaggacaaggatgagacaggaagagctgaggctagagaatgggtcttgggatccgctaagtgctacaagtgtgtagaggaagaaaaatcagagaggaaactaatattttaaaaaggaaattgtaatgttgcagagccatgtagayaaatatccttaaaatgatgacatgcaacactgtaaaaaaggacaaaaaagagaaccaggaagaggggtggcagttaaaccatctcattggtttggactgtttagatgttgttaaaaagaattcagtgagtcattccagagttagcagctgtcgtttatctatcctaattatctaatggtgcctcattagctcattttttctggtcagtttaaatagataaacactttcctttgtatctgctgattaatttacttggtatgatattatattaaagaagaattgaaaatgattattctcccatcatttaaaaaagtatgtttgatagtttcaaattcatgagagtaaaaacttggaaaactgaagaatgcaacacatttatcaaattcctggacgtttgttgacttcctactctgcttctaaaattgtaatgattttcaggtgatttaagtgcaatttstagtcatttagtgtatatgtgtgtttctgtgtatatgcacatactatttattatttgttatttgtattataccttgcatgtataatatttattaatatcttacttacatttattaatataaataacccttaaaatcaaatgtaccctcaacatcaaaaagtgaaggcattagaagagagtaatagtgaaagaaaatcagatgtatcctggatattatcattggcatataatatatatattattatcaccatattgtgtgtatatatatgaaagtatttattagttttcttaatgcagtacagctatttaacaaccccagattgctaaggttgttactgattaatttttcccagatttaccatctgtctgggctgactacatagccattttgctagggttttcttccccgcctctgtaaaaattagccttactcaacatgacgacttttttaaaaatgtaaagtaacacgtcatatattattacatcaaagaccattcaaaatagcaacttttaaatatgtgagtgacaggataaattactaccgagtattatgcttaacatcactatcacctagagccaaaaaccatcatgcagtgttggtggtttggtgacatattttgactggaatgtgctgtgctattgggcatcagtcaaatgtggtaatttatgataattactcatctgaggcagataagaaagcaacatcctaaatacaaatactgtcatagcactattgccctgaactggttgccgcagagttgaatattctgcaacaactttgtgattttacttccaatttacttttgattattcttatatgatatatagaatcttgtctacttttatctacatttcctgagaaagtaataaaaataaatggccccacctgttaagattaagatgaaaattgagatttcataatgaaaataaaaatcagatggatgatgtaaattttaaaaaacatgttttctcatccttttcttttttccagatactaagagaaaaggcacatgtcagcatattttctagtcttctggtagcactttcaataaaaaaaaccctttagagttactctttaccyttgaaatgagttcagtcttgtattctttgtatctactcttggtcttcctcaaagacaagataaatcagagttgtgaccttactcctactctttctagaagacagattctcatttctttcagaaactatggtgtttgccttttcaacatctcctgtatttaaaaattgacagtcccagcagttttacagttagatataaggctatattgacacatattttcccccagtagtgaagcaagtgataaattcttatggagagcatgaaagtttctagaacaaaaatgcaatgtgcttcataatctaaatctgacaagtgttgaggaagaacttttcaaaataatgatcagaccaattcgctttagttgcttaaaatattatgtcacccaatgacagaaccaaaaaaagtgtttataaggcatactgcataattaggaagtaaattcctaagatatatggctaatacagcagggtttgaatagctccatttctaaagctgaatcatggtctttgatgagagtgggttataacaatgcaggctttgagagccttgcaaaatctcaattaagttgctgaaatgtttccacagtttatttttctaggatcttttccatgactgctcgctcataaagacctggctgtggaaggaaattggacaggaactnttgaattggcctcttgtttgcctagttctattgacctgtaccagggtggttacactttggaggccgtaagttgttcatttgctactgttcttaatcaataaattgttccttgccaatgaataattagaatcaaattctgataacggaccagttaaagcagggagcaaaattctgaaattaagaagtgaatatttgttgatttttctctttgagcccctgtcatatatagcgttgtcatttttatttagtaagagattattggaatacttgggtaaataagcgtaagtctcttattttagatgggttgcatttgaacaccttaaaaatatagaagttttttaatgaaagcaattgtataaaaaataaaaattaatatcataagatcataaaaactataaaacagaccacccccaaatttaaactgcaatgaatgacatcatagggcaaagacattagttgatgattcatattaatgagggtatgcacacatatatgcatatgtaatatctttgcaaaagctttttaaagagctgttaatttgattttggcacaaaggttaatttttcgtgccttgttataatgtgtcagcatttttttgaaaccacagctcaattttgttactatatttgtagacctgaagtgacgtgtgtttttctccaatttaaaagaattttctccttgcctttaaataatagacaaaatccgtaatgaaataccccctgaattattcagtaccttgatcatgattataatttatgctagctttttcaagagtgctattgagaagtttagtttacaaagatgtgattcatataacamatatatatgttctttacatgtatctgccacagacttgggtcaagaggaaatgatagttgccccaaatggacaactaggaatttgaagacagaaagttaaagaaatgctaaaagtgctgtttgcttttttgctgtatttagaactgagcggtgggtaagcttgttcagaggggagtgctgtttgcagtaagtaagaggcagaagccctaagtgttcaaagacaaagaaaaatgaaatacatttgccamaaactggaggaccaggaagtgccatcttatattaccatccactgaatgttcattatttcatagaaaatgtcggtgggacttcaagaataggagtcatgttttactgctaacatatgtggagttaagataaaatcatgcattacaaaactgtaggaaataagtgtttaggattcttagtgatattacatagtggtgattgattaatgacataaatttgaaattcctcttggactgatgtgaactgataattagggactgtggtgaaagagaagaaaatgccatagaattctgaaactagaatttgttttgttatatcaaggatacaagtgaaaaattttcactgaatataagtgaaatggtgggggagcagawggaagcggtcttaactgacagccaacaatgaggaatttggaggagtgatgaggggccatgctattttatgcttttcttaaagagttggctaaatggttttgaatattcttcaagtaaaaggacagaaatataataaaaagtacataaagcatgttgattattctattattttagcatcttttaataaagttgctaaagggtttattttatttgacatctattctttcagaaggtttgtgtcctgatggcagccagatgatattagaaaaaaggaactgaatttgttgcattagaaaattatgtcaaatgactctctaatagacaataaattacaattacaaatcaaaataaaagccaacttattaatgttacaaaagaagagatgtattgtccaataattacaaacttgaagaaaatgggtgacatattgtcttagttcattttgtgttgctataacagaataccacagactggccaatttaaaaagaaaaaaagttcacagttctgaagggtgggaagttcaatattaaggtaccggcaactttctagggccttcttgctgtgttattccatggtgaaaggggagagggtgagaaaggacatgagagagaaaccaagaaggggcctctcttttgtaacaaacccactctagagtaacaacaataattcattgatgaaggctgagcctacatgatctaatcacctcttaaaagaccacctgtcaatactgttatataggggatcaagtttccaacacatgaattttgggagacacattcaagccatagcacatatgaaccaaactttttcactgaataggaagttaagatatggaatacacttagtgaatataaataaaagttaaaagagtaaattttgtaatggacaaagagcaaatgtaaggttagtcagagtccaggataacatcatttgaataatcttggatgtgatatctgtgcgattctttgcgggagagaaattttaaagattatggtaatagttaataccactataatattcaatataacctgaacttaaatctgtgcttttccctaagaggaagttacagggaacaattttattaagattttcatacaataaaactgtctattttcatttttagtaataatgaaaatggtaactgacatgtactgagtgctttccacgtgtgtgtcaagcctgtgctgagcattatatgcattgtcgtgtaactgctcagattaaatgtaagtctagcacaaaatgtttgtccatataagtcaaaaaatgttggccgagcacacccctataatctcaacacyttgggaggctgaggctggaggccggcttgaagccaggagtttaaagaccagtctgggcaacaaagcaagaccacatctctaccaaaagaattttaaaaataagctgggcatggtggtgtgcaactgttgtcccagctgcttgggaggccgaaaggggaggatcgattgaacccaggagttcaaggcggcagagagctatgattgcactactgcaggcagcctgggcaacagagcaagaccctgcctctttaaaaaaaagtttatatgataattattttctgttacatttctaataaagtttctaatccagtttttacaaggtgattgggggccagtcataatccattgttgcaaccaatcacactggaagtaacatgttcgtcattaaaagaccaactgtaaatgctcctttacttttgtcaaaactagtaatgaagtaagaacacagcaccatgatacgaattttaaacattcctcaactaatgggccatacttttagaagaaataaaacagtggtcacttcttcagaggctgatttgtcaacataacactaagggaaaagaaaagtcctctcttcttctgctgtggctgaatcaccacaggcttccaatcaaaaaataaatatttccaacataagaggaaggaagctttggtaaatatatgtatatatttttcaaaaactgttttacatgaaagaggtcattcatcactgtaagaatattttcaaaggtagcatcagacgtgaaattcaaaactccctcaaaactgaatcctgaaaaaagaactataacagacaaaagaatccttgggtttatatgtgttcctggattctctgatttgcctttataatactttcacaagctatagtttattatttttaaaaccactttacttcaaaattattgtatttcagcatctaatccatacacatgtaataagaggagccaaataatttattaatttaacaatagtgatggagatttctgcactcattagcatgtaacaatattcatatttgttaggttgaaaatgacctttgccctatgaaaagttttgttaagctaattagtaacaaaaaatatgttgcaaatggacattgttagcctccttaaaaagcaaacttcttttaacttctcttaattaaatagcaaaattatgtgtaaatactgtatttgtggaatgattgatacttgttgctgaccaaaaaagccctaaattatagtctagttttcagaattctgagccaataaaaaaaatgcctctagctagttcttttaaagaacacaagcccacactgaacagagggctagctgcttatatgtcattaaaaagcaaaacctaattgtactatcatgtatttattgcgtctataaagcaccttccaagaacttaagtaagaacattaatttgtacctgtattttaatgcagaagtagaattccatctctttcagtgcttatgagtytggtgttttaattccaccccaaattacctaaattctacaaatatttattaacacacagggagtagtattattctaagagtttttcgactaatgatcatgcagtagtatctaaaatagctattgatgttagaaagttgtaacatttcttttccatgtaatagcacatgatatgcccaagggaaaaaatatacggtatttgtacataaacccaatcaaggtgatatcagtgggactgaatttttcttccttaaataaccagtaaatgaaaattgctctctagcatctcaaaggagaaaatgctaaaaactattagctaacagagctttctgcctggctgcattaattttctattcattttagtaaaaggaaagttttgataggccttataaattacaacatgttcctagtagactaatagcttgaggaagaacatataatagctctccttaatcaaaataagagcaagttgttgtttatgcagctgaggaaccttggatcaagggtgctgattttattatttcgatgccaaaacaaaagtaatccatataaacatgaccaatgtttagaaaggttaggaaaaaacttattaatgtggctctagcaggcagagttttttgggaactcatccattttttataactagcttgttttttttagaacttaatatggccagacattgttgtataagcacaagggccatcatattgagcaaaacacttctatagtccctgttctcatggaatttattgtctggcaagaaaccaaatgggtagaataaggtttgtaggactttaaactccttcaaaactggagaccatctaactatttattcgttgtggcatgataaggtgctaagaatgaaaccaaaatggaaataatatttatgttctattaatattaaaaagaaaatcctgcagcacttctgtgaactgggtgttataggactggctgatcccaaaacaaaactcctacgtttttatcatttatattaagtttccatgtcaattggttttactggtcaaactacctttagttcatctactattgagtcagacactaaaggtgtattaagtcttccaaggatggagggatttatcctcatgtgcctactgtttcctgaaatttaaatctgcactgaatggcctaggatgtatagacagttaacctccctgaaacacagcctatccttttttgttaatttccacagtgaatgacagttctttaatatctatcttttcctccccagtgctcccatcttatatatgtgcacatacatacctccaacttctaaccggacatcaatgtaaacttaccttaatagctttggcagatacctgtgatcaaggggagggagcttactggagtgtgtttggtctccctggaagactgaaggggtttaggtttcctgtaattgactcctgtgctcctccctttttctccccacaacttcacttctctcgccagatcagtgtcagtaggtaagtaaatccattatttgaaagctgtctgttgaccttttcttcatgattgattgcatgaaaagtgcatgggagtgagatttccagagaagagaatggtcatgctacctgcccttgccacttctcccagaatatcactggggtttcccacagaggcaaaggctgcttggatagaagcaatacctgagaatgctctcaagtaaccatggtgaagctgaaagccacatccagcattgctccacagccggtgagaattatttataaagacagggcaggggctgagtggtttattggccttcaaaacattcctgatgggacagtgaccaggtctgcagttgcctaagggtgttaagccaacttttaaacctccacctattatatccagagtattccttctaacttggacttgaagaataaccagattccaaccttttctcaagttggaagttacataatgaatgatagctgtcctagaataagaagtatattttaaaactttataccttaaaatatttttcttacttgagtctgcatttcatcaggtctcctgtaaagctttagttttcttccatgtccatgaggaaaaagaggtttcattatcaagactcttctaatagtgaatattttaaacttgctctggaaaaaattaagcacaagtacgtttggagaagtacatttttattttaataagacagtagatttgttgcagcaaaagatagcaaagtatcagtagttgaaatagcgattatatgtgtcttgaccaaacttagaatccttatgaagttttacatgtcatttcatacaaatcaactccaaaataaaattttaaaggcaaaatttgaattcagttatagtgatatatgatcctaaggaaaaaaaaaaacactgtatgttccaatctgaaaacatttttggaaggaataaaacgataaaacagaaggggtttttcactgtttttaaaattttataaatatgtagagattggcttaaagtttgggatacaacaaatcagtgaagaaaaaatcgtaccattatatgttagcatcagctaacatttgtatacactttttactttttagagtactttggtaaggagtatctcattcagtgtttttagaaaagatggaatgttttccttttttatgtaacacttttcaactagtcaaaggaaaatgtttaattttaagtacagctactcttgctttcctttgcttatggcttactgaatgatctttccttttgctaaaataattaatactatataattctgmtttgaggctagaaaataagaaactcaaagatcattacaactggtaagcaaagttgtgcatggggctgaataaaacaactcaaaaagaatgattattcaaaatattgttacctaattctgcaacattaagggaattataagcagtagttgctatttccttgttctctactgactttcggggtccatgatagatgtttggtaaataatagtctctgatgcttgaaaagccttaaagctacttattattatccccattttacagataagaaaacagaatgtgaagtggtagagcaattacctaactctaaacccaagtctctgagatttggaagctgtgcagcttgtgcattatgccatgactatgatatatctgctcactaagttgaatatcatgtagctatttaaaagcttattaaagaatkatgtaggattatatgaaaatacttgggaggaataaatgacaattttggtctcaataaaatgcgtattttttaaaagactgggaaaaacacaagataaaaatggttttcttattatgcttttcacctttgctacartttcttaactttctctaataccattataattatattgctcaaaaacatctatttttaaataataaatggatcaaatggtcaagtagtaaatgagtatgtggaaaatactattattttatctgtgtgcattttgtagtgtattaaattcattacattaagtcttgttatttgtttacaccactgagagaccattagtgatttccacatgagtatagcccatgtcttatctacacagcgtgaagaccagcacagtgattgccctatagtgtctgctaaataaatcccaggtgaatgatcattgaataaacagggatctttcttaaaacttattaataataaagagtttgtgaagtaagtgtagaatagaattaataagtttaactgctcttaaatggcttatatagcatatatcaatatggatttatattttaaagtaagtgcaagctgtggttaaaagcagacacttttacactgctggtgggaatgtaaactagtacaaccactatggaaaacactatggagatgccttaaagaacttaaagtagaactaccattcaatccagcaatcccactattgggtatctacccaaagaaaaataagtcattatatagacacatgcacacgcatgtttatagcagcacaattcgcaattgcaaagatatggaaccaacctaagtgctcatcaaccaacgagtggataaagaaaacgtggtatgtatataccatggaatactactcagccataaaaaggaatgaaataatgtcttttgcagcaacttggatggagctggaggttgttattctaaatgaagtaactcaggaatggaaagccaaatgttgtattttctcacttctaagtgggagctaagctatgaggatgcaaaggcatggacttcagggatttggtgggtgggaggggaagattgggagagggtgagggataaaaactacatattgggtatggtgtacatttcttgggtggtaggtgcaccaaaatctcagaaatcatcattaaagaacttatccatgtaaccaagaaccacctgtacctcaaaaactattgaaataaaaataaaaattaaaaaagtacaaatatctatttcttgttatatttgtcctcaatgctactgtcatttagtacccaatatttatgttacttgatcaaattagggttctcttggatacaaagaatgtctgttttaaaacctaggatgaactaaaagtgattcttttgttagtggcacatactaaaatattttaaggttaaagcttacaaatgactgaggatgggaagttcataatttcctagttaaaatgacaatctataattgttttcccttctatatatttaaaatacattatacaccacaaatttagggatagtgtaatttgaaatacatactcagtacttttaattttccatcagatactaatatagtcttcttgaccaatctaggtcattcacttgtttaaaagaaaaaagttattagacatttttggttaaatcctaatttctgaggctcagtaaatgtttcttttgaaagtcagaaaagagctaaaatatgtaaatactatatacactgtcagaacaggatgccactcttcttgttgctaagttaatgagtaaggatttatgcaataatactgtttttcttcagagtagtgtaatcttctagtcctcagatgtttcagttagttgtagacattttgacattaacaaaacatatgtttctatgtgccatgtagataggataacgtatgtaaaacaccttaaaattgcaaagtgctatacatatgaaaagtgttgctattaatttatgtctctgaataatttctatttctccatatgaattgaatattgcttaaaatctgggtactttgttactcatttgaactttagtaaatctttgaattttcttctcctttttggcccttcagattgttgttgcttctgtagtcgacagagttttccactaatttcataattttaaaatgaggatgatagagttggcctctaaaagaagatgagctctggagtcaaaacatgggattttaaatcctagatctgccatttaatagccatttgaacttggacagttatttaacttgctgaagccttggctccttatccataaaatatggattttaacccatgtcctaatttattcactgagattgttgtgaagattcagagaaatcatctatgtggagttaatgtgatctttatgatgttaagtacatatcaattattatctttttattataatatgtgcaactcaattccaaataacatctgctatcctcaggggtttcatcagtgccacagaaagatactgtgcttaattttgttttgaaactgacaatctctttccctctggtgttagaggcaatggttttatcaatttcaggggcagcttttatagaccaatagatcctgacctctntactgggtacaatttgtcntaaaactgacagagttacangtgataaaaggaatatagtgctgttgagaacattcccaagagaagggagtggggagtgtgttagaatcttsttttcagttagttttagaaaataagtgattanttagaaagaaaaaaatagagaacaataatttgccctttgaaatgagaaaaattaatgtagatatgaggcactagggaaacatataaaaattctttccaacttaaatactagctgacttcattaaaataattagaaatgcctatattgattcacatgcacaactgtatataactgtatcactttggttacatttggagaaataaatcctacttccaaatattctctatatatggtggccatatatattcatataaaatattaaatgttattaaaatttatcatgaaatcagtttttccccaattaatgttttcaattaaaggcaatagtgagttacttctggctacttacaatagtgaaaatttcatagtaagttgcaactttaaaaatttgtatcagttctgctctttaaaggcatgtaaatatgttacatgaacatcatttaaattgtatatttaaatgttttaattttagctaagatttagtttaataagttttaagcttagcattgcctcttagaaacagaagacctctgtcctccattgaccagatttgctttttcttatgtgaactttacttctccaattttaagaattgtgtttaatatgggaaggccttttaaacaaagatatgtccttgagaggcatttgtgcactttctttctataaaagcattgaattctgttggctatacttaaggggtggggaggacaacaagatctgaaaaatatctccagtgcaaattatggggcctcttggtctaattttccaacagctgaaaaatttcatcagcactaacttttttaaaggttctgaaatcttttgaatgaataacaagttgccattactaataagccagttgaatatctttacatatccaacacactggacattgttattgtattttaaatggcttgctttcctataaaatgtaaactgatttaaatatcatttgattcacacttcacatttgccaaatagcaccactcttcaagcctttccactgagttaagcagtatcagctgaacatctttccctttttactcattgatcatttgaatgatttttctttcttgtccttttcaacctggggaacatttttaagaaccctggagtgagccgaaataactgattcctgcagttttaatatctccttattgaattttgatatcatagtttaaatttaatcatgaaatgtatcatatagttggcatctttggcagatacaatttttaaaagcgaaaaaatggcgttgtaattgatagagaatattaactgtacatagtagtggagatttcctatctatcatttgccttcagattgtttattaatatagcagaattggcctttaggttggaatattgttgatcagtccgctgtcttttgacttaatgatttgcaaaacctgctgaaacaagcaggaatatacagccagcttttgtcagtatttcttaaattcctagcccagttactggatgccattaaaaacctagacaacttttgccccacagtacacagttagaaatgagtacttaagcacacttaaatttgaaggaaagaaaatttgaaagaaattttttttaaaacttagtgtgtgttttgtagtaccattttttcccagattaaaaaaaattgttaaagtttaataaagctcaccatctagtgtttccatccactgactaaaaagtgtattgttggataaaaatattcagaaaattctctttaaaaatagagtgtacacaataaaacttcggttcgcaattcagtgtttaaaagtctgttcctgaccatatttcctgccatctttccaaccatgaattccgcattgtaattggattgttgtgctcccagttttccaaagaggtctcttgacttcctaattcaaagctatatccttatttctggcctggaattccttataactcctttccattccattatgacttcagattctagctcccggaacatctcatccctaatagctgcagcccatggtcatttcacatttacytgaatttattattgcattcataatctttattttaatttggaattaagcttacattatttataataatgttggttaccgttaaagctgcctctaaatatgtcatatgttgagtgctctacaacatgaatcccgacatataatcggtgtttaataaatattttttagcttttctgtagtttaaaagggtagtctgaatcagtcaaaatcagaattgtctataaattttaaagaaatgttatttactactcaatatatgcctagctatccaaatattaacaaataggaatctttggataactcctctgattaatacctaggtgaaaatgacatcaaataaagcaaaaaatcacaattatttcaaaagttttttctgtttagttaaacactgcatttgaaagaatttgctcttctgatctcattagataatggatttctctcagagtaagagtaaagttcatcacagcaggcctctccattagtaacttaatctccattaaaggtgaagtcaagatttttgtgtgtgtgataacgtgaatttttgtgtggwattattacattttccttttggaccttgaataaaatatacttttaaatcttaaacacagctaaaagcattaatgcataaggtaacataaagataaacctttaagctatctagtatatattttatgcgtggttatcataaaaacaaaggacagataataattcagtcttctaaggctgcaagagagcagcttagtaactggatgctttctgctaagattattccatgttaattttaacaggaagcagaaacatattcaaaaattgatacgacaaaacgctawgcacattctaatttttaaagaaattaacaataaatggcggaagtagcatgatagaagcaaacacatataaagagttatgagctatcataatcttggctactcggggcaagaaaacaataaattaattaagatagtgtagctattcataaaataaacctataattccttccccaaactatacattgctatttaaatagcataggaaatatagmctattttatattagagatttatttttatcatccatctccctatttcttttcctcacaactacacacacaccctcacacacacagacaaagcaagctttcttgtaacattttgcacaataaatagtaattagataactaacacaccacacttcaagaatttcagtatatttcccatgtwttacacatacattttgatataagccaaaatggtctggctgtccttgatgctcccaaacaatgtcagtgacagcgacattatagagtttggacacatattgatatttaaatggaattttctgtttgagaatagaacaaatcagtaaatgactcaagaatgccttagtaaaaaataaataaacacaatgcagaaataaaatcatcattttatttggaacacnacatattttactattgctttataattgatagttataattttactattgcttcataattttcaaatacattgtctcatctgatttctggaactatctgatgtggtaattactagcatttgtaaccctaagtgggttcactagcgggtgaaggaatcaggatttggatatctgttccttgtgactgtccagtggattcctctccaagtaacaactaactgcacrgtaagcagaatgaattatccaagaaaactgaatggctattttactgacttgtctatatatagatgggcagtttttccatatgtaagtctttaaaatgttcattaaaataacttttgtttagtctctttgcctaacaccaaatgtttcttatcctaaattctacatttctttctatcaataagtgaatatgatcacttttacaaaatattgtttcttttctatctttaaaatagcaatacagcactatattgaggcgattttccatttgtgcctgtaattattttgtcagcctctagttaaacaatttactatgttcacattttcttacttgtgtcatgcaaagttctcatatatacccacttttttggcccgtcattgaaaaagttttgtttgcaaatattttattttagaagggggcaattttgtgatccccctcatcttacttttctgctaccaccttcccattgatttgttcattcaacagacatgtattaagcgcctactctgttccatgtgcaaggcattacactagataaaaacattccctaccagaagttctctctgtctagcagaaaacaggaactatatagaattaaagaaatcaattatattctaaacttgacctagtacaatgaaangagacctgcctggctatataataacttgataaattatttgataaattgttcaatttttaaatcatttgttacagcatattataccttttaaagtactttactgtttgtcctttagcacaagtgaaaaacttcagagttaacggcctatctttagatgttcccttaatcaatgtgactaaagagttaaatgtattcagaaacaaaattttattcttagcaggaggattattgagagagaactactgaatgataatttttttccatttatatttgtggttatgctgatcttttagtaatattttactgaagcaataaggtaactcactraaatgcagatgaatctattatgtgtgttacttatgccttatttcatagatatatacatgcagaatctgagacatagtcaagatgttaattattttatagtgattagaataaattaacataggggttttttatatattaattaaaagttcacaatgggagcagctaagcaataaaatgtgantgaatgcttattttactatgaactttaggtttattggcagaactgtcttgaaaagttcaaactttttagagttgtcactttttaatgcctttttttctttcagtgatttctctaaggacttgtgataacttgctatatttgattttggccaatgtgaccccttccatcttctggaagtgcatctcttgattgccatgaaatcntgttccgcttcccttttgcctctcttcctctcagatctgtccgtctctttctcctttcctggctcttcctcttctccacaactgttaagtgtccaggcctcaggactccatctggggtccccttctcttctctgtgtacacatgtattttccccagttgtgtgccatggttctgattatccttcttaggtaatctcattaagttccatggactgaaatttgacttatatgctaatgactcctaaattcacagttccagccctaactttccacttgaaatccagaatcatacactcatctgcatagttaatgtctccacttgaaacaggctcctcacatacaacctatccataaaacaaaagttgtttctcccccttcttccgttaccccaaaattcctcctctgcatcccattccattcgtcagcttctcactgtgtactccagttatcaacatgtcctgagactgatttcacggcatatgtagaatccatctactaacagtctcccacacatacatctctccatctctctgctcccttccagggcaggactctcacatctataatatggcagtaatctaactgtttcttgcttcaactcttgcccatccaaaacacattctgccccagacagtgaggatgggcttttaacatctatagtaggtcagtgactttctaccatgtgatcttctaatacctcatctctatcctcagaataaaattaaaaaattactcttcatcgtggcctgcaatgccttgtatcatcccacttctctctgcctcccaggtcacatcttctgccgcaatcactatcactgagttccactggccttaattctgttccttaaaaatccccatgtgctttccaacttagggcctttggttcctgtttgcagtgtcccaacctcagaaattgaacatgtcctttcttacaggcatttgttttgtgtcaccctatcgtcatgtctgaaatcttataacatatattcttatttttccttccttccttccttccttctttcttccttccctcctccctccctcctcctctccccctccccctttcctgcctccctctctccctgcctcccctcttcccttcctttaktcctgtcttcttttggaatatactcatttttattaagtcatgataccctcatccccttggtgcataacacaatttaacatagcagagaataaatacatgccaaattggatggtttagtcaaattcttattttttgaactgatcttatgttttctgaggatacagcccaaagctagagagcacgcatagttgtgtgagagtgagctgctactttatctaacattatttttatctaaagttatctaaatatttgaaatattctatgctaacaatttttgcctcctcctgaggctgcgaatagaactattctcagatggtcccaaagtttcagcacattacggcagttaacataaagcttttggaaatgttatattaaccactaaggggcatgtgctaccattaatctgtattacgagttcctgttgttaatggtagaatttgcctgagtgtgcatttttctccttaaatcatgtataatagagtattggttcttaagaaattacagataccaaagaactgatattaaaatacttaaaacatgttgagtgtgcctgttaaagaaccagttctcagaagctatggaagtactgctttgttttatcttaaggaaattttagttgaaaatctgctttaaaaagctacggagagctggactattgctgtcaaggaggatataaagtgtaattcgtttttcttttttcttttgcatttatatcaagtaaattcatgcaaatccttcttagaaaatatttctgtttaattgttgttatgaataatattgtcagtatattgtgtacatagcactttcagattttatgtatctacttatattcaaagaatttacataaaataaataaccttaatatcagtattcctgctattgactcaatggttattttcagaatatttccaggatagagactgtttaaaatgtcatttgggcttaccgtagtttgactgaatgggactaaattgctttgttgattggaccagtgtgttaaccaaagraaggtgaaaggttatcactatcgttagtcctatacaaaacatccgaaaagttttgaagacaatgggatgggatttactaaaattctcttcaaccttcttgtaaacagtctacttaaattaaaaagacgagcctaaaattttgatactatagcccaggaggaaggagttaatcgataaggaatgcaaggtcataaagtatactttctatttccttataagaaactaaggctatagtttgacttgctgcttgccaacttacctatatggttaccagagtaacttcctgttctaaattatgctgtatgaaacttacgtgtattttcttaatttagaccccaaatttagattctatttataataactaggatgtggtaggagagagttctctaataacttcacatttgtagtttcttgctcaaaatgaaaaactttttggtggcacataagtatttatagtagtgtaagtcaatacacagcacatttaaccagatcataaatcaaaacagtctaaataaaatgaattaggcaaaaagcagttttattttgattgatgattttatagtatgagtattaaaaagtataccatagagttaatgtttatttcccttctgtatctcttgtggcaaaataggtgctagaaatttatgagcatattttcaactgggcataaatatttatagagccttagagaatatgctacctccatcctttaataaaacctcacattcaggtattagagataactatttatgcactcctttgtttattcaacaagcatgtactgttcattgtgagctacaaagcaatgtgctagacaccaaggatcccaaatcaaatgttctatttatcctcaaggagactagagggaaagatggtgttttagtctctgctgctataacagaataccacagaatgggtaatttatagtgaacatgaatttattgcctcatggttctggaggttgggaagtctaagatccaggggccagcatctgatgagggccttcttgctgcatcattccatgggaaaaggccaaagagtgagcgagaaagagcaagatatgaatgtgtggtctcaagcccttttataattggccttgatccattcatgagaatggagccctgatgacctaaatacctcccattaggcttcacctcccaaccattgcattggagattaagtttccagcaaatggttttttggtgggacacattcaaaccatagcatgtagcagtatatcaattttcatagtacattgtgataagttctataaaagagaaatgctctgggtgccagggtcttggtggagaagcatcaaaatcaaatgatgggattcaggatgtttttctggaagaagaaatacatttaaaacattttcatcagagggtaactcaagccatcagatttgcattttggaataataactcrggtagcagtttggaggctgttgggaataaggccagactggagatatggacacccattcttgggagatcagcgtgttaagtgtaggataatggatagtataaatatggacaccatatacttgggaaaccagtgtgtcaagtgtaggataatgagaacctgaactatgtcagtgacagtagaaatgtcaagaagagatgccagagtatcaacacagcaatgatttggagtcaaygaattttagaaagtgaagggattgtggatggtgaaggcctatatttatacattaggaaacaatagcccagaaagtgatgcatacatataatctaagtcttagtcaaaggggatattatgacttcaatattctcagtgatgaacatgcagtaacttcagaaatgttttgtgccttaagattaatataataataatttctgtaatggtcataanttctaaaaatatatgttttattttatgtatatttgacttttaaccttgaacaaatcagaaactaaaaagataagcctggttttttaatcaaagctgattaaatcatataaattatttgagccaaaggttgcctcttaagtaacctaatatttttcagaaaaatatttttatggttcatttccaacataaatttataaaatcattttatgtcatgcaactttttttgatgatcgcagggttcttaattcttaatggaaaagatattggaaagttgtataattaaatgcgtggttggacctgtggatactgtgttactattaatactcataaaagtgacgatctgagtagagcataaatgtagtttatagaaccctaccngataggcttgaccattttaaaactatagctggatctaatgacaaataaattataggaaaaaatgacaaactttgatcaaaacaacttatctttctcttttcacctttaagaatgataactaatatcaagatataatttatatctgactgtagtaattcagggacatatcatcatcattcagttttcaagtgcttatattgttaaatgcacagagcaaatataagktgttcgactaatttgtggtgttaatgttagtttcctttggtgccacatgaaggttcttacatatcatgctcttaaaaacactataaagtggtttacataaagatttgaccttagaaagatgaagaatttcttcctttgatgatgattcaagtgcctacaacaagttcttacagatcattttctctttactacacgtttcctaaataaatagcttgtggtatttcaatttaggcacatctttaacatttgggacaacttgaagcacaactcatttagtatcattaaaatagtacagactgtcatattctgtcttagcataagatatctggtaattcccaaggcagtttagttcagtgagtttaaaaaattacatgtcttcttattagaaattgttgccagaacacataatgaatatgataccaatttccactatatggaaatttatattttttcaaaagatattacattactaaagaaagaaaggcagaatataaatggcagatattcatcactgaatttgtttttgagaccacttatagtaattatgttacataagcccaaagagtttatatatgcttggatagattatatttgtcattttaagcattgttttaaccaaggatacaaatttatgaagtgtttacasgttcaaaaataatttcctataaaaataacatgaataggtcaaatgatttgactttaccttcaaaacttatccagaatctcaccttcactactttaaccttggtccaagccactgtcatctcagaactgagttactgtactagcttcccatttagttgatttcttcrgaacaggctaggctttagcagcagttaactctgaactctccaaacctcagtggcttaacaccaaaatattatgcatcttcttcacaaatgtctactttatgtttgcatgggtaaggatactagaggagcttcttattgtcactcagggatccagtctgacagaggctgaaccatgtataaggtcaccagttgaagcagcagggaagaaagagaccggagaatcttgtagcctcagtatagaagagacacatgtcactaatgcccacaggttgtcacccaacaccagtcatgttgcctcaaccccatctacacagtggttgggaagcatacctgctcgtgagcccaggcagaaatgggaacaggatactactgggcattcataatatctctcacactggtttggaaaatccaaattccttccttgctacaagaaagtctcaatggggcagccaaaaatggtcattttaatgtgttaggtcatatcactcctttgctcaaaatctttgaatggatgcatttttcactcagaggaaaaaccagtgtccttattatgaagcacaaagtcaaatatacacccacccatgtggctcattccctgacttcctgtaggtctgcttaatagagaagcccttcctcattacccattttatttctctccatagcactcaccactctgatattctaaccaatatggtttttttaatatttttgttgattgtttgtctcttcctactrgaatgtgacctcaaaagtkcaaggactcttaaattcaccatttaaaccctaatgcctagaatggtgcctgacatattagaatatgaatgaatgaatgaaatgccctaaaaactgtattgtgaatcccatttcctctgtgtagttaacttgtttgtcctatcgtattcctcaagaactggaggaacttactttcttttttcccttgtttcttgaggccatcacaaaaattagtcgtagagggacttgtcctgcttaatgggatccaggttgaaaacagtaaaaataagagattacagccaaacctggggaacagctactctattaagagatgttatcaaggagagggaacccttcaggtcagcagaggcctgatttggggtgattgtaaggatggcttctgagtcaaattgaattaatgagaatacaatatagaaccataaaagggtctgtttctcagccttactaaattcattcttaggatgggattgtatttgatttttgaagtgagaaaagcttatcagaatgccattttatatacaaaaattgtagtacatttaagatttctagtgggcagactcattattaacatgaaaagcagatgaaaatatatacacgttattatatatgtacacatttctattagtaaaggggtgaatatttacaaaataaagagaaagagttaaagataacataaaaagtgctgatctgactttaatagtcgcaaaaggaagaatattaatacccttttaagttcacttgacaggaggtgaactgtcaaagaaggaaagacagaagggagtctgggtgaattatttgctggtgtgagactgaggatttttatgcctgaatggaacttgagttccttgccagtgggcagtctaatataccagagccaaaacccaggcatatacgattagcagaaggtcttgaaaacaaggtagtcatgggctggtactttttttttttattactgcatgtgtttttattattattattattattattattattattattattatactttaagttttagggtacatgtgcacaatgtgcaggttagttacatatgtatacatgtgccatgctggtgtgctgcacccattaactcgtcatttagcattaggtatatctcctaatgctatccctcccccctccgcccaccccacaacagtcccccgagtgtgatgttccccttcctgtgtccatgtgttctcattgttcaattcccatctatgagtgagaacacgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtataaaagtgttcctatttctccatatcctctccagcacctgttgtttcctgactttttaatgactgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatgggtttgtttgtttttttcttgtaaatttgtttgagttcattgtagattctggatattagccctttgtcagatgagtaggttgcaaaaattttcttccattttgtaggttgcctgttcactctgatggtagtttctttgctgtgcagaagctctttagtttaattagatcccatttgtcaattttggcttttgttgccattgcttttggtgttttatacatgaagtccttgcccatgcctatgtcctgaatggtaatgcctaggttttcttctagggtttttatggttttaggtytaacattgaagtctttaatccatcttgaattaatttttgtataagatgtaaggaagggatccastttcagctttctacatatggctagccagttttcccagcactatttattaaatagggaatcctttccccattgcttgtttttctcaggttcgtcaaagatcagatagctgtagatatgcggcgttatttctgagggctctgttctgttccattggtctatatctctgttttggtaccagtaccatgctgttttggttactgtagccttgtagatagtttgaagtcaggtagagtgatgcctccagttttgttcttttggcttaggattgacttggcgatgygggctcttttttggttccatatgaactttaaagtagttttttccaattctgtgaagaaagtcattggtagcttgatggggatggcattgaatctatagattaccttgggcagtatggccattttcacgatattgaktcttcctacccatgagcatggaatgttgttccatttgtttgtatcctcttttatttcgttgagcagtggtttgtagttctccttgaagaggtccttcacatcccttttaagttggattcctaagtattttattctctttgaagcaattgtgaatgggagctcactcatgatttggctctctgtttgtctgttattggtgtataagaatgcttgtgatttttgtacattgattttgtatcctgagactttgctgaagtttcttatcagcttaaggagattttgggctgagacaatggggttttctagatatacaatcatgtcatctgcaaacagggacaatttgacttcctcttttcctaattgaataccctttatttccttctcctgcctrattgccctggccagaacttccaacactatgttgaataggagtggtgagagagggcatccctgtcttgtgccagttttcaaagggaatgcttccagtttttgcccattcagtgtgatattggctgtgggtttgtcatagatagctcttattattttgagatacrtcccatcaatacctaatttattgagagtttttagcatgaatkgttgttgaattttgtcaaaggccttttctgcatctattgagataatcatgtgktttttttcttttgttttgtttatatgctggattacatttattgatttgcgtacattgaaccaggcttgcatcccagggatgaagcccacttgatcatggtggataagctttttgatgtgctgctggattcttatcaagggctaacttgtgagagctgcttctgttgcagcgaattccattgtgatcatcttaatatgctccttttttgtttttatctgaggtgtaataagtaggctgtgtataatggtagaaaatgacatrgggtggtctttgagaaaattcttcacaagattctattatgtatacatgaaaatggtagcatttattgctcatttctgaggacatgacaactagtatttttagacaactctttcctaaactattaagtattgcagaagtcataaactaaagccctattagtcatctttctccagagaaccagagccaataggctatctatatatacacacacaaacacatatatgtatatgattataaatatatatgcattatatacattatgaatgtatatatacatgtatacttgtgtatacatatatatgtacatacatacacacatttatttatttattataaggaattggctcagacagttatagagactgagaagtcccaaaatttccagtaagcaagttgaagacctggaagtgctgatggcatagttccagtctaggttccaagacacaggcccgaggtgtaatttccagtctaagtccatgtcagaatccagtggcagaactaatgtcccagctcaaagacattccaggaaagagacagaattttctgttactcagsctttttgttctattcagtccttcaacagattagatgaggcccgttctctatggaaaagacaatatagtttactcrgtccattgattcmcatgtcaatctcatccagaacacccttacagatatgtcagtaataacatttaatgaaatatctgggcactccatggtccagtcaagttgacacataaaattaactattgtattcatgaaaaataaattcctttttttatggggattggttttctggttaaaaaatatatgttcactatcttgggtatcttataaactaagctattccttatgattatgaggattttctttctgcgaaagatggttcattcgccatttttggatcttccactgggtactatagttgtcagtttcagaacctttgtatgtttcagatattcatttagttaactgagaggaataaactgtctactcaaataataacccaatttctacccactgttgtggtttatactacaagatctcaatcctgggtgcatagcagtatcatctaaggaaacatatctcttgcttctggcatgatttttaatcacatgcccagggatctatccaatggtctaaaattccntatcacctaagcccacatagaaacggtgatcacagtttttaatcaanaatagagacacacagtgaggaagaatgtacatataaagttaatggaatataatatttgaaatcaagacaaatctggacaatgaaaattcatataactctttatacaagtcaacataagaatagagcaggtaggcatgcaatttctaaaggtagatgcttgtgttagtctgctttgtttttccataaaggagtacctgaggctgggtaatttataagaaaagagatttatttggctcatggttctggagatcgtacatcttctcagcttctggtgaggcttcaggaagcttttactagtagcggaaggcgaggagagccagtgtgtcacatgatgagagggggaataggagagaaagcaggaaggtgccaggttccttttaacaatcagttctcacacgaactaatggagcgagaacttgctgattaccatgataaaggcatcaagccattgatgagagatccactcccatgacccatatacccgccactagggcccacctccaacactggggatcaaattttcatatgagatttgaaagggatagatattcaaactatatcagtgttcaaataaactataacctggattttggacattagagtcaattgtatctactattgacagagttaaaaaacaaaataataaaatgcagattgattaaagaagagtcactctaggctaactgaattgcttgtggggatacatacacatcagtgtcatttacaacaagggtgtggaatagaaataaccactcagatattgaaaggggcatcaacatcatactactgttcctaaagataacaagagagatatatggtgaatttgaagcagccctgaaccatcgaaatcggtggaagaacgtttagaatctcattagctgatakgcaaagcaaatgtcaggtagagattgagagattgttgagtagtcttggagaaagtggcagctgaaaacaagaaaaatgaaaaaccccaatccttgtccttattcttgtcctgtcaatcatggagcttagagacaaccgaggcacacagaaggttcagcctttactggcaaggattactagagtaaaaaaactgatgctatccataatggatagggtggtggtaggagcttgagaagcaaaaataaaaatgaagaggagattgtcaattaagagtgggtgtaaggactaataaagacttgttcaaatttggtattgggttttgggagtggtaggagtgagctaaaaaacctagtaataatattgataataacaatattcataacattttgttgagtacttattatgcaccatgcactgttcgaagcactttacatatatgaacttatttaatttgcatgtcaacctgtaaagtaggtactattaattggtcccagagacaggctacctcatttggttagggtgacactagagatgaaattccaacccaagtgagccaactccaaagcctgtcctcttaagtataggtatgtgcttattatacttaagtttgtgctctgaagtatgacaacaactaaaggcatctgtgtctagatggctcttcatgaaaatcctgctttttacacgcacatcattattgtggatgtaggaaagtttaaatgtaacaggagtttgctgaacaaaggctaatatgttgtctactaggcaacccttttataaggctgctgggtgaatgaacatggacagggatgagcacatcagagtaatttaggttccagagctgctgagctctaacaactttgtctctccatctcatgtaggaaaaattctgtctgggaggcaatggtgcccctcccctttagacagtgcttagaatggctccaccaacttcagtttcacagagctggccctttctccagtccacattaatttcccattaggctgacattttttcttagatatgttattattacttgagcctttggcctggaaatcagaaatctcttcagtgttgcaatttctttcctctgatccattttgtgaycatttcatatagtttaaccctcaccgtgtaatcttatttccaaaaatgtggcctgcctatatatatatatgatacaaaaggaataagaaaatcacttggctaaacaggacctcaagagggaacctaatatatgtcatagccagtaggcaaaatcttctccttcccaatatatataagcagtctaatttaatcatcctaatggttatctttagacatttttatttacattaaaatgaacattccatttctcttgctgtctctgtcgcatatttgtgtcttttgtgtgtaaacgtgcacacwcatgcacatagtcacaaacaatsataattcagattctggatatgtccaaatgaatgaatttggtgtgagattctttctccccatacaaggttgtggaaaagagcacagaccctggaggcattcagacctgagctaaaaatcatgagtgactgaagaattacttaatctctgctanccttgkttttcttatctgtaaactgggagtaagaatagtatacacctaatagagttaagaagtttaaacaagcaaaaaaaatggacaaattcttactgcaataatatgtattatttaatactaaacaactataaattttattatttgaagtagttgcatgcctttcttcaaagcagcattgttttttcagaaatatttgaaattctgtgtcagaacagaacgaacaatattttggaaactatcacaaaatatgaattcgtgtttttaaatttagcaaaggtaatagggacaaaggaagtcttctccgaaaaaaactaaaggacaccccagttctaaaaagttatattttatttggttatgtaatttgtgcaatatttcatctataatctactgtcaccttctggggagaaaaaaatagctcagtctgtcatccccaaactgtgacattccttttatgactgcawagtaccctgtggagatggtagatgccaggctttttaagactttacaaagactggaggccaactgctttcaaacagaaatatttaccgagaagctaatccatgtatcagagatctgaagagagagagcatgactaaccactgaaaatagggctcattaatggagcaatctgcaatgagcccagagggaagttctctcattctagaaaggatgtgtttaaaaggaaaggccaagaaatggagttagatcaaatgatatatttgaagtaaggagttgaacaaactgacttgagtgaatattaatcatagtgaacaaaatgggcccgttaagttattacagttcatcatatggtcttcattccaaaatatttacttatctaactgggaatgttgaccagtacttgatattttataataatgcaggtaagcataatgtgtgcctgacataattatgtgagcttttgaaaacactttattgtcataagatgtagcgaggacctgctgattatcattagacagcttgtgtatttaggtaatgaatgatttggtaatagtttttattcaggcttatgccagaaacagatttatttttaaattattttgctaaaagataggaaaagctgacatgtgatgtttagcagtaagttttcccaggtgggtagctgtttgttttagtatgggagaacttatttttaaaacccttttttgtgagtttaaaggggcaatggacttaattgttctggtcatgcaaaatatcttttattctggatgtcttctgactttatattttgaatatatatctatttcaaatatctatctatctatccatctgtctgtctatctgtctgtctttctctcctgactgtcacaggacagaagcaaagagagaggatccatcaactgaagagtcattagcactggttgtttttaatatacgccatcattgaattctctcagcaaccctttaaaaattgggtgttattattaccctccctttgtaaattgggaaattgaagcaacttcaatttcccaatttcccaagtaatgaattaagtaagacccaaaatgggtcttggattcagattccgtgttctcacatgttcccttcaataatgtggatctttcatggggtccccagtggttttcatcatcttagtcaagaggagagagtataaagacaccccttaatttaagactagattatcccttcatcattgggaaagttgaggcatttgacctaagctaaaagtgaatgaagcaggaggtagaaccctaggaccactcatagatggagctgcttgttagactacatagcaggctctggcaagtgggctctctgggatgaagtggtgcaagcaaggggagaagatcaatataaacgtgcttgatggtatagggtaattgatatttatttcataccaaggcactgtaaagtgaacataaaaagtcttaaaactgtggaaagagtcatctgtggtgttagaagtcagaagagtggttatgcatagggtggtgagtagtgactggaagacagcacaagacaggcttctggaattctggtaaaatctctttcttgatctatgtgctggatgaataatggttacaatttgtaaaattcaaagagctctacattataatgcatgcatgtctaagtttttattattctccgttatgtttattttattctttgtttgcatataattgtatttctgtttccacattatctggtcccaaaggtattagtttttaacaagttagtcagtgtcttttaaaattatatgtaccataggcgaggcacagtggctcacacctgtaatcctagcactttgggaggccgaggcgtagatcacctgaggtcaggagttcgagaccagcctggacaatatggtgaaaccccatctctactaaaaatacaaaattagacaggggtgctggcaggcgcctgtaatcctagctacttgggaggctgaggcaggagaatcgcttgaacccaggaggtggaggttgcagtgagcagagattgcaccactgtactccagcctgtgtgacagagtgagacttcatctcaaaaaataagaaaaattacatgtatgacaatgtataataaaactcacacacgtgtgtgtgtatgtctcaagcctggtttgattccatctcaactttgtggcagtgggacagtcacagaaggcaaattggctctgagaaatgcaatcacatttttgtgcaatatagacaaaatgggaaaaaataatactaatgctttctgaatgaaaggaaaatatcaagtatagaatcattgaaggaagaatttatcattgaaagtttaggtgatataagcaaggaatttgattatatgaaatatcactgtctccacacagagaaaattgaaggctgaagaaaaacatgttttgtgattatwgcttaccaatgttagaaggccctgtgatctatctcagggatttggaccttgaaatcaggtggaaactattatcctaacaaacacttctcttccaaaattccatccttctgaaactgtgctggtctctcataattaagtcatttatagctaccatctcccctctgtagaagtttttagtgcaagtggtgttagacttggaacatggcacagaggagtggagatcttaatgtttcttgactaaattccacataggtcactgactgaaaatctgcctgtgtgtgaccatctctaataaaacttcatcttatgatagsctttttgcaaataagatacttaagaataacacacttcaatttaccatggattatacctgtatcaggacaacatgaaagaaaatttaaccattgtaaaggacagatcaattttaagtggaatttgctcttatcacaaagtctaaagataaatgcaggcaaatttctcagcaaaaaagagaaaaggatacaacacattgttcataaaatacaaagaagcagcaagctctcaagagacaaaaagagaacagattgcttaactacaaagtgggaacttaagctttccattcacagatgtaaaaataaaacaggaccccaggttaccatggatgaagatatggcagaaatcttaagctattgtatctttggttttgtaatcaaaatctaagcaattgattaaaatcaggttgcagatattttcagtataattgtccctaatcacacattccaagaggaagttgtaaygaaacttttgagtagaaagtcaaaacacaaaagaagagttggcatgaattacccttgggtgagtgtatcatgaggttagattttgaggaacacattaggagttaaattccaaatgccctgtactgttgggagcaaggtataagatatttgagtaacagtttcattattaactaatttgtgatctttttatttcagtggagcataagggatatgataaaaatttgctacaaataaacgacagctttgttgaacaggaacacatttttttttttttagattttacaacaatagaacrggccaaatatccttgtaaattacattaatgagacagattgctacttttaatggaggctctgtgctctacattgtgccttatgcaaatttgccagttaataagcctgaacagtgtttctgtttgaggaaaatgaatctgaaacgattgtcagattatctgtttggcatgcctggctggtgtctggaatggcactttgctaatgtgctattactcagtgtcattaacccacacaaatgattgaaaggtgaatttatatgtgtaccatggggctcagcacagggaacaggcttcagtgaaatgaggctgcaaaggataaaatgaaccattcattttttacctcggttttcatgtgctcactttaaagacagatgatatttaaatacatgaaaaagaatgagacaaaactattacttaaaaaacacaactttgcattgcattaatgaattaaaagttatgtagttgaaagatgagnattcctctccccctcatgatcctcatacctgggagatagtggcaaaaagggcatatcaattaaatacctttgaatctatctcatataagaatattttggacactttaatttaaaactcatgatggaaatgtgaaatgaaaggcttctccttcatgagaagaatttaatttacacttctgcaaattaattaaaatactttaaaatggaaaacttattttttaaaataatacagattaatacagcaaagccatcaaatggaagttatgaaatattttctagtttgtctctttaatatcttgtttgatatttcttcactgggtattttaacacacatctatccttttgaatttcaagggcattggaaattttgaataagcctgtaaataaaagttcacgyccttattcttacaaaataaacagaaaacatcctcttaatgtgattctttcygcacagctagacttnttttcagacttaacagagacacttgaggccwaaaatacctctaacctagctggtcttactctatgttttaaggctatttggaatttaaaaagagaaaagaaatcagacttaaaaaaaaaaagacaaaatgcatacaggcgtaaagttttttgacagtgcgtttatggaactcatccttacatcacgtgctgttaagattcataaagaaattaacaggggcatcccctcaaaactgttaaagttatgtatgtgcctatatgcctatgcatgaaaggaaatttgacgtaaaaatatagaaaagcaaactgtgttaagaaaaaaattactcttccaataagatgtcatgatatcaatgaatttgagggccatgttgacaggcagtgagtcttgggtcagggtgtggtaaactgcatgtcaggggggtccaagtactcatgtaaactgcaggttcccaggaatgctttcttgtttatctctgaaatgctgtgttcagtggctaattttctctgctgtgatattcttttacccaggaaatccctttatttaaacactgcgtaatttctaatgacctttttgagtggtgtcatctttctattcctagtacattcaaaggtcttgtaaattacatgttggtacacttacatgaagtatataatccatgaaaacttatccacacattgttatgcttttagcgtaatatatttaggttatttttattcatccaatttcaaacaaaaatcaccatttccaaggaaaatcattttttctacttttaattccagccttctcagtaacggcttaccacccccaccccgccctcatagaaataaggaattttaagttccagccantcttcctatatttaaatttaagaagttgcatgaaggatatttccaaatttcctaatttaggctcattttacttggatagtgatttccatccttggatttttttttctttcataaggataaaaaacttcaaaagtatatcctgacactcatgatggctagaactttttcagtaccattaatcttgttgaaaaattaaatatttcatacttcttttttgtttttatcaaggaaacccttacaaattaaaatgaataattagtaatttctgcttagctaagcaaatagaccacgagagtaattcaggctcgtgagaaatggcttttctttatcgtttaaaaatatttatcaaatcaaaatgttgcttcttttcctcctctagttataaatgcttgttaagtataaactttgatgtgcatctgacttatttcaaaagcattttgcaatagccttttgagtgtgcactttgttcacgcttaagtttattgccatcacatactgctatttttttctgactcttcactctgccctttattgtccactacctgcccctctcccccaacactagagctactcaaggtgggctgccccttccaaggctatatctcattcacaggcacagtccctatctccttcccagatgttgtatactcatggtgccgtccattctctgtcgaccaggtaacccaaggtaaactgatcaacagaaccatgttaatttgttcatttattcttctttttaaaatacatttgacccttgaacaacatgcgtttgaactaagtgggttaacttatacttggatttttaaaaaataaatatatggaaaaacatttttggagattgtagcaatttggaaaacattgcaggtgaactcgagtagcctagaaatgtagaaaaaattaagataaagttaggtatgtaatgaatgtaaaaagtatacatacatactagtctattttatcatttactatcataaaatatacacaaacccattcgaaaaacataaaatatatcaaaacttatgtgcacaaatacagtctgtgcatagtactatttgcaatccaaagaaatgtaaacgaacataaagatgcagtattaaataatagctgcataaaattcaccttagtacatactgtaataatggtgtagccacctcctgttgctattgcagtgagctccagtgttaaaagatccactaaaaacactctttgatgctatttatatctgcatgagcmatttgtctctccagtaaattgtgtaccacggtaaaagtgatgtctctgggttcccacatgtttattttcttgtttagtgcaatacagtaaactttgattaacaccatgggacctacatgaagtgccactagtaatgctgaaagtgctcccaagaagcagaaaaaaagtcatgacattacaaggratagttgacttgcatgatatataccatagcttgaggcctgcagctgcaatttcccatcatttcaagataaatgaatacagtttaaggacgattgtaaaaaaaaagaaaggaaatatgtgaaaccgtcactgcagttatgctagcaggcatgaaaaccttgtactttttgcaaaatacatttttatcttgtactgaaaatgcagcctttatgtgggtgcagggttattataagaaaggcatacttttgactcacatatgatttgagaaaaaaatgaagacattgtatgacaacctaaaccaaaaggaaggtgaaagatctgaagctgaagaatttaataccagcaaaggatggttcgataattttagaaagattttaaawgtcaagataacaggagaagcagcttcagttgaccaggtggcaacagtgtccagactccattaagaaaatcattgagaagaaacaatatctgcctgaacaagtttttaatgcagrcaaaagtgacctagtctgggaacgaagaaatgccgcaaargaaatttactggtaaggaagagaagtgagctccagcaattaagggagggaggaataggctaactccagtttttcacgcaaatgcagtcagggttatgactggaactgcccttatctataaagcagttaacccctgatccttgaaggaaaaagaaaaacatcagctgacagtcttttgtttgtaaacaataatgcctgagcaaagagaaccccttttgtgaattggtttcaytgatgctttgtccctaaagtcaggaagtaccttgccaaaaagggactgccttttaaagttctttttttattgaacaatgttgctggccacccagaaccccataagttcaacaccgaaggtgtcaaagtggtcaacttgcccccaaacacaacatctgtaattcagtctctagatcaggtgtcattaagacctttaaggctcattaaacatagtcctctatggtaaagattgtcaatgatatggaagagaacctccatagagagaacattataaaggtttggaagaattacaccattgaatatgccatcattgttatagaaaaaatcctgagagccatcaagcctcaaacagtaaattcctgctggagaaaactgtgcccagatgttgtacatgacttcacggaatttatgacagagctaatcaaggaaatgatgaaagatattatggatatagcaaaaaagatggagggtaaagcatttcaagatatagatcttggagaaattcaatagctaatagccaccatgccagagaaactaacagaagaggacttgatggagatgagcacttccaaaccagtgccagataataaaaaaagacagagaagaagcagtaccagaaaataagttgatattagacaatctagcagaagggttctgattattcaaggctgcttttcacttcttttacaacatggatctttatgtgatatgaaactaaagcaaatggtggaaggaagattggtactttatacaaaagttttaaagaaatgaaaaagcaaaaaaaaaaaaacccaaaaaacagatattatgatgtatttcagtaaagtccrccaagtatgccttcctctcctgcctccctttcacttcctccacctctgccaccacccttgagagactacaagaccaacccctcctcatcctcctgctcctcagccacatgaagaaaatgagaatgaagacctttatgatgatccactacctattaatgagtagtaaakatattttctcttccttatgatgctcttaataatattttcttttctctagctttccttattgtaaaaatmcagtataaagtatatataacatacaatatatgtgttaattgactgtttatgttattggtaaggcttccagtcaccagtaggctattagtagttaagatttggagaatgaaaatttattctcagatttttggctatgtgaagggttggtgccccctaagcccagcattgttcaagggctaactgtattgacccttcctaagagactttcctggaatcaatacttttatgcagtgactatgcagacacagggcatcatttacctttcaaataatttcacgctcttatttcttatctttggaatccatgtagtaattttcattaactacagaaaatgttgccacataatgatgaytgtaacttccagtgataatgtgaaaagaaaatatatgcatgctgcaagggttgtgcctgcttctcccagccccattctctctctctgtttttatctgtgggttgatctttatatgtttctctctctccctctgcacacacacactgattgcatttcctgttgttctattccttctctatcttccaaaaaaagtgattgcattcattatctattgctgcgtaacaaattaccccaacatttagcagcttaaaacaaaaacattggtcatttcaacactggttctgagggtggggaatctaggagtagcttagatagttggctctagctcagaatctctcattagagagcagttaacctgtcagcaggggccagagccatctgaaagcttgaccagggctggaggatctgctcccaagttgtgtcagtcctgtggctgttggcaggaggcctcagtttctcatcatggctcgagtgtcatcattacatgacagctggcttccatggagcaaatgatctaacacagagcaaggtgcaagcaggaagccacagtaccctttattacccactctctaaagctgcacaccattagtagtgagtcactagatccaggccacacccaatgggaatgaagttagactccacctcttgaatggctaaatgacgtcgtatcaaagaaatatggacacaccttaaaatcaccatctttcttaagaaagaaaatatctctggtcacttcaataacactataatgtgatttatgaatggcttttaaaagtaaaacaatgagtatctcctttgaggcctgggattttttttttctcgtattcaccctatgtccatagctcaactcaagcatagaacctggcagatagtagctggtactgaacaactatagcattaattaattaattaatgtcttcaaatgctgggatatgttttctaaacacttggagttttactaccaacatttgctcctcttgctctgcttctaataatgttaaacaggggaanatggaattnagggtatttattcctttaattaaagattgatttaaaaagttacaagcatcataatttatctcttaattactgtccaaatgtatgtgaagtttatatgtagtttcatatatgttgattatctgcttttagaagtcttgtttattgtctgttaccttcactagattttaagctccgcaacggccaggatttttgcctattttgggtnaggcagtatccccaaactatgacattgtgtgactctatgagtaggtactctatgaatgtttattaaatgaattaattaaaattttcactaagctaaggatgtcagaaccttgtcatttgcagggattttgcttagacaattatacattgtcanacttacttggagatcttcaaaatccctctcctttttctctgggctgaagacttcagcattaaaaacatatgattgaaacacatacttattgctgttgccagtatacaggctcatcagaatgaccaggtttacttgactagcttgtcgctatataccttggaaagcatagggtaagataatgggcagaaaatctctacagtcaaagtatggcaaagaaaagctctgaatattggtgaagatagaaaacatgttccaaggcccgggcaggagtgcagaaagnagaaaggtcactggggaaattgcttgtttgtaataccagtcctgaaattagaaatgaaatagcatgtgcaaatccaaacttttttttaacctgactgctttggatccatctgtgtattttgtcatcattagcttttctaatttctaggatacaaattgctgtagatcctaaaataagctactgaatattctctattcatttttacgcaccccatatgttacccaaaatgatgggcaaatctaccttaaagaaccaccaaatctgttcagaaaggatggcactgggagaaagactatttggctttcttcctacatggaagaaaagaaacacctccagaggagctaggacattttgtgaaccctacacgatattgtagcataacacaatgattcaaatacttgtcaagttcaaagtgactttagagactacatattctaacctccccttacaacattagataatttggataattttccacttcaagtatgtcaacacgatggttttgatgattgcacttcttttgttcctactttagagatgggagggactggctgcaatataccttgagaggctatcccctggcagggattagtcatgttaggagtctcttcaaaataactcatctgcttcccttcctcagcattcctctgtctttgtggctgtttgttttaaattttttattgtttacttaacatagcctgcaagtgacccatacggtattcatttggaacgatgcgccttagtgaggctttttatgacaccctgcagatgttaggcagcagtcccacggttctcaccatcactggggacacacgttcagcctggatcatctctctgtgaaaagctccacaagaatatctttttcattatttaacacccacttgtcgtattttatttgaacatttgatcttcaggttcacttatttagcccaaagtgaaaatgtagcacctaataccgttctaaaaactagtaaatgttctaagttctgaaaatgggaaagaattatgatttttcataaagtttcaaaacttacatgaggtataggtgggaatacaccctcaggttgaaacaaaagcctattagaaacttttttcatgctcatgataagaaaataagacagtgatttgtttacaaaaatcatacaaataattctcaaaagccattttggttacaaatagatatgaaattatttataattaagcaatctatgatgttcggaaattatcatcrgtaaaatgttatcctctatttaattatgcattcttgttgataatgcataaatccctgtgattatgttcttaagttaaggaatttaaaatagctctattttagatgctcctacttttctgacttaaaaaaagcctttcgtataccaaccaggataccatccaataacaantcctaaagcttggaaacttctctaatcagactcttcttaatgacgctgttctcaatacttgtcatttttaattgtagatggcaaaaacagcagtagcaatttcatttctgtaggaaccaattcattattatgcagnctgccaatgatgctcttgttccaactcctcccagcatgccaacttagccttcaccaaatatttttcctttaaaagtaaaacaatacagagcttttgagtgagtcttgtggtgtggttcagtatcaatagtttccaaatcrattttattggatcaagaaaatgagatgtttccctccatctacatatccagcacctttctgttacgtaatagaaatggtaccttgtgaataatattgttccttatgtcattctttcagcttacgcaaaagtatttataccgttgtatttcattttgcacttcctgagaagactggtttacagtaaagatacgcagttattttattaaaatgcttcattatttaaggtgaatactggtgacttaataatagttggagagtttaaaaatactaaggacagaaacctctttgtgttcacatatcttttgccctctctagactgttcctagggggcaagacctgtttcttattcatctttgtatatggagtacccaatacagtaggttgaaaataaggagtcaacagttctattgaataaatgaattgatggttaaatggatataaatgttgctaaaagtcatatgctgagatttgcagtgttctgagatttacatttacaataatctgaaaattaaaataccctactattttgataccttctcttttcttcttttttctcttttgtctcacaagtcatgttaactaaagcaggttactcatagatttttactaggaagatgtttcagacctgaaacccccacgtttcctcctctggccatctgctctgtgctctgctttccattaggatgggttcattttctgcctcatggtttggactctgagcctcagtctctgcttgtgcttcgttcagtgttcaccattcatggcatggttgggcttcttaccctttaaatcaggagagcctggcatcttcctaagctgagactgctcttaccacgacttcttcctgaacgcccttcctcttagcggcagagccttcttgttctccctgttagggatgtgtccacatattcagcggctctgcagtccccgcagccaccnntctgcgggtgtaggtcacagttaggcactgcagcctggctgacactccaatcactggccatattcatcagccctttctttagtgctctatgtggctagaagcctggtttttctccaacatgaaagcccggtgtttagttagtggagagagcacagcatgtttgagggcggcagctggaagactaccttccccaccagaaacagatcaaatggtcatttgagatatttccaggtttccttgtttaaaaggcagacagatcaaagacactgtcaccctcaaagatttgaagactagcagagcagcctcaaggccatcaccccctcatgacccctaactgttcactgtttgtggtgactttgcactatgtgatctgcctgtctaccttaatcaaaggatctagagaatcaaatactagtacacttagtattctgtcttgaatatcaacaagaatagggccatttgttagttatttgaatacactggaagaaagtaatctgcatatgttgtttttaaatttgctacataaacccaggacacatgctagtgatggttgtagtttctatattttatttttaggaaatgtctaaaacattacagcagttaagtcttatttcattcagaaagctttatctgactttcccttaaaaccgaattacctcctgtatgttgccatattacaagaagttaccctagaactaggcatttctcctgaaattttcatttttatagtcagggttaacttgactatattctgcactagagtgattttaggctgataaggtcctttatgagcagaggatggatcttatttataatttttacccgtaatatctaatatagcacctgaaacaagtttaccactcagtaagtatttcttgaatttgttagtataaattcctaatgtacattgtgctcttgtcctgtgactagtttgaatgtcccatttttttgttgtctacatttataactatttactgtatatctactttggtataatatgtgtacacatacatatgtcaaacagaagatatttagaaagagaaagggggggaaagtgagcattgaggaaatgttttgcccatgcggtaatggttaaaaaacagcaatggattttcttgaangcggttatattttatggtatttcagcatatagccttttctctattcactcacctaaaaaaaaacccaaggctctatcaacttgattgaggaaaggattgtgggaatcactaaaaagataaaaagtcaataaatagttccaactgccaatcatataaccacaagataaaaaaagaaaatcaaaacaggcaaatacatgtttcattttatttgggtaaatttccacatatgaaagaatatcttgggttagcagggaaagcaatctgactttaccagcagctttgcaagcatggtcactatcatcgccacgcatcacctctgattgacttcctgcttgctaccaggttcggttggtgctggattagaaaacacagagtttgagcagtgcaacagcatgctgccggtgggcttgccaaattaaagccccaagcccagggttgtcattgttgttattttcatagaaaaagactaaggataatgtaacagaaacaattcaaatggccagaaaatataggaaaatgtgtcwttgttaacagttaattctattaatcagcttgagatatttgtaaggtaaaattgaaatggtatttagattagatgttggaaaaggactgtatcacatcttaacttcatgggaagaatcaatcaaacattaagtgaattattatacattgcatgccttgcactatccttggaggaaaaagatnctttgcattaagaagtcttcccttcaagtctttctgaaaaagtaaatgatctatttatatcttcagagtacttaactaagcagaataactatcattgtcaataatttaaaattatgatttatgaacatgttctacaataataaaatgtttgtagaatttaatatgccaaaatatcagaaaatattttaaaccatccattgtgcctacatagaaagtatgctatttataatttttgtgaataataagcatctttcatatacctatgtggcagttagaactctaggatggaccacatgatsgcttcctcctgatatacanactctgtgtaatcctatcccagtaatagtgggtggacccaggaatgtgatgaagtatcactcccatggttatgttacattgtttgtcaaaagggattttgtagacataattaaggttcataaacagttgacactgtgtgtattagtctgttttcacattgctgataaagacatacctgagactgggtaatttatgaagaaaaagacntttaatggacttacagttccacatggctagggaygcctcacaatcgtggcagaagacaaaaggcatgacttacatggtggcaggcaagagagaatgagagccaagtgaaaggggtttcccctgataaaaccgtcagatctcgtgggacttattcactaccatgagaacagtatgggggaaaccgcccccagtattcagttatctcccagcaggtccatcccacagcatgtaagaattatgggagctacaattcaagatgacttttcggtgtggacacagccaaaccacatcactgtgttggacaaaaggaagataagcatgttgctaactatttaagttattgcttagagaaaagttattattagaatggctatttaaaatttagtattatgaattcatacatatacatggatagacttcttgaaaattcaagtyataaagaaatacgaaaaacaccaaaaaaaaaaaaaaaaacaccacatggacagttccatccaccaacaagagcataaaatgcagttacccacagacaatcccagtggaggtacttgctggtaacttgtgactcctactcctttttaaaagtgctgttttcttctatttgattcaaagaaaaatttatttccacaagaaataactggaatctgaattaagtacctgtcagtatattttgattctcgctattatcaataataatctgttnccatttaaaataatgcataagtgcttaatgttataggaattatatttcatgcacattcttaatccatgagtgagtgacaaatatgctatatatttataaaattatgaagaatacttgtttcaaacttatggtaatgatattatcataataaatgagtgctattctataatgagagccttttagggaaattcttttaggccattctgggatcatgtggtgaaccacctttagaatgacattcaagtctccctgttttgaagaagttggaacctatactaactgctcttcctctaactatgttgtccttgataaaacagtcttttgccccattgttcaaatatttataacttacaaaaaagtttatcaaatccactgcattgaattggcttgtaattatagtctattgtatacattgattgcattttttccatctacaatgtgacttatgagtctgatatagtctcagtcaattacatgtgtataatcattattgaaccaaaatagacaatggcaggtctggagccagtctastctgataccttaatgggcctttagagacttttaatacactgactactggaataatagtcagtctactgaatgactttgtatattttgatttttttaaactcttgaggtacaaaagaaagttcttagaggaaggaacattaagagtaacaatcacaatgccatatgaaaatacttgaattccagatgtacttgactatgctccacataggaagcgatgagcaatttgaaaagaaatttaagagttgcttatatttggaaccactgtagtacttttgcctctaatcaaagaaaatatacagtgggattcagagttccntgtaactttatgttctttctaaaaatagatgtagtggacaaataacccaggaaaattcctaaaaggataacaggggtgtaaatcaaaagatactagtaatatccacatatacctagttcagaatttcaagataagagtaactagaaatctttttagagcaatcaccaataaattataattctatacttcatttatttatatgttaagggataaggcttggggtaagttaaagtgatatatataaattcccatcataccatttaaaatatgggattactatgaagttcaatattctattaaataatagtaataacagcacttactcattggatcattatggggattaaaagagtaggcatatgcaaagctrtaggaagtactcaattacaatataattattatcattcatttattcctttacaccaaaatttcataagtacctattacctgtgtgacagagaaaatatattttaataatcaaactaccctgaaaatgagttttaatcttgaaagaccttagaagaggtctcactgaagtcttttccattcttcaattagctctggtaaggaaggctatcaattkttgtggttcaaaggaaagaaatgaaaaacaaattttaaaatttttgaaagaaaaaagagatggaaaagacaaactgaaactayatatttgtcagctccatgaaaaaagaaagagatatctaacgggaaaagcagaaaattctactgtatgtatttttcaacaatttttttacttgacagaacaatcatattcagcaaaattctattaatagatatgatacagacctcttccaaaccctgtttttatctcagttacccctattttctagtcaaaacagaagtaaaaatatcatactacaatgggacagactcactctttccaatgctgagctccattttggttcatctgaaacttctaaacgcctaaaaatattctggccctatattaataatgagcagcttggagcctcatttccttgtaaacttgcattgaaattatgtaataaaaaatttaagtgacggagnaaatgtacacacacactacacaaactgatcttagattggaaattgtggactcttttctaaggatagattctcctaggttagcaccacacaaaaagctgttcacatttctcagagttctatagaacagaatgggttagcagagttctctgtccaatctcctcaggctaaaattaagttgttagctggggctgccatctcatccgaygttcagatccttgtccacatgctttcgttgtggttgtagacagaattcagtttcttgtgttgtaaagcagaattcgctgttttcttgctgtaagtccttaaaaagaccatcagtctttctatttctttttctatttctgtgtctacctttatctcaatctctgtcacttctccctctctctctctttctctctctccaagatctgtgactgaggattcagaattaaatagttaaaaacttcagtttgaccctggtactccagctgctgaaatattaacagcattaaatgcgggcaaatgggaaacgtgagtgtagaccagaagccgttcagccgtgtgctcttgttttgttggttcctgagagtagaatctcttgtgcttttcccagasagatgaaaagtgacaaaggtggtagaaatatttgatattgttaccacaattctttgaaagcaaaatttggcagatggatagagaagatagggaaggggttaatgttcatntttgttttctttttttcaagaaacatgcttttaatatngtgtaaaacaccctagacaaatctgtaccctatatgaaaaatggttcccttcttcattttttaaagtatatttgtttgcaatcagtacatataacaggtttgaaaaaaggaaaataacaggaaatagggatattgctaatgtttctcaattcaaattgaaatgaattcagaaaacaacattgaataacatattatattgacataaaatattaatgtgtgtaaacatataggtaaaggtattgtgggaaatttctgattagcttttaacttggtcattgaaacattatgtcagttgattcacttaagagtatctaataagttctgcaaatgcacagaattttctgggaacattgaacttagaaatgaacatagtattaacatcttattgcccatgttacttaaaatattaaaagtcagtcatttcttcagtgaaaataattntagtcatagaaaatgttctaatttgcttttaattttctaaacaaataaatctcaacctcatatttgcatagggaactgaatcttttaatagtatttgtataagtctcatcaatgaatgtgttctatgcatgaagtatggaatatctaattatatttttaaaaagaaaaactttcatttttacacattggtacataacttcaccttcttcaacttcccagacatttccaatgtccaaattttggttacgtccttgaatttttgttatttccttaatatgtctggcttcaggaattttcttcttttaaattaaacaatatctgttatctgaaaatcaagtgtaaaggcagccattcacttcattttcaggatttatattgaacactagaaccaaattaatctcttgcactccagaattaagaaggttctaatgacacagtcagtgaaaatgtacagaattrttacagttgagtttaccaaagcaagttagtctatttccatcaccactatgattaagttcctttaactcaatgaattccccattcccacaactgactttcctgcagtcttaatagccaacttgtatactttccttatacctagaggatttaaatatgaaatcaacttatactgtaattttattttacttgaacacattttctcttttcatttttttattttactttcttagtcggtggtgtgttcctccatattaaggctttcattgccttataattattaycattatacacacgaaagatacaattgaggggagtacctttacatgcagccactcagcaatataatgagctgtgtgtttttcacatggaacaaagtccctagatgtcactcacaggcctcaccgggtagcagtcatttctttggcatatcaactaccatctatccagctggctttcaaacttgtggtttcagacactggtraatttaatctcatttcataggaatactgatgtatcaaaccaaaattgcaatttaaaatgaaaaacatacttgttacctgagtggaatactcctatggacatggtggatgtagtctaaatacatgagaagtcaaattatgtagaacgtcaagttattaataacttgaactaatatctcaaggacaagaatatcaaggtctgtatgatgaaagcattttctctctgtatgcagatgcacatggaaaaataagtaataaaggttgctcagaatcagaataaggataattagataagccactttatttatatatttatttatttatttgagacagagtcttgccctgtctcccaggctggagttcagtggtgcaattataactcactgcagccacctcaaactcctggactcaagcaatcctccagcctaacctctcaagtggtttaattttttgtagagatggagtcttgctactttgcccaggctggtctcaaactcatgcaagcaatgctcctgcctcaacctcccaaagtgttgggattctatgtgtgttccaccacacttggcctaaattgcatgcttaatggttttgggccattacagatggacaccaaatgcaatcgaggttttgttaatggggagggaacaacataaccccttacctctatctccagcttagacatcactttgccaatgggaaagaattcctgaagtttattgcccaaacctcatacttttctacaatgtttgaaagatactttgaatattgacctctgtgatgactctttcaatatgatctcatggatgattaatactcttctgccttcccagggattgggacactatttttaatacatgtactctatacatttttcacatttctctcttgttccattctgtttcagtcttataatgtaacattaagagagcagtataatttcttattattttcaagtttttgagaaataactcattctgggctgtaaatattgataaatatatacctcttaatgtctttcccatgcacttaatttttataatctaacttaatttttaaatttaaatttaaattagaaatgttcagcgatctttggatactgatatgatcaaatcattagaaaatgagttttataggtgtcaacagtttatgctattaaccacaatgacaaccagaaaatcattgagtcataaagtctcattctaccttctagaacacttagtgaagaacctggtaggttaaagagtgaatcaagtatacctgtagctaattttatagtactcctaatcnacctcttcctcagtgtatcatttcccctcctccacaaatcccacttgcttgttttcttgcaaagctgccaagaaactgtgaacaaatttactgtctgaatgactgattgctctctcagtgaccttgaaaaattgcttgcatcattaaaaattcatagaaaataacgttttggagaatactcatatgtaatcacagtacctcctgctatgctactatactattacaatcttctgaactttaaaaactatctcaaagacattaaacttgctctaggtatctagttaaatcaaaagtttcttgctgatttttctttctcaaatattctgcatattctccatgcagaaaattcttccacctttttctgcatatggagaataagaaacagaaaatcagagtgaagagtctgattgactctaaatttttgcgacatgtcagaatgcctatttcaaactgccacaaagtatcaaatgaagagtgtcagttgttcttttaattgaggtgaaattcgcgtaacacataataaccattttaaagggtgaaattgagtggtttttttgtgcactcacaatattgtgcaactaccaccccatctagttttgaaactttttaaccccgcagaacatcctctaccctttaagtagtaactccatanttctccctcttcccttcttctggcaaccaccaatgtgctttctgtctctatggatttgcctattctggatttcaatcgttttaattttaaatatgtacaaattacaaattctgcttatgcattgattgtatgcctcatttttcttgaggaatgagacatggaggactaggatgtgaaatcctagtaataattcctggaaactctgacaagatggtaaagtctcaccataagcagccttctgatctctctcccagaacaagtatcaccctctactgtaatgatctgcttatttgtctgtattctcttcaagacagtaatcactggtgggctttttttcaaactgtaatgcttagcacaatgcctttatatgcttcagtccttggtgtttgctgaaggaaatgaaggggaacaggaagagaagaggtggagctcattagtgatgttttgaccctagatgaataaatgaagaaatgattttactgggttctgtttcttttttgttttttctttcttttttttcttccttttctcttttttctttttcttcttcttttcctcccgatgtctgattttcctgaaattagtttgaagactatggaattggctccagaatatacttattgtattaaaattgaccttaccttgtcttatccaacatttggctttattagcatataagcaatgattatgtgtcatgtattattatctaattggtaaagagctatgtttaattatctgggtaatgcaatctgattttgatctgtctgttttctttcactaggctttctttcctcttgcacaacacttgtctctcaacccacccccagcaccttgcccaaagcattggtgcttagtctggtaggttcagtcaatgaacactcacccagtgttagagtgagataactagttagatgacggcctatggaaaagggagaaaaactagtttcaaatcccttccttcctgtatattttccgtaaaatctgattattttgcatggaatagtaggaaatatgatcatatgaaaacccagtgtcaaccacattcnatttcctataagacagcttccttttaatgggcagattgcccacnacaaagagtagtgagtatcatttcagcaatggataagataagcactttcttttaccttaccctctttctttcacttcatgtttgaagataatgaatgctggtagatctgtgttgtatgtctgaaaaaagcaaatggtaaacaaaagcctcccctataattctttaaacctcaatgctcatgtgccttcattctctgttggcttgaacaaacaattccttcatagangaggcattaggaatgtattttaatcttgtttccaaagttctgtgaagatagtgctacctatttgatttgtggagaagaatgggtccttgttgattttacagaatttctaaggaaattgttttctgctcatttcatctttcctctggataacacgtcacattatcttgtanggtagtgtctgctgttcgcttctcagtgccattaacatacatctgggccaccctttgtgtggaactgtcccctggtgaaaccctccgtggtctggggtggagaaagactgcaatttacagagtccattatcacctctggacgtgtagaatgataatggaagtgacagaggtgcagctgaaaattggctcttaatattttatgtgttcaagcaaaggattggaaatctcatgctgctctttagggaaaatgaagtatgtgggattttttttttatcagaaagttatatgcaaagagttgactgcaggatttcaaanaaattgttacaccatattcatttcttgntaacgagtacttttcactagggaaaaatacttttgtgtgaaaaattaatatatggaagcaaaatgtatcagcattgaagcaaatttaaaataatgtaccatatacattaccactttgttttaaccaatatgctatgtctatagagtcataaatatttgctttaaaaggttatctttaaattgtttggttgctttttgttactttccacctaacatattcttttctgacttacagacacgacnatgtttcaagagctatcacggtcatgttgattttggaaacggaaattttgggtcagatattttagtgtttaagacatatagtataagatagaaaacaaatacagtttctgaaatagttanattgataatttaacatttatctcatttgttataatgtttattatttcactaaagagaggtgtttatcaaaagaattctttcttgaaaaatatagttgctttctgttttgactaagacgtgaaacaatacagtgtctgtagaagaattttattacttttcatcaatctgatctcagacaaaacaaaagtagtaagacaatattctttcttactaataaaagattaaacaacttgaaatttagcaaatgttaggatatgtttttatttccttaatgtatatttatgatgagaatttccaatttctctactttaccaaatagtaactattagggttattactatatcactattgacttatggttaanatatcgagattttacattttgaagcatttggagatgaagggataaacttggtgaggtttttcagtaacatttcagaaatgacagactactttttcttatatgtttctgtcgaagtttcctttctggaaatgaatatcactttactaagctgtaagcaggaaaagtttcaagctgctgtggtgggcttcaaacctaatttaaatcagcattgcctgccattttgagtaaggtccctgtagatcagtttatttagatgtgtaatgtgattcagatgccactgacaagatcagattaacaagacttccacgttgagatttaaagtgacttctaaatgctacaaacactctactagtgatgctcaactaattgctacntaagtcatagatttttcatatttttatgaaacaaatgtagtttttacattgtatggaatcantatgaatacctttactttaatcactaacatttattgaagatttatgtgctaacaaaattataggcacttttacatatgttctttatgctacattagtcttttggggcatgcttatgagggaaaaggtgattgtcctggtcttcattcgccccagacctagtttaattcctggaaattgataggacctcaataaatatttcttgaatgatttaagacattacttaagccatgatgacaaggatatctatgtaaacattttaatttacctttttcaaataagcaacttggaaaatatgtattaaatggatgacttttttagtttactccatgccatgcactgcagtttgtggaaacacgtcactcttatttaagcagcattactaataatagataatgaagaaataaatttctcagagaaataagacggagaaaggaagctgaaagaatgataccactcaaatagtttttcacagtgcagttcaaaaccattagatctttgatgtaagaagtaccaccaaggccaggtgcagtggcttatgcctgtaatgctgacactttgggaagccacaccagaaggattgcttgagacaaggagtttcatagtgacacacactctctacagaaaaaaaatttttaattagcctggtgtgctggcatgcacctttagtcccagctactcaggaggctgatatgtgaggatcacttgagcccaggagcttgaggcctcagtgagctatgaacctatgattgtgctactgcactctagcctaggtgacagagcaagatcccatcttcaagggggttgggggaagaagcaccaccttacaatttacatcctgctaattacctataatgcctagatgcagtgatgacatggtggaaagggcagatctgttatctgttctctcaaagggaaatgatgtatagatagaaacagagagattcttataaaatagaattctccttggtgagttgctgactaaaattaaattgacataagtaaataaatcttgaatagttcagggattgttcgtccctgctgacagtaacaagaaacttgggtacgggccagattttccactgcagtctgaagaactttgatttcttgaaatgcatgtcaccaaaatttgacaaatgctccaatatttaaacactactagaacctagaactttcccatacaaacaataaaatgtaagactaaaacttaaatgactttattgtttcaataaatataagactaaagttcttaataaagtcactaacagatatcttagttggcagatttactagaagagttctgtacagggtttatatgtagatttgttcagttacaagtttgaaacgttgcagaatttcacattccactctttatacaagcttctattttctgactaagaactgccaccactttcttagatgtctttatgttttcctcattcctgtcaatggcttgaagaattggcattcttctggggaaacatttttcatgagagaaaaagatttttgttattttatgagcatgagaaaattagctatgtgagatgtggatgctgcataccaccatacacsttacaggaagtcaatattcattataacaaatttagaattatttttcattgatgaatctcatattaaaaattaagtgttcaatccataagtgtccgtgattatttttaaaggggctggtttcatgaaaggcctggaattttggtggtcatgacaggcaatggccctctcattgcttttgcgtaccaagcakgtacataaatagaattccagagataaaaacttcatcaagttgagggcttaactggtttgctgttttgagaagggccaggtaacagtggtctttctttttgttaccaggtatggatgttccctctgggtcctgccaggtctagaacaaagtagcaatatttcaagtgtcttttttgttganataatttgktttttttttcccagtaggagcaagtttgcataatcagtatgtggggatgtgtggggagtaaggggaaggcaatggatatggggtcttacctggcgtagccttggatcaaatggccccatgacattagaagagyctacttagagtccccaaagaaaaggggcacctagaacagattaataactacttctgttttcaagttaaactggccagaaaacacatgaaaacaattttagcatccaaatacaatgaatcattaagtgatataaaatgtttatctcgaaagagagtgtatccattacttagagcttttctgtgtaaaaatgtatttcccaggtgtaatgacattagcatatactttcatgtcaaaattctgcaggcttggtagttgtaattcaatttattaaaggaacawacgtggaaaatgttattgctctgttctttctcacaccaccatatgttacacttgccaccattttctctcaactccacyctgagttaaagctgcttttcccaggatttggagacattttgcttatctttccttaactcgatccaytatgtgccatcactagaatttaaaattgatttcatatccatttaaattaatttgatcctcacaataatcccaagaggtagacagagtggattgtattgttagtgaacttctttctcatatgaggaaagtaaggcccagaggggtcgtatgggttgcctctggtgatgaggttttcgcttttcaaatgttgcatgtgtggctacaaccatgcttcattgttcttcccacagaagacagtgtccacaaatcaggctttctctctctctctctctctctctctctctctctctcacacacacacacacacacacacacacasagacacacacattagcaaaacttgaatacttgtgacatgctaacatcaccaccattttctctcagccccgccctgacatatcagggtgagactatcagagtggagctgagagaaaatggtggcgatgcatgttagcacgttacaagtgttgcttttctcaactggacattagctggaaagtgtcagcaggaaagagattgtttgctctactgatgaaagccctttcctattaatctgtcaaaattctgtctatcctatggtgccagcccaagccgcttcttcctgaaagaatatcccctttcctacaggtttcctctgttattatattctttacagtctgccttacggtagactatttatttcctatcattgcgtcttaatgaatctaaaattaggcacaggctgggcgcagtgggtcatgcccataatcccagcactttggaagccgtggcaggcagatcgcctgagatcacgagtttgagaccagcctggccaacatggtgaaaccccgtctctactaaaaatacaaaagttagctgggcgtggtgacaggcacctgtaatcccagctactcgggaggctgaggcaggggaattgcttgaacctgggagaaagaggttgcagtaagccgagattgcgccactgcactccagcctgggtgacagagtgagacttcgtctcaaataaataaaaaaawaaataaataataaaattaggcaggcctgacttttattttcagaactgtcactttaactagctatgtgacactgggctagttgttacattttgtaatataactttccttgtctataaatcagggcccttgtctcagtgaagttttgaagcttaaaacatgtaaatagttaagcaaaatgtgtgatacatatraagtgctcaataaatgggacctgctattatttttggatttngtatctctctggagtttaattcagatattcattttcctatgaatctagaatagtaattgaatatagaattttataacaatacatatatatgtatttctaatctctagctcttcaatwttttactagacaaaatagattcagatctaagaagatgtatctagataaaatacaacattatgatcatgctacagaggaacacatcttgattctataactccaagtattatgaatatgaataatttttgtatgcagtcaattcctgattaggtcaaacagagaaagaaacttaagaatagataatggtaagattctgccagtctactaagctgtgcatagggaatgatagagaaatgctgtggagaccaccttgtgcatggatagccaagataaaacagtggtatactggtcatgcacaatcaacagacgtatttaatgctccattattgaaaaaccagataatcgcagaaaatgaacggatttttttaaagaaatttatattgagtaaaattcacccattttagtgtacagttttatgagttttgaaacgcagtgtgtaaccactatagttgtgtagccaacacaatcaagatgtaggatatttactgttgtgtgccagtgaacctgaaatcaggcaggtttaaatttaaatctgcgatctgccactttcattagatgcttgtcattgaacattttcctcacctccaaaatataccctcatgtctactttccgtcaatccctacccttgctcccattgtctggtcacacttacttgtttcctcgccctgaagtttctttctttcccagaatgtcatataaatgtaatctaaataatcatcattatgagcttactgagtattgcacaattactgtatgtaagaatttgtattgtaatattaagtagtccctcagagtctatcaccatatggaatgctcattttccgtggatcgagtcagataactatttttgaattcttgtcttccattttgtagattttttttttcctacagcctttccctctgtctttacagcttgccttcagtttgctctctggctacatcttgctatgctctcctcttcttatttgctacttatttgtatcatagtaaatcagattaaataacttgttgaatcgttggttacttaagaacagatgagttctgaatgaggccggtctctttaggcactctcttgagacaaagtgtgtccttcctttattctrggtactttataaaatctacctttataaaaaccactccrcccccccacgttgttttttttgtttgtttgttttgttttgttttttttgcaggctctttgttatcttccagaaacgtgatattcttagtaagtaacttccggtggtgctatcttaataataacagggagtcacatcgcaagctttccctctcctccgctccagcactgaacacctgtgtttcactgagcagctgaagacttacttcttccacctcttcaaaaatgtgtcttgatgactccactcgatctacatttctctcacattgctcagaaaattcatttattgcttttttgcatactcatttgtttcgcagtaacttgaggcttctcggcaacaaaattgtcaagaacttacttgtactttctcctctaaatgctttccttcatactagacatattattgccaaaccaataaatatttaccgatttgttgcttgattcgctggtataaagcaacataaacaagagtatccttatcttactgaatttgtttactttatgttactgattctatcacagggtgtactatttttaaaaagccaattctacaggactgttgttatcaagagcggaattggaaaacatgccagctgaatccgaacggaacagaaacctaaactgcattcagctgcattccctccccttttcactgcaatttatctaaaagaaaaaaaaaaagattcatttctctaattaattcatctaggaaaaaaagggttggagggcagatgaaattcaggagaaaaaaactaagaatggaaatgatgtatagttgcaagtagggaaggacaaaataaaccttagtaatttaatttacaaatcatcccctgaaaattgatatatatttgttatatgaattgtctctatgccctctccattacaaaaatagaaaagcaaaaggcaactaataatgaaaataagttgggtgaggtgacagctttgtcatttttttaattggattcgcgctctccttcccttctgaaatgacgcactcaagactctgcctccacagctgtcagtttagttccctcagacattattaaaccctgcaatgaagcttccattggaataaatctaccaaaagtggctcttcatatgtttctctgtacatttctaaatataattgaaaactgtttcagtatggtatttcagttaattttttttaatggaagcaaaatcgcggagttgcagactggtgataatcccctgcagatataggactttcagagctakcccaagagmtctgaatacagggagtcaatggaggaaagttattgatttgctcctccagttctgaggactgttttactgtgttgtacctacggtactttgtccccttggccaatcatacaggttcctaaagtgctttaaaaggcaatgcaggcccggcgcggtgcctcacgcctgtaatcccagcactttgggaggttgaggcgggcggatcacgaggtcaggagatcgagaccatcctggctaacacggtgaaaccccgtctctactaaaaatacaaaaaattagccaggcaaggtggcaggcccctgyagtcccagctactcgggaggctgaggcaggagaatggcgtgaagccaggggggcggatcctgcagtgagcggagatcgcaccactgcactccagcctgggcgacagagcgagactccgtctcaaaaaaaaaaaaaaaaggcaatgcactccagctgcctatttacttgctgtcagacaagcaagtatccccactttataagtgggattgctgaggcccacagtgaacttccaagaccccatggtgaataaaggagaaagaggtcaatgagcaggtctttatctgccagtgcagttttcactgtagaaccccacattagcagagatgagctcaagtctgttgtccatctgtccattcccagtataatctatggagttagtttcatgctctcaaaggatattcaggagaccattagcatatatggagatgcgctatattaatagccatctccatggtacaagactaaggaattcactctgtcagtattcaaaaatggtgatggagtcttaatggattaatatatgtttatgtatataaaataaaacattcatggtttaattaaagtgtttgtaaattatcttgattttatcttagtgaaaaaatagggtgtttgtattattcaagagagagtagatcaaatcctaccagtactttgattgaaaattctgtaatctcacagaaattcaataaagaataataataaaaagaaacaataaatatatagttcaaataaacttttctataccccttaatattgatagaattctgtataggaacatcattttcatgttgtatctataaaaaaagcacaaactgaaaataaaagatggttaaataataaaaggaaaacatttttaaatgtcaaattttcagtgagttccaaataaaagrattatttattacattctcaaaggtcctagattcctctgcatccttgcagcaaatgattggcaaattgctttgattgttcatataatatcagtgtgcatttagagtaacagagaccctcagtcatttgaagaaatcttttgaaagttaagaaatgttaaagaaatagtatttaacatactaatacatactgtgagtagcaaaaataggtaccctgttactctctggtagtttctaattatacttgaaaaataacaacacaaaaatacacaaagacctctgaggccctccctgatctctaagatgtcccttgcctggctgtgtcctttctgatctgatcacgtagtattcttttccctgtgtgacactgactttcttgctgtctaattgtttagactatccaacctgcttgccatatccagcctcctacattagctgtttcctctccttgggatgttcttatagcagattttgtattatttccttattaatatcawctagtcctcccttaatcagtctggctaaaatatccccagcttctcactctttctttttttggaattagcttatctcctcatgctccccaactggaatgcgagctctttgaaggcaaggactgtcttcttcattatcatgtcctccaaacctaggaaacatctgccagcgttaccattatgataaataatacaagaagaagctatacatacatacatagcatatatttgcatgaatatgtttgtgtgtgtatgtgtgtgtgtgtgtgtgtattggcgcacacactcatgcatggacttttaggaaagaaattaaggacacgtctgcatacattactaattatttggcgcattattatattaggctacatttgtgattgattctatataagacagctattattttacctcaccaaaattcttccagctgtgaataatagaagcagaagagaatatatattgttaaaaatgataagtgtgcctgtagtctcagctacttgggggctggggtgagaggactgcttgagcccaggagttggaggccagcctgggcaacatagcacgaccccatctctaaaaaacaggcrggcttgatgggtcacacatgtaatcccagcactttgggaggccaaggagggaagatcgcttgagaccaggaacttaagaccagcctgggcaacatagtgataccctgtctctacaaaaaaaaaaaaaaaaaaattagctgggcatggttgcacatgcctgtagtcccagctacacagggggctaatgtgagaggatcacttgagcccaggaattcaaggctacagtgatctatgatcacaccactgcactccagcctgggcaacagaccaaaccctgtttcaaaacaaacaaacaaataaacaaacaatcaaaaaacagtagggtccttcaagactttgaaagtcttgaagtcttcaaagataattcaayctctttctctctacccctgcgctactactgttaagagagttaaaactcaaaaagttgacatggttcacagcgtcacatgtctagtagactatacaagcaattcaccaaactgggctcctgaatggaagtcataaattctttacactaaccaggttgcctttctttgctctgtgctgggtgatccaccaactgacctgcttagcgtgttaatcttactagtttactatactatttagcttcatgagagcaacttattytgaacagtgctcaasagtccagcctcctgaaacagactgtttgggtttgaattctgactgtaccattcactagatatattgccttagttaggtaagtcacatcactgtgcctcacttaattcatctgtaaaacagtgataatgatacaggtcttttgctgtgataattaaataaaataatttatgtaattagttacattacatatattatgtatctatgtatatatatgtattacatattcatatacagaacagtgtaattatacctagtttttgcaagatctccaaaacattgatttgcagagttacttagaataaagaaaaattgagtgctaacttaaacaaataacattaggccaaagtaatttagcaatttctttattagtcaaatattgattgaaaaataaaacaacctgggcatatttttcactgataatcacagagtcctccttcgttattcattaaataattttaatattatcttttgaaacatacaattttgaaagtgaaatttacgcaaagagcataatncattcatttgaagttcatttggaaggatttctgtattagcagttccactgcttccttttgttgagctaggaaatgaggacatagccatatttgttcaggaatgaatagaaacatgacacaaaagcagaagtctggtggcctgacattgaaattgtccttgtatattaattttttaagcagtttttaagacaccgttgaatttaagcagcctccataaaggaatgcttttatrtggtcaaaaccaaatttagaaatcagaaattcttaattccaatagtatatagactctatttccaatgacctgtccagtttcgtttttatttctcttttttaaaattgaatgtggcttatatttaatatttgtgaagtcctttcagattcttcaaatgagcgactctatataaatgcagaaatagcattgttaattcccaagagtattataaaaattacttaatgtttgtaaagtacattgaagatgaaaattgtgatgtaagcagtaagtgttaagtattatttattaaagaaaagcatgttagagctatggttgctgataagtactttttaaatttcaccgagtttctttcaagttcactgaggcatggccaaatgttattcaagcactccaggaatcttccctccttttgggacttactgctttttttttcggtgtcaggtcttcggaatcttaattttctcttactaattatcaccattactgctatctaaaaacctagaatgccttaaaattatatacaagtgaaattagctatatatgcagtatttttgagtggaaagaagtaagtagagtcttctactcatactttaattaaaagtcataccaatatttgaaataatcatgaaagtactgaataactggagagagcctaacatcctctctnaatggtawatgatactaaattgctgttaatgaaggttgaaaaaattggtctgttttgtttgaatttcttacatttggagagcaaaatattttttaagatgtgactaaattcatctgggttgtctcttttccacatttattcccttctctaatactagcacatagggaaacaaacagaacaaaggcagcaaacacaggtaagccacctcctactgaaaacaatctactgtctccctttctccattacgtgtacttctggctttcctatccgtgcagaacaatagcctctctgtgattttataatctctgcaggaaaaccaacaaaggtatctgagggtcgctgcattgccagagaacagcagaggcagaaccaccaatggaaagcagaagcagcaacaggtggccgattttgcacaaaatgcaggagagaaatgtctcctagtgcrtaagggaaaataaacagcatgattgagtaggtcagctcttagcttgtcctctcttcctgtattctctctttttttcctctccttttctaacatttcaacctctaggaaggagttggtgacagagtggtgccatgaaattagaagaaaaagactgacattcaatttcttagtgcctgtggggtcaatacacgccctgacatatgggtttacgtttcccacccaattagccagtctaaatgggaatattcattgttctaagcaaatccaaattgacatcagcatctcccaaatttatttgacctcagaacaccttttttcccaaaacaccattaacatcctgcttctagaatgcacttngggaaatgaygctttttatacaatcaaaaaagtttcaattacatattcaacttatcacattaacacggaagtatgtgacatgtttttggaaggtttccttcaaataaaatattttgtttccagaagtatttctctttcatctatcaaaagcatrtctgtgactctaaccatatccaataacaaaggggatgcttgtgctttgtgttaaataaactttcccttaaaacataagaaggagaagaggaaacamaaaaaaaaaaaccaaaacctcatgtaacacttctttttgctaaatgattcagatttttcctcttgagtttatggttcaaacagcctttgaacccttctttacatcatccacgccagccgtgcttataaatcttttccattctagaagcttgagatgttttattatttatctgtatttgttggggccagccttgataaagcagattgtttataatggaactgcttactgcaagggcctgtaaaagaaaaataagctcaatgtggcctgtgaacttggatatgcaccagggtataatttttcctgctacatgacagggtagaaagagactgaaatcactgatagagttttgggagatttaaagattgaaaacaaagctaccttgtaccatcttcacttggggagaaggaaagacccttagcatttagggaagacctcgtcctatcctccgtttattgatgggtttcctcaatgattatggataactggaaaaggagaagataggtatctagaggctcatttctggaaaactaaatatctacagaaagcagcaatgctctctgcaaagtttacaaataaatcaatcaataaaatcagctgtttaggaatgcacacacagcattttatattctggtacatttcatagaatgtgtgcttagattcatcagatgcagaatggaaataatcatatagcagtccttccttatctgcaggaactatgttccaagaacccctgtagttgcctgaaatgatggatagtaccaaaccctatgtacactgtatgcctagctcttaaggatttttgagtgataactatattattgctatctctatgtatcagcaaaaagctaaaaacattttttgcaaaccaaatttttctgttttgagacatatacttttgcattatgctatacttttcatgtatttttgtgttcattttatttatgatattttcaaaaagagacgttcctatagttgaattattaaataagaggatatctgttcccagaaagttatcttggctccagagccaccagaattcattcttctaatctgcactgataaatattgatatgtggtaatttgggagctttgttttaatgggagaagaaggtttttaattttcactggtagtactttgacatggtcatggaacctctgagttcaggtccaggatcctcaccatctttctgagaaatatcttattaaaactagagtggtccctggcaaaagcaataacaacagcaacagcaaacaacaaatttttagttatgttgattgacttacctaaaatcctgatctggtagaatggtgccaatatctgtaaatggagatcctgtgaggcaaagtttcttttaccatgagttttgttatagtgatggaaaagaaaattcacacatagtattaatgaatttagaagcatgaatgtgcaaagtttacctgcagctctgcctttatctttaccatccaaataaaccacagctaattaatcacacggaagtcctgggctctgataaagatcctaccactctattttatttctttggatgctgcaaaacaatttagcaaagttttcttagtagggctattgcttttcttacacaatcatgtgccattgcatgagaccttaccactgatgctctatcagcgtcaatggcagaccttcatttcaataatagggcccaggtaattcaacttacttgcaaatttgcagagttgcaagaaagctaattacagttgtagtaggtacctacaaaatatgggtgatgtctgatagtcaaaaattttctgtagtttattttatagtttcttattttatcatgtatatgcatgaaagaagggctatctcctttatttcctaaaggttattcagcatctcttataaaattctgtattttttcccaagtgctacaagttccttttacaatatgccacagaaataaagaaaagctttttttctcatttatacgatactatgatttgtagatattcagtaaatggaattattggtcttaataatttaaaatcttgtgtactttttgaatccttgagaattttagattgtagaaaaagaactatgatagtatagaaatgcaaattcaatattcaggactatctaaatatgaattttttgtaatattttaaataaaatacatttaatatataagaattgacatgatacactaatgtaaatctcacaattagaattgcataattgattcacatcaataatagacctatatttgatgttcagctatgcttttactgactttcaaatggtttctgttttgcttaattggtttggatttgctctgtcaggttttttccctttatttccttagtgagaaagttgcagacctgctgttttatatgtctctgtttttttttttttttcaagaaagaaaaaggcaagcaaaaatctatgttcgattaaaggcagtttattctgagtttatgagcacttcaaaaaaatgtctcctgccttcattgaagcattatgaaaatcccatagtacatctgtcatagaaattagatgctagaaaattccattaaagatcattatttctaagattataatattggctgtgttctagaaaaatagagcataatgtcatragggcatctttcccacacccttcctcaattgttttattagcttattctgtatttctattggttatagattgactagcattattcttatatatattagcaaaatattctgatatttcagcagcttgaacgtgttcatttttccctgagttactcctagagttaattaagagaaacaacctggggccttttgttgagtgaccagtctttacatttttagcaagaagactgcctcaaaaaaagtgcccaaacaaggattagaccatccatccatagcagtttctgtaattagttatatatctgcacagctcacagtgtaatatttggacaatcactctggttacaatttgtctttaatttagtaattatgagttttgtttttactctttttcctatggaggaatcttttctagcttcaaaaatatttcagagtccacctccaagaaaataattcttgcagttttttgaaaatattatatattatttaatagaggggtacttcctccatttcagaaaaatatactatgggttattactttttatctagctgttaatgattgatcctatgarttttctctttggattttttttttcatcagataaattataatttctcatctctccagttattaccaactctgaaaatgggtaatctgtggatattattggaataaaaattattttaatataaatttgcatctctattataggacacttttaaattgtggagaaaagcttcataaaaatcacataaataacaacaggaaattgtccaatcagttctgctatacatgacataaatgttccttaaatttatctcactatgcaaaattggaaataaaaatcacaagagtttgtgggggaaataggattggagcataacatgcaaaatttgaattaaatacacacaaatatagaancctaataaaactgatggaatatttctacacatgcaaatggttaagaaatataaacgctacaataaatatggacttcaccttgaaagagacctaagtttgcttatggaagaggatgttggaagagttgcagcttgggagttactgtgaagaggtggaaggagggttatctgaaatcagacagaaaattgtaacaccagatgtggatgggtatggtccctaacacacatggcaaactgagatacctgttagatgtttgaagggttatgtgtatgtattttgtatattgctatgtagcttggttcattggatgcagttttctatagtcacacattgttcctcacaagtaaagtaatgcataattagatgggaaatttgtgtcatgctcaaatttttccctgttagtaattcatgtttttaaaataagagttatgacagaagactaaacatctgagagacaggcactctaactttctaaytgaagacggtgaacctagctgtggtaaaaaagaggtggctatttaataatgtcactaacataaacataattaaatgacaacattttgatttttctgtgtaccattatgaaaaactgaacatcaacctccctgtccaacttgattcattcattcacactgggttttgcactgagaagtgacaccttacttgaaagggatatcagaattgggagggccacttagtaatcatgcaacatttcaaaaccttttgtttgtctgcttccttgtactctatctctggaatttgtgattcccaaccagtcagtacaagcaaccatggcactgtattcatttaatgaatgaatatatttaagggagcaaatgaaagtgtgggacatgcaaaatgtattcaactatccatttcctgttgtacgtttttctgcaagagcaaaactcttctgtgatgtgttgctgtactctgagagaagttaacaaatattggtagggaatgggctttgacaaactgcagtgcctctgtggcccttgcactgctgtgctttcatattctggagctagactccagtgtacagagtagaaaaataataagttctttgagctgaaacttcatagtcactgtgggatattcaagaaggagaccaatgcggagaaagataatatagtcatggctttgaacttttcctagattttacttgccagaaaccaagcgagagtcactctgacaccttattattactagctctctttctccatgtagggaaaagtgctccacagtccatgtcaataaaagtgaaagggagttcacacatgagagagaaggtggtctgaatttagtgtgtaaaggaagtatataaagctaagatctattccaagcctcagcttggaggccaccttcaatggcaagtccgtcttttcctttccctccgattcaagtaaggtgccccttcttgcgtttccagaacacttttcagactgtattatatgtatctgtttcattgtcgggtacagagtaggtgcttagtaaacatgtatgaatgaatgaataagcattggatctcagaccttactgtgaagaggaagagataaaagataaatttataaattgattatgagataatgtgatgcattattgtagaatgaacaagtaatgtccaagaaagaagagatcaaagagggctataattcattcagtcaactgctatctgcatcctgtttccctgtgttagatgaactagtggattagaaatatatagtccctacaatcatggaacatgtaaactaacaaagcacacagacattaaacaaagaaaacataaacatgtataattcacattttgataataattatagagcataactgggaagacataatctatatgggcaggcagggaaggcatttttaaggaagtgatatttaaaagtgatgatcgaagatgaggagggacaaaaggaaggattaacttgtgcacaggctgtgaaggcatcaagagctcagctgtgtgagaaaaagagagaaggctgaagatgagtgagctgggtaggcatgctgggctggcatcgtgagtagagaaacaggctggagccagatcatacttggtagaaggtttggattttaactgagatgagtttggatgcatttgtcaaaactcagtgaatgtaaacttaatatttgtgaattctattttgtgtaaatattgcatgaaaaaaatctaaacaaatattgaactctggttaatgatatacatgtttaaatatttactgggacggttcttgggtttgtaatttacattgaaatgcatcaaaaagataaaattgatagaggagtggataaatatatagaagtatgatgaaactagtaaagtaagttactaataaattgaagtggtagatatacagatattcactgcaaaatttcttcaactttgctgtatgtttgaaaatattcataacagttttggaaaaaataaatgctccaaaatgaaaataaggagatatataataatcatacaaaatcccaaaacccaaaaagaaggattattctaggatattaccatttgattcttgctctgtgattttttatttttatggaattgatacctgcattttaaaataataagcatatctcatcactttaaagaaatcattttaaattatttgcatcattttacattacttaaactatcaaatctttgatgaggtatttctttgactaagtrtaaacacaaatctcttagactagaatgcatcaatcctcaactgtccacccagtacctgtcagtgtggcagaaaggaggtgaacacactggagtctattagtgtaatcagttctcagcagaagattctacttttaaagttttttaagatttgtggttgacmtaactgacataaaagaaagaacrattgtttctttgaaagtagctaagggtacccaagagtctcagtgtattcagtagtttagattctaacttgtttctgtgaaaatgtaagtagcatagtgtgaaggctgtggagcagattgctcttttccttgatgagttgctacccactatgagcattttgctgataaattagtgcatcacacaatgttagaagccttgtgcttgatctccccatgttttcaatgaaaacatttcccttttattgatgtttgttcttattgaccctttgaggtcagaagacagagtttctttattaaatcagtaaatcaggggtatttaattggctctagaaacttctgagtggttttggcctattccagccccaaacagggttctgaccaaccactgtgaattctgcttttccaggaaggtagggggtgagggattataacaggctctgtgtaaattgtcacttgctcattgccttcaaagcactggttttcttggtgtaggcaaaacgccaaaatcaatgtttttgactcacataaagaaatagtttagcatttggaaaactgtatgattatccctctttttctgacaggccatcagacatttaaaaaataaaatatgtcttaggtttttacagaggaacttatttttattcttcatgttacatcaaaaataatgacatgagtgttggccttagcaactgtgttaagatcaatgatactgcaggaacgatgaaagtagacttttataatgagagcaaatggcccggagtctgtgagaaattgctgaggatccttttaccgtagcaccattgctaattaaaatctaagaatcaacaccaagattgttcaggaaacacaaatactgattggagaaccaaacttgagggtcattccaatttctaaactatcttcattggaatttaactttttaaaaaatgtctccaaagcgtcataacctcacttctattcatttcyttttacatctcttacatttgtttccctaggctttctgttcttgtgcttgagatcattattacttgatacggggcagtgacaaatgagggaagcaatttgttcagaaatcatgcctgtggcaagtatttctagactggagaatgtagcctcatttatcatcatcattatcactgaaaagctataggtcaggaatgtcttaagtcccctgtgtttcagcattgtctattaaattggggttaattaaaatgtctcttctaaaggtacttctcttgaatacacacacacactttaactctggtcttttttagcagagccattactctatttcctgtagggaggaatggaatgacatgtgtaggacatgatttcattttttagactagaaaaggaaaaccacctagagagttgtgaccttcagacatgtcgacggttctactcccatgtaaagtctatagtccacttttaaaacatttttttttagtctttaccccttattttattgatattttaagaaaggaaaagtagcctcaatctgtgtttttatccttcctaagaatatatttcccactctagtgtttctgaagttagaatacataggtattagctgggaaaattatttaaagtacacatctctcagccccattaccagagatttcaattcagtaagaccaagatggaacctagaaatctgagttttaacaggctttcgagatgattctgatacctgtggtacttggacacatttttgaactctgctttctaccatcactatagagtggtatgggggtgagcataaggggtgctaggaaactgcacaggaagggaacctaaattaaaagatggtagcactgagattcgagctgagagctgaaggtcgcatgggagttacctaaaggcagttggaagtgcatggggtatgagagggtgaagacattttaaactcaggtttacttgagtaaaaagacataggggctagagagaaaatggtacttttagggtccacaagtgtataaatctggatgaagaatgatgtgtgagtggctaaggaggtgggatgtaaagatgagcttgaagaagtgagtggaggtcagactgtgaattcctcaaagccatgttcaagatttaggaaaacatcctgctaaacaccactaggacttctgtaagctgtggagctcaccaccattcatgggttctttcacgttcttaggctgcatatagtcttgggtctatcatcatgataaaaggaaagctgctttcaatgtaattttcatttccactgcaccttccaagggtgagaccctacagagaaaaacaggtcatgaagtaacatgcaagaggaatggctttgtgaatatattttatttgaagataattggtacttaataattcaaacagcttacttcattgactttgaaccataaatattaggaagagaacactagaactgtggtgagacaatgtcatgtgacaaagattaaaaggaaaacaaatggtcgaagattccaccatttgtgttttgtggtgtgtattttgaagtgcatttcttttctaataggtaattgaaggtaaaccaggcatttttatcattgattttgggtacatttaatcatgacacttaaataaataatcatcctcatcctattccacaaattaatgtttgaatacatgttaaccttccgactgaaaattattttaaagactttttgaagttcacagcaaatttgagagagaggtacagagctatcccacagatggcactccctcccacatatgcatagcctccctcattattaacatcctgtaccagagtggtacatttcttacagttgatgaacctacattgacacatcattatcgaccagagtccacagtttacattagggttcactcttactgttgtacattctgtgggttttggccaatgtataacaacatgtatccatcattatagtatcatacaaagtattttccttgccctaaatatcctctgtcttctaccagttcatctctccctccccactaacccccagcaaccactaatctttttactgtctccatagtttggccttttctagaatgacatataattggaatcatacagtatgtagccttttcagattggcttctttcacttagtggtatgcatgtaagtttcctccatgtctttacaaggcttgatagctcatttgctctgagtttttcaatgctacccctacttgttttctcttcctggttaaggatatgtgtgtatttcaatatgtgcttatgtgtcaataactgccagtcaggaatgacaagaatatatgttagaaatgtaagaaaattgctaacttgagcttaaattggatgtgttgactccactgttgtgaatgaggcttctttggccccgatctgattcgtgtcagtatacaaacacctcgaaatggaaagcttacagcctgccaggaagaataattttttttcttcttttttttctccatttaactttgaaagtgggaggatttgagtttttgattgccaaatagctgtcaacttaaaacaactagattttattttcttatagttaatttcttgatctggatcaagttctgagcaagaaaacaactaccactgtaaacagctattggggcaagaaaaagtgtacttaatatagtacagacacaatctgtggtctgtatgattggatggtaaaattccaatttgttggcttgttttttttgtttgtttttttttttttttttaagaatcactaagtattatttaaagggragatctgaaatgctccagcaagtaaaaatcaaatccttaagatagtttttaaagacagtttcagacatgtcatctaaacgctagttttaaagtgctacctaatgaactagaagaggccttgattagcaaatttgcctgcatttggtctactgagtagtgaaagccttgtttatggtgggttctgctttctcaagttgccctccttaaacaaacagagcaagagcagaaagcttttagatgtacaacatgaagccttacaagaagctgaaagtcagcccatgaaagaaaggagctgtttagtgggtttccagttaaggatctgggtggtgctggaaacagaatggtagataatagactcctagtgacggggctgtcaggagatagaaaactgtagcagctttgtgggaaaatagaattgctgggtttgcccacttgacctttactctgaatagatgggcttaagaagatcacaaaggactttgcaaaaaagtagtctgctcagttcttttggtgcctgaaactcctttttaattctggggagttttaagtttgtttcttggtattcttaaagggattctgtgaaatccctattgtcattccataggtatgtgttttaaatgaaggcattgctcactatatggccatcacatgtcctgtgcagcagtgaaactaactgtttatgggaaaggattactgaacagggactccagcatctgtacactccacattatcactcctatcaaaggcattcattgagcccctttccatgtttctggataattgcataatcttatttaaataagaaacgcaatcaccatttgaaggcaaaatgtgtatcaaatgcatatatactgctatgtagatgaaaggcttgcagattaattggcagcattttcagaaaatagggcttgacagtagcagttcatgtgaaaaagatctgggaggttttagttaagtacaagttgaatatgtgccaagattacratgtggtggccarcaacccaatttaatctcgtaatagttacatgtatagaattacaattttctgccctaggatgcatggacactgattgcacattttaaaaattatgtccagttatgaacatcacactcctggataaaattagcaagcttgagaatatacagaggagactgaaaactctggaaaaaaaaaaaacaaaaccctaagccctttaaaggaattgatcatagttaacatagagtagaaaatctagcgatttggatggaagagaaatggtagtcatgaatacaaatttcaaatagctgaaggcctattatatagaaaaatatcatttgtgagttttcagaaaatttatagttcttcaaaccacacataagaataaataacagatggattaaagagacagatgtgggaaaawataaagaaaccataaaaactgcagaagaaaatagaagcaaatacgaacatacctcaaagatattgtgggtttggttccagaccaccacaataaagcagatattacaatcaagtgagtcacgtgaattttttggtttcccagtgcatataaaagtaatgtttacactatcctgagtctattatgtgtgcagtagcattctatccgaaaaacaatgtacataccttaattttttaaaaaaactttattgctagaaagatgttctttagcaagttatcatatttttgcttgttgagggtcttgccttgatgttgatggctrctgactaatcaggatggaggttgttgaagactgggttgactgtggcaatttcttaaaaataagagaacagtgaagtttgccgcaacaactgactcttcttttcatgggcgatatctctatagcatacaatgcagtttcatagtattttacccatagtagaacttctttcaaaattggagtcaatcctctcatactctgctgctgctttagcaactaagtttatatcatattctaaatcctttgttgtcatttcaacaatattcacagcatcttgaccaggaatagattccactggaaactactttccttgctcatccataagaagcaactcctcatccattcaagtttgaccatgagattgcagcaattcagtcacatcttcatgttccacttttaattctaattctcttgctagttccaccacatctgcaattgcttcctccactgaagtcttgaaccccctcaaagtcattcataaggatcacttctcctctctagctatgaaagtcctacatggcatcttcttccaatatatggcgattttgtctacattaaaaatctgttgtttagtgttgctaccttcatcaataatcttagctagatcttctggataacttgctacagtttctacatcagcacttgctgtttcaccttgcacttttaagttatgaagatgacttctttccgtgaacctcatgaacgaatgtctgctagtttctaagttcttagcttcctcagttctctcagcattccaacaattggagagagttagggtcttattttagattaggcttttgcttaagagaatgttatgactggtttgatcttctatccagaccactaaaacgttctgtgtatcaacaatgaggctgtttcactttcttttcattcgtgtgttcactggagtagcacttttaattggcttcatgaagttttcttttgcattcacaactcagttaactgtttggcacaagaggcctagctttcagcctctcttgaattttggcatgcctttctcacctagcttaattatttctagcttttgatttcaagtaagagatgtgcaaatcttcctttcacttgaacacttagaggtcattatagggttattaattggcttaatttcaaaattgttgtgtcttagggaataggaaggcctgaagagagagagagatgagagaatggctcattgctgaagcaatcagaaaacacataacattggttgattgattttactgtcttatatgagtgtggttcatggcacatcaaaacaattacaatagtaacctcaaagatcactgatcaaagatcaccatggcagatttaattataatgaaaactttgaaatacggcaagaattaacaaaatgtgacatagagatatgaagtgagcacatgctattggaaaaatggcacagataaacttgtccgacacagggttgccagaaaccttcaatttgtaagaaatgcaatatctgcaaatacaataaagaaaagtgcaataaaatcaagtatgcctatttctaacttcttttggaggtggtatggatgataccgaatgaaaaaatgtaaaaggaagtgctgctagttatgattaggaatatctgaattattaaaaaactctttgaagttataataaaaatttaaaacatgaagctgaagaaattattaaaattacatttaacagtacttaatggtatgaataaatgtgcacaatataatgttgactaaaagatctctagatcaaactttaatttttaaagttgaaatatatgtatttaaataactactaagaaatcatttttaatcaatttctttgggtattcaaattatacgctttatgttttcagaaaggtatataaagtaatgaatataaaaaaacaagtgagtcaattatttagactttctgagtaaataaagttaacaaggccgggcgcggtggctcacgcctgtaatcccaacactttgggcggatcacgaggtcaggagatccagaccatcctggctaacacagtgaaaccctgtctctactgaaaatacaaaaaaattagctgggcgtggtggcgagcgcctgtagtcccagttactcgcgacgctgaagcaggagaatggcgggagcccgggaggcggagcttgcagtgagccgagatcgcgccactgcactccagcctgggtgacaaagcgagactccgtctcaaaaaataaaatgacataaagttaacaaaaataagatatttctaacaattatacttttaacaatgtcttatggcctatgggctgtctccttcattagaagaatttgtgtagaaaatcactgtaaatctgagataatatagaatagatttcctatggtaggaagggatcctgtatttggtgatctcaaacgccttttcaatactgaccttctagaggggaaaggcaatttacaatttgaaacattttgcagattggagtggaaaagtgacaagtaacattgaaatgcctaatttcaactttagacatttttgaaatgaaaaaaaatgtaagtccagagacttaaaatgatcaagaatacagccgactcaaatttcctgaagcctagtccggtcctttcccttccggtagagacagaatagtttggtgggtaaaagtgtctgggtttgaatttaagttaggagcacctcctgtttctagacttccctgtgcctcagtttcctcatctataaaaaatctggggcgggtgcggtggctcactcctgtaatcccagcactttgggaggccaaggagggcggatcacgaggtcaggagatccagaccatcctggctaacacagtgaaacctggtctctactaaaaaatacaaaaaaattagctgggcgtggtggggggcacctgtagtcccagctactcgggaggctgaggcaggagaatggcatgaacccgggaggtggagcttgcagtgagccgagattgcgccactgcactccagccagggccacagagcaagaagctgtctcaaaaaaaaaaaaaaaaaaaaagaaaagaaaaaaaaaattctgaagccctgttacatagaaaaatatcatttgtaaaaacttaaccgtacttacaatgttgctgagagaattgagcacttcaatatatatgaagccgtcagccagtacccgaaatatgtgagaaatcggtatttcctactcttcatacactgtgtatatatacacagacacgtatatatggtaattttggtatttcaattttggcttccgtgtgtacacacacacatacacttggaatgaggggtgggggtagggagggatgtcaaaggttattccggtttatttttttattttcatgttatcttagtaccttcagaagtcactcatcagggtcttcaacattcaatatgatttactaaaaattccatgaatcagtgagaaaaaatagaaccctttataatttcccccatttaaaaggtgacacatttttacatgtgaattaatgctgacctttttatttagagtttaataatatttaatttagtttgtggaaactgatcaattttgttatatagttttccaccttaagaccatctagattgggccataagcatatttctattcattttagaaacaataatcactatactaaaatgtttgtttcccttttgtgtgtatccttaactttagaagattaaaaagatgttcgagaacgtttaccccagtgttactatagcctggctcttaatcacaccaatagaaatgctgacatgtacatgaacttttctgtcatgtgtgcaggaatgggcacagatagagtctgcaccttttacagaaaaagccttagatgacttatgcctctggaaatgtactcttcattttaaaagacatttcttctaagtcttctttaaatgtcttctgtgtgatttatctccccaatttccaaacattctaaatactgaaagacaaaaatctcaaaatgtatttatttggaatggtaaagaataccatgggaactttttctgtctttttgaatgtattttattgtgacagctttttcagatcttgtagtgatccatggatagaatccctcacatacaattccatgacctcgtaattccatggcgttacttacatttttaaagtataactgcattgagaaaggtgagctgagagcaggcaacttactttctcctgccatacagaaacagccagtgggctcagctgccagggaacacaggtggataatccctgtgctttctgggcagcatggccaaagcactgttgtctttaatgccacagaggtccaaaatacagttttgtgtcctccaattcccagagagaaattcctgtcagtctactcacatgatttttaggctcaggaaattctctctagcaaaagatacaatcctctcatatagtaagtgttatggttgcaatggggyttgtcaagggatttgtctgcattaataaaggtattccctggggtagtgggaaaacgtctcattgttgagcagagaccatcaccactttatgtatatttaataataatgctgttcctgagctttcaaaaatcaacaaatttaaaattctgaaattgtagactgctattaatatttttgtattatatgtgctatgcctaatcccagcgaccttcctcatagtattcatgttttggtttgtttggtttttttctgcatctggaagaggaaacacatataaccacacatgtgtgtgcaaatacgcatataaatgcagcagaattatccactggcagccatatttgccaaactaattaaagagaatagcgtattaacatgcacaccgtaaagcaaactccattctctgtagagcattctctcactgagatacaaggactttatctttgcacagtgggtctgaactaattgagatgtcttaaaaaacaagtcagttaagaaggttgaggcgacggrtgttgttgcagaattgtcagtttgcaagaaaacattctttggaaaaaaatacagcccccrgttgcaaatctaatcagyggcgggtatgggaggtggggaagagagcatagagagaaaaaaacatgtctcaaagagaaaaaaagagcaagaccctaattgaaatgggaagcattctcaktttagaaaatgttttcttaacagattgctttagccctctgccttaaggtttttgattaaattaatgatgggagtgataagctccattagtgttgctgtttccagagggaaattgtctacagcctactcttttccttccttccccaaatctcaggtatgacaatagaattgctaattgagaccataacatgccaagaagatgaacttaatattactatgcaaatgcagacaatccaggaaattaatatttcatgtgtgcctacctaaacgagtaacgtttccattatgggcttggtgtcactcagctgggaagctgttgctgcagcttgttgtcgtcagtgaggtcttgaacttctcttttttgtttcatgttgcctgctgtcttgggaccagtcagcacatctgacatgtgctctgttggcccttgctgttaccacagatcttttgctagtgcaaataaatgaagttgttatgatccataggacattatcaacttgatttcctgtcttagtagtaaagtattagagaaagaaaagcagctaagtcttcgataataaagaggaaaaaatatgtcagtaaaatgaaccataaaatccataataggagatatgatggggacttttccatgcaacataattagcagactgagtgctctcaaaaacacagtaagaagagtgttactttgagggcctgaaatagttatagtaaattattcataaacgtgtgtttgtcaaacatgattatatttcataatctgatgagaactattgtgttaacaattagcagtgtgtgtgtgtgtgtgtgtgtgtgtgtaaaagagagtgtatagtaggagtatgaagcaatcttggttttaacattctgattcttgttttgaatgaaatatcaaataatagatatctccttaagagcagaaaccaaaacaaatctttgaaaaaaaaaaaatctaccatagtacctgaaagaacaacaagcattcaaatagatgttcgataaatatgttggatataatttatttttacttttccaaytttgttgaaaaatagatgtatcctagaaatgaagggtggcaatgtaggccagagaacagtgggcttattggggtctcccctgttctctcttatgctgtctgtctgcatggccaacctttatgaagaataaactacagttatactacagctattctatagtaaagaaacttttagaggaactagagtcataaaaatctgttccaaaaagatcacatggaagtgattctgatgtaaaattttgaggatccagtataatttgtttggatagaaatgactggagaggggattttaggttgaaaatacatgtctaataattgagaaggggagaagtcttggtcctatttgcccagatggagtgaaaaagctgaacaagaacattctagagattgaagataggattcttagagaacaggtcccaaattttaaattctaataggtagcagatctggaattaaatgccakgaaggccttggttttaggcttcataatcttaagtgctaatcccatgattttatagaatttgatcaaagcagcttttgtccttatttagtggaaacttttcttcattataaagttatgcctcttttaaaatgtaacctggattatttatatttcccttttctagtccttctttgagtctcatgtatcttttccatgtcacccacagtgatggtgtattcagccacagatgccccctgtgaaagataagataatgttttytacctttttattgaaaccagtttttcgttgaaattgtttrctctwataggtcattgttgtaaaatctaaaaggcaattccatttaaaagaaggaaaacaaatggactaatgagtttaggccaatttagaactctaaaaamtattttatatattttagcatatgcatcaataaaacatagttgcataaggttttattgggacatatttatcaattcccttttaaaaataaaagagtgtaagggctaataactagaacaaattagatttgttaaatctctagacttatgaaaatattgattattttattatgtgtccccattgacacaaatatgtctagcattctcaatgaaattgcttacacagtagactaaaccttcctggattttatattagacatgaatgtaacaacaaaaaataacaagaattagaacctaaagttactgtcttggtacttgttcaatgagctttcatcatattttggagggaataggtggataatattttccaataaaacgtttaacctgatccatcgtttttcaaacacacagtaagtgtagaataaattaacacatactaattgcttatggatgctttgttttcgcatctgattataggtattcatacttaagacatctcaagaggaaatgttgataatgtcatttctttgtaataaaaagacagaccatcaaaattgtggaagtattgtgttataagatatttttaaacataaaaagccattgtaaaaaatatccatcctgtctatttctgtaagaacatctgagctattccgagcttacattttaggagttaagttctagaggccaatgatcctttgtttggggtattgaatattatctagtatatccagtacaggtttaagagtagttgctattttataaatgttcaacatggaccagaaaagcatcagtctataaatggattccttgggcccagagctctgacagaagaaaagtttgagtgtttgggggtagtggggtggtgactgcattactatattactgcagcatttctggtttatgtacagtagcactcaataaatatatgtttactttaattgagtaggcataaatagcattcaccagaaatcctttgctggcagccagctgcatttgactgctgagagccatagcatatcctctctgaagttggagggaacacaatctcttttcagtgttcaccttttctcaaaaagccagaagatcaattatgatttctttatgttcacaggtaaaatggtttaacagaaagtaaatttcatattatcataaagaacccatgggcaaaaaggcaaatggagtaaaatgctaggttttatgacagttattagagaattcttaagggtttttatctattttaaacattaagaattacttttttccatatatgttgacattatggggttaccttatcatcttaacttccctgatacaaaactgaggaagcttggtggtatacttagagaccaacaaaagaaccacctggggataatctttctccatctccacccatcatttaacaccaatttgatatcagtgtttcagctgttcgaatactgacttatctaaggaagtctatatttttgtttatattatttcaattctaaatatctctttatgggaaaaaataagagatgcttaaatattgaagatcatcgtgtctcatctaatgaggtggatcttccagaatcagactaaaggcagatatacagaaagtgagcaccaggaaaacattctgaagtcggggcaggaggcaggggaagggcagaacagaggaggaggaatggagttcgtcctagactttgggctgcacatgtgctgtgagaaattggtattggcccctgattgtgatgaagaacagggacttctctgtaattgtttatcatctttctaaagaaagttggatatttttttattaccactgaaagcttcacatgttctatgtaatggctagaggtatttgataacatgttttctatttttctttttctagtttttaaatagatggtcaggagtcagagaggcatggacagctggtgcttactcagtaaatgatattcatgttattatagtaaaaagtaggcctcaagttactataaatattatacttctcaaccccagaatggcatccctattcaaatatacattttagatcacagcatgattacttgtaatacattttgttttcatcatttctttcttaattttgtttcttaaaattcctaaccacatttagtctaaaaattgcttaaaagataatgtaacacttctcctggtttacaaaaattgtcaatgaatcaaagtgaaaaacctcttgtcatcgcgtttctaatgaaacttgtataattttagaattgaacattgaaagagaacaataatcacaaactgatatttcaaagaaaaatgcaattgctttgaaatgtaaattattcactatagcaagactaaggctgtgaaaatatgagtctaaagtcctggaggttaggtcctcactgctccttcacctaagtggaggaattgtccctaagatgaatttggaagaagcaacccattctaaaaacagttccccaatgactttttgctcattcgctaacctactatcacaccacatggaagaaggagtcaccataaagtttctaatcacttcttgagaccattaattgccttaatatatcagtaagtcattttctttggaacaaaatacagcaagagtctaactgatgctcagagggacaggagtaaaggtgcaggaaaggaagcacaggaaaatgaatttcaattgctttgtattatctgtgttcatatatagttgttttaattgtgtttgagaacagatcaaaggagaagaaagaattgatgtggtgatgataaacaacagcaaccacatttttagttggacttggcacgatgtcagaagcatacacgcagtcctatgtgtgcacactcacctactcacctactcattccctttgtgcctgccccygttccttcctgccttggctctgcctcatacataatcatcttatgcataaggaaatacaactatgaaatgttatgtcaattatagagattttatgtattgctaattagcttaggaactgaagatgcttgcctccttttttccctaaattggtttttaatcaatctgaacagcatcccaaggaaacattttgaaagagaattacaaaatggtcatcaggaagatttttcctactcactaaatgtgaaaatcactatgcaacaagtgcatgatgtcaaatactagaagtttattaataatgataataacaatataggtcaaagagctctgtgcgtgtggagacatatttaaaacaaatgattaaacttaatgcacattcaggacttacggggctaatatctgtgaaaagatttattaaatctccacctggcaaaatcatttccatgtgcagttcattttccggtgtgccattgaagctctaagtcttcatactgcagagatcccgacggcactcattttgaaatgtattaaaaatatatgtaagagcaagaaaagcatatggagttcattcagcccagttttttgttcaacaaacttggatttaaatcttgcttctcacacttaccttgggcatgttccttggcccccttttctccccagtaagagaattgtcatagaatctaccttataaggctattccaagaattaaatgagactacagacttgtcactctttaaatttctggaccagaagtgagctatcataagcattcagtagctctaatatatgcattcagtaaatctttgttgagtgtttacctggtgacaggatgggcactctgctagctgtagggtcctttcaaacagctttacattgcacacgctattaaattctgactttttcaagaagtacaagctatttaattatatcaggtatttggttctgctgctctgtgatttggacatggcatgtggacattttgataatgataccatagaagttttgaaagtgaaagcatatttttgcaatgctgataaaagcatatttatgtgaactggatctaactgtcctaattgtccgaatgtctccatttaacctgaatcaaataatacctgtttttcactttcacatattatttttctttctacctcctagccagagaattcatgtcgcacttaatatgacagcagaggagtgccatcatacccgcacccttctcccctcacttttttctttgagactttatgctagtcactgtccccaagatactccctactgttccactcagttcctacaggctaatactgttcaargatgaactgaggaatgaacctgtcttaaactaaactttctagttctttagggaagctacagtgcacatcacgatgtaagcacttcctcactctaaaaattcttatttagcctgtattctttccaaactcttagtctagtccctaaagtaatactgacagatgtttccttggtctctgctgaccagccagcccattctgtaaaataagcacttaaaggttcttcctcacatgggcttaaatctttctactttccattctccagctatttgtctgccctccgaacattcacaaataaatgtattccaaagactcccttcccttgcttattttttcaattttatcttaacatgcccatttccatcacgttttatatgatctgattagctttgaagttggggattgggggatgagaggagacataattgtctttcagttattgccagagtgaaaaaaaaaacaacaattttaaaaagtgactttcaaggcacttgaaatgtggtctcaaagtaaagatctttgtttagaatgataggatcattcttagggttgccatttaacgcctgtactttctgaatttaagcaataaacctactctagttattccatactttctaatttactcatcatggatgagtaaattatagcaatccacgaaggttgctaaccatcaagttgttttgggaatgagttctgatgcatataataaccctattttaaaaatcaaactttacaaaaatgagtcatcaaacttacgaaaaccagacagttgaccttatgaatagtgtgtaaatagtgaccagagacaagaaaagtggcacataaacaaccctcaataaatatcaactcaatcattaaatgattttcatctacttgccttttttgtttgcttctttggttggttttcttaaggacaactccaagagtttgctatgaatcatctgatccctcctctgagatttggtttcagaaagccacgttagggataggaagctgtagggttttgttttgttttttttttaacaattttaatgatatcttttgctgagctacttgaggatcactgccctcttgtatttgggaactttgaagtagaaagctgtgactaaaagaagaaagtaggagggtgccaataaatgtagactatgttgagacaaatattaatggcaaatgaaacttttgcatgcctagaattttagaaaattatttacttggttcttttacatgcatgcttctggtgatccctttaagagttaaaggagtctgtgacagctctggctaaagtatccagaagacaagaaaagaaagaaatccttggctgcgatggcccaggctcaaatggatttataatcaagggagaggcttacagttatatgaatttaatatgatgagtaaatattattgtactgaagatttggattttatcttatttcccacttgtaaaagaaaggtcacaataatctccaaaattcttttcttcatcttttcagcataattatccagatcattttctctccttcactgcactgtataacctccttgaagaaaatgtgtttaagttcaaagacattttcctgaacctgaataaattacctcaaaatagtaggttatgggtttctgcctctcattaacatcatgtggataaggttataggcattaatatcctcatatagaggagaatttactttaaatgtacgtgtatattttattagaatagaatgtggactaagggttagagaaagctgacatcacgaagtgttcacatccctgtggccacacagtaataagctctgtgttcatgttaaatacaaaaacagcttggtctaaggaccttcgttgctaggtattttctttatactctgcttttgccatcatctgccaataaattcaggtaagacctcccattgcctaacagaatttaaatcactgctgacaggcttcacaggaaagccacccgagtggcctactcagcttgtgtctggggacactggcaagccacccgggaggtgttggcagcatagagtggcctttgtaggaagtgtagacccttggacccttgcttaatttcttcgtcagtatgaccctccatcttcttttttcttatctgctcttttttggtaactttctctctctaccagacctattttttgtgggggggaggtggggaaaaggggaaggaaagggcagaaactgcaacaggaaatttaaggggattccaaatatctgataaaagaacctctccttaatttcagatttacttaccaaccatttgagctattgaataaattaacctggtgtgatatttgggggtaacacatacatctgatcaaagagaaattggtagttgcccatgtgcctccactatttaataagatactgacatatttggctctgcatttggatctgagtgcaaattatggaacagcttttctttgatggtaaagacacaaccttcccatttgcaggctgtctcttgcatagaaaaggacaaccagggagctgttctgcagctaatttgacacctgtacatttgcagggtgtgcagtagggagctgtgtagccagatgacccaggtagctgctatagaatatttatgttcttctgctttcttggctgttgcagggacttgcaaataggctacgcggaaatggtttcaactagttgagagaaacatgtttttaatgaacaagtgttattatttggaaaggaacaaaaatgaggtagaacacagtcccagaaaacactttccgcagtctgtgtagctttcaaaccttcatttccaccactgggaagatgaattcagttgattattctgaatcgtattatattcaataaagtgcaaaggtaataagaccctccatacaaatgtggcataatcagaataattagatgttagatgatgcctggatgatgagcttgatgaatggcaattctgaaagggagtttggccttctgtaggagattgctggcagccaggccccaccatgggtgggccttgagaaagcaaggctgaggaggcagcagggaaatataggtcagcactcttgtgggcatctccagagagctaggaaaatcctgcttgcgttgcatttacagtgctatgagagatcctggaagcagaggaggagaggccactgcagaaaactgaccagggtttgcctcaggattatgaaagcaaattataactccaacaaatcaaggaaagctgtaaatcaggaggttggaatgtggcaagggctttggcatatgagtttggggaactgagtgtggtaaagagggaaggtgagtttatcagagggtcacatgggattcattctttgcttaccaatatgttttgtacctgtgaaataaaaaatttccctcttgacttttgttcaattcgcagaagtgaaggaagtcgagagagaatcctgggtatgtagatggaaagtaagtactcatgccagggaaaattaggaagctgacaaagttgctttaatccttctctactgttcctgtccatgccagcctcacccttttgctacctggcctttctcttaccacctatttcttgcaacgtrtgctctcccattctttctgttgacagcgggaacccaaaaactacttcagggtcagttggtgactcattgtgttaactctcacaagaatatttacatattaattgtcttacatgaataaggcaataaatcatgtatgaaataaattgtaaatggtagattttcaggcatcagtaatttttttgtgggggagacaattgacttcacactgtttctcatatcataccaaatctggtgacttctcagtgtattcttaatatattcatttatccaacaaacatctatcgagtgtccatgattctgtgtcaggcacagctctcaatacttgaaaaacaacctcaagataaaggtcagttccttcaaggagcttccagtctaggattggaggggacctaacatgagattgccatcaagtgtgagaaaagaaaagcagggtccttggaaacctcccctggcacagctgtgccacacagaaggtgttcagggggcacattcttcatggaaaatacaatattaatatgagattggaattttgtgtggagcgatattaacgtggtgaagaggattgagaagggtagtttggagaagatggagaaacaggtacgaacattaaaaggcttaaagcagcacactctggagaattacaagtcagttggcatgacttgaatgtgagtgttgaggaagagaggagtaatgaccagagatgagatgaagaagctcacgcaggacactatgccaaccaggaagtgggcatttatattgtaaagaaataggtcagatttaaagcagacactgacatgactagaattaggttttaggaaaaaaaaaaaaaaacattccacagcattatggaraagtggtgggagagagtgatgacaagaggccagggaaggccacttaggagactctggcagttgttaggcaagaaatgagaaggtccttaacgaagacagtagcagtggatacaggcaggagagggccggttggagggaacacaatgactagtctgagatccagttacccctgctgaaatccatcagaaaagtttcaagttaataattaactgtattctcctaaatatcacttagccaactagtatgattttaaatttacaaagaaaagagattgcgatccaatttatgaatttctaatctgcctaatttcctccagtgaaatgcaagtttgtactgcagtatgtgaattatttaaaatacatgcacttttcctgtagtgtgcagatttacggttggatacaaaacagcctgatgctaaacatatgtgaacattcatttttgaaaatcaggaaaccagagagttactatttcctgcaggaacttctaaaagaaaccaaaaaagtaacataatgtgccagaaagctcaagggaatggataaagtaaattgcaaggttgggaaatgtggccacccaaaagaagataactttctctttaaaattctgcactatgtacccctaatcagataggctgagtgacttacagaggatcctttgtggacatctgagggttttttttgccccctagaccaaaaacataaatcttgttcctctaataaagacgtttcaggcagaaagttatgatagtatactcaatatcttaaagttagatatgccaagacattggaagacatccatcttccctgtcctggtcattctctggtttgtcccgaggggctgtggcatgtgttttctttgaaattttcaataacagataagaaaataatttcttttggatcatcagcttcccctgctgaactcctgctaggttgacttgtagagacaattaaaccaagcatttgccagtttaggtggacattgttattgcagcatttgtccctttcctgacaaattacattattcctctgccctccaaaccattagaaggtccagagggaaccaggtggtggtgaggaggggctgatctcacatttgtcaaccctgaggcagagctaggctgagtgtccaactccctttgattctgtacactgggcgagcagggtgggggcttgattggggtaggatccacatttgaatgctgtcatttgcttctgagcagaaggccatcatctctagtgttcagagtgaatgtgatgcccccagatctgttcaataattgccctgatttctgcctgaggcttgactttcttctagctaaacgctgcatcccctaacactctcccccagtactaacaaagtggctctttcattctgctctgggcggtagcagcatcttttgcctgcacttcagctctgagtctgattcagcatcacaaacttccctttgtgagcatctctgactccaccctcttctcttcctcactgaaaaataatggggtattttagtgaacgctgaaacatctgttgaattctaaagaagaggtggagtcttaaataaatgtgcataagtaagagaaggcaggtaaccccttgggtgaaatccatttgtcttttttccttttttcttttcattaatgagactgggacctagtaggaggtatcatgcatttagagtggtacagggacattacaacccagtggattagggctggttttaggaacatgcagatataattaagaggtgcatcagtccaggacaacagtgcctaacttctctgaaaatcagcggtgtcatctgcaaagaagaaggagtaataccctccttacaggctggggtacaagtattatataatacatagtaaggtactaacatggcatgctaaacaccccaaaatcactagcagtcactattttcattgccatggttgattttctgcttacactgtgatcatctactataagagggtagagccatcagcccactgggagattgggtgtggaaacattggtttaacgttaagtcagctgagctacacaaagcccctcattgatgtcaggccagccctaggcgcacatagaggcatacaagagcagcactgcttatgccctgacagacattagcctcttgtgacaggtgaggaatggagcagagcagatcctcaaacaagtcaagaaatagatagaatgcttgtgaatgcaatgaagaggagaaaggactgagatagggaatggtgggcagagtgggtgcttgatttagtttgcctggtcaatgagggcctgtccaagagacatatcccccaactggactcatagaggatattttttttcagtaccaaaaaattgtgcccaccttcactaagtagttgtacttttaatatccattgatttgaggatacataaagataaaaggcaattgtgaatgcaatagaaagcttttacacaagtgtgtattttattcatcagagcaacattnatgcacatttgaaaaatagagttatacatatgtgtaggatatattcttgattccttctgaagataatgctggatttgaatttggagttaagaatgtggacattttaaccttatcctgagtcccttgaactgtttgatgtctgcaggttgggagtgatggatgagagtgcaaagattagacaggaaatacaagagtcctgagtcatattttcattttttttcctaaagataaacaaagagcaaagaagtcatttacctcctttgagtcttttttgtcattggaatgagaatagtaatgcttgttatttaacctcctaatgattgtgtgaggtggaactaatctgatagataggaaagttcttgcaaagcgttttgaactatgtgaggataaagcattgacagtggcttgaaataagagaatcaaataatctagaatataagtcaattgttatttaaaaaaactaacttgtcaaactgtgtacttcacctgcctctttgtaaattcggatcatgggtagctctgctagcattggctatctcagtctgttcatttctctaaatgatgtgggtgtgagtcaaatcataggctcccaagtgaaagggggtattattctcaaccctctaatcttcaggaaggttattccatgttatacttaaggttatacttacatgctgtagatcacccttatctcatatttgaagagaaatgtctttctgtctttaaaaatctctcttgtatatattttctgctctcttgtgtataatgtaaacccagaaataaatttttacacatttttatattagaaatatttcagtgccctaagcacaaatatttcagtgtattgaaaggccaaacttgattctctttcttattaaacggttcagtgttcagttagtatatatcaaataatactgactgtgctgctttttaatacttggtaacaaatgctttactattgagagaggaagatttcccttagaaatctaacatacagaagatgagcaattcaaaaagattctatagttcatcatgttttaatattttatatttagaatgattgactccaaagacaaaagcactaatgaaaacagactgaatgcatttatgtgatacagaacagaaaaggaaagttgcaggtgaaaaattttggtatcttatagacagagaattttagctagacaatcagaagtattttcatttcacagaagtctcaaaaatacttccagccatttaaagcacatagtagattagatatttcagaagcatctgaatatcctatgacaatgaaatatgcttgctgcattttgtattcaatttttataaaaatctgctttgaagtctttattgaattaacaatttattttaaaatgaatgtatttaacaatacattaacaacataatggaattactttaatttatagattaagtaaatgtgtaatatatttttaccataatagtaaaacatgacattttaaaaagccaaataattccttactaactgctgagcaacccacttacttttgactctaatcatttcttctggtttttacccaggtattcctaagtaaagtgtttattctattattcttaacatttttagccatctgtgattgactttcaactattgcaaattgcaatttcaccctgttatgagccctttttccattccatatgctcccctctcctagctgcccaatacagtaatataacgccttttggataaattagcattaagtgtttacagcctcttggttgtacaaatgttatttgaaggtgaatcatcatattaatttatttactttcttgtatgacttcttgttttaattgaagttaataacttgtctctttgtgcctctctctctctcctcatccttagatttctacatactaaaattaatgtatccctaagtgcttccataaaattccagaaaaactacacacatcatgtaatttgtctgtttctctttggatgcaatccttctggagacccctgccctttgtctcagctgagcatgattggttttagcttcaggaatgttgaacaagtgaggtgtccacctgcgatttctctgcccactgccctgcctctaccctctcacttttactgtacaccctcccgcttgaaattcctcacatcccattgtatgttttactccccacagctggtgaaacataccctttagcatcttcctcaaaatgaataagtaggtaaaattttagtgccctcgtatcccaaaaaacacctttattctcttcatatagtcaatcgatactgtgctgcatataaaattctagataagagctttataatctaaaactttagcttttaataactcatcttattttcatattcagtgtttttgacaaccttaatctgctattgtctactctcccattctctttgttctagtgtttgtagcttttctatttcttcactggaattggggatttcaggagcaaagtacaatcatttttgtataatcaataacttatacctccttcttgaagcccctaaaaatgtccatttaacattatgtctgttaagtttgccatctataaccactgaattattttgattttaaaggcaaatgtttgcatttttgagtgagcatatttttaaatcatgaaattgttgaaaatatagtttgaagtgaactagcttttgaaaaatatataaattgctttttcttaacattttgaaaccttaagatttgaatctgaatttaattctccagaagcatataatgcacttatttctcagtctttgatttgctctataaattatactcagaaatttaaacttggaaataaagaatgagtaaacgttgttaatgaagtagagtggcttaagggactgacggtgaaagaaatcaggggttttgacctagttttgttatacaacctatttttttgccatgtactgataaatttggactgtgaatcaagtctgccctagttgcatcccatataagccctgcctaaactacagttgtcaggtttcattttagagaaatgaaatcagggatggacctaatggaatcaaacaataacttttcagatgatgtcaaggtctttgaaaatcctgccacggtacctatggatcatggcaccatctccaggaagcccatgctgtataatgcagaacattaactggaggggagggcactgctcacccaacccaacattagtgcagatgaagcactgctacagatgggaagcagaacactgaaaagcagggacatgggaaacaggaccagtaatttggtttttcatgtcaggatgaagtgagaagtcatggtattgaggagtcaagaaatattgaaatcatacctttacctagcataaaagtcgatttgttcctgtttttttcagtcctcgtgacattaaagcagtgatctcaattttttgctagtgccacggaaaactcctaacatttgttaatcttcatttttaacaaacagagacgccttggacccctggcctctggcaagcaaaagaatctaagtaaatgatgaaacagagttgtatgttcatttcacattatggtaacctattgatgacagttgattctgatttccatttactgtgatgacatacagtttcctcttataataaatgtgctcagtaaaaacattaatacatttcaaagaaaatattcacaaataatagtaaaggcagtgagaaaatatatcagaaattgtgagcctggtgcacacacagctaacgtgtgggaagttcaggcacgcagcaataaaacaggagacctggacttcggttctgtccatggcaaatatatgacctgggcagttcatgtaacttttatttgcttctacttcctcatctaaaatgaggagtcagctcagatctcttaataaaccccttatatttcttaaatgttgagatttcaaggattttctttgcgcttaatataggcacaggttgttttgggttcgcagcaactagcaaggaggaaaagatcatgaagcagctgatgataaccacccaggtcatccccctgaggatcactggaatgatagaataacagactaactgtctcatagagctttagagcttatagtgaaaaggaagagctctttgattcccctcacagggccacaagacgtgtgacagaggtgtggctcacctgttcagtgctcccaccactcaaaccccttccgtgagggggagtatgcagatgggcacatgtagaggccggggcgagtactttgggctccagctctgcagtagtgtctaggggtgggtgcctgcaacccgagagttacaaagctctttcacctttgctgtcctcagatggcttgaatgttaacgggctcaatggacgctctgcctttttgcaagagcagagggccaatatgatgctttctgtaccccaagctcttgtccagcatcccggaagattcgggtcacacactcgaagaatgaatgcaaggttttattgagcagtggaggtagatttcagcaggatggatgggaagctggaaggggggcatggagtgggaaagtgatcccccacaggagtcgggcctcccactggctaaactcctcttcaactgcccccagccagactcctctcggcgttcagatcttcctccttttctccctttctctgccacgttgttccaccatccatctgctgatctgctggcttgctgctctgctccgaagtttggggttcagggtttatatgggtgcaggatagagggcatggtgggccaaatggcaactttttgggtacaaaaccagaaattcctgttctcatttagggccgcagatatacaggcttgagggtgaagcctttgccagagaaccaccctcttgtatctgtatttccctgtgtcctgtccacatcagtagcactcttagagatcattaagatgaattctccctgccaacactcatttaataaatgagaaaacaagtgtcccagagaacgtatgtggcccattattatacagttgaatagtaacaggcaaaaaactatttatatccatgggctttggcctagaaccctggctccactttggttctcttcattgcatatcattatggccttggaatatgattttcctgaccttataatgcttttaaaaagggagagcgatacctgggtgctgatttttttttaatccagtactttcagaaatgaaatgagtttcatcaataccagcagctaatcaaaataactcagggctacttttgtttctgacatactttgggtagttttgtccaaaaatattctatttccctttgatggttagatctaactgaaatgtgggatatacctggacctctccccaagaacgttgtgaaaataagcagcaattwtaaatggcttaagaattgtatacagttgcattattaatttatgttttttgtccattggtgatataaaataaaagcgattcttttcaaaaaaaatggaagagaagaaagtttacatgctttttggtttttccctcccaggcctttagagtctattgactgttcatcaatttaattattgtgttatgtatgtctaatgtactcaccacacaggaggctaagtagtttccttcccccaaggtagctttcaatggctggaaaacgatccatctgtgagccacactggcctcttcggaaataccctcctattgattacaagagagaattgtaaaagattattcaagagacactactgaggaaacatatcagtgttactttaattatgacctaaagcaaattcttgaaacaaggattgaacaagatccacagagcaccgaagaactgtgcagtggatgagtaagccagatagagatggacaaagaccagaggagatgcacttgggaaatggtaatccatctgtagctgctacgaatatggaaaacatctatttattttatttcaataataaaggtattatatttaaaatatttacaatggctcccaaagtggggcaaggttttgaaaagtagcagaaataaagtgaaagtattagcaggtatttattgagtactattgacttccctgaaatgaaactttcagtggcctcctgctgtctatcaaatgaaaagccttcttgtcatctccacactgagctggttcccaagtgtgactcccagctactgagcagcagcggggttccagctcacctgtcctgttcaagaacatgcccgagattgctctaccaacatgagtttgctcaggctgtttcttcaaatgttcttctcccagcagattccagtttctgcctttgggatttcaataatactcaraggcttatttcatggccttactctgaaaagcctctcctgattatctcaagtagatgcaagctttttctctttttttatttttattgcctaccacacttattccttgttctacttagtaattactggcccacgtgtctaattttctctttcttcccccaagactgtgaagttcttgacatcctatggaacatagcagtaatttatactcatcaaattgaaaagatatcttaaacaccttacaatgtatttttaaagaaatagtatctcatacatgaaaaagtgaatcactgaaaattcagatcactgttaggaccatagaagaaatgtctcaaagagacttattagtttcttaatttagaataaagggagcaatctctttagactaggggactctaaagaaattgctgccaaggaactaggatttaaaatagatttagaaaggtttagctaattgcagataataatctagagaaatggcatgggctaaagtgtagaggaggaaagtataggctgcaatcaagagacatagttgctaaatgtgtgttatagcatatttatatagtgatagagggttgctatagcttgcaaaatatttttctttatattatatgtgtcctcaaatactaccctgtaacactaaggtgccataatgttttaaggccctctgggattatctgtttattcttctctcctatttatctgtgtgatcagaaacagagggaaccattattatgcacttttattcccctcaaggctaagcactttttaaataaataaacaaatggagaatgattgtgctgattatacaaaataagtccctgagagaagtgtgcttgatcacagagcccacacttaaacataaggcttccttgtctgtccagtgcttctagcatgctaggacagcaggcctaggcagaagagagaaatctgaaaatgtacatctgatgaatatgataaatagggtagcagccatttaaaaattagaaccaatggagtaaaacagatgatatctaagatgtataatggcatcaattagaaggcattctgaaaaaaattacaagtaggtagaagtggatttaaatgaagatattgtattagtagcattacatttcacaaaatgaataaaactacaaatgatacatctttagaaacagcttttagacaaaaactagataattgatatgtgaaattgcatgaagacaggagaagcagcattttgccaatctctctagtaataaccactgtccacatcttcaagaaccacagtaagataccactttcgaaaaggcatccttgacacattccacattccattgtactgtaatatctcttgagctttcaattagaaatctgtattgtttgattgtcagctatgcatctggggattacaaaggtgaataaaatattgtccctggcctcctcccagagggaagtatatcacacaactctgctcggatccactgagtctcacctccttcgggctctgggctacttgttatgccccaagtaggggctctgactcagcttctcagggttagactgaaaatatcacgaagaggcgctgaacayatatgttgagttcttaggattattacccaatctgtattaaattactggggtgaggcacagtggctcactcctttaatgccagcacgttgggagaccaaagtgggaggattacttgcccagcagttcaagaccaacctgggcaacatattaagccctcatcactgcaaaaagctacaaaaaaaccttagcctggcacagtggtgcactcctgtagtcccagctactcaggaggctaaattgggagaatcacttgagcctacgagttcaaggctgctgcagtgagccatcatcacagcactgcactacagcctgggtgacaaagtgagactctgtctcaaaaaaataaaaaaataaaaataataaaaataggaataaatacattattagctcctatgttttgctcacagctttaatacccccctgaagttcccctaatttatgcctcctgtattgcacatggtaggcactctactaagaacaaattgaagcttccaaattaacaaaatatattgaataaaaaagaaaaatacctcaaatgttatatctcaaggacaaaaagtatttcttttagtgagaaaatcgtctcaaatataaaaataaaaagagaataccttaacatccaaaaactcagtcgttaaaataaaagaaaatgagaatatcaatgaagaaagaatccgtttgctggcaatttggctccatatgtgatttggcagctgtattagtttcctactcccctgtaatatttaccacaaaattagcagctgaaaacatccatttattatctcacagttcctgtgaattacgtgaccaggcagggcttacctgggtctcacaggctgcaatgcagctgttggtcaggggcacatcctcattcgaggctcaacccagggtggagttggggactggaaggttgatccacttctaggccacctcaggttgtttgcagaattcatctcattgtgggccgggcgcggtggctcacgcctgtaatcccagcactytgggagaccgaggcgagtggatcctgaggtcaggagattgagaccatcctggctaacacggtgaaaccccgtctctactaaaaatacaaaaattagctgggcgtggtggcgggcacctgtagtcccagctactcggcaggctgaggcaggaaaatggcatgaaactgggaggcggagcttgcagtgagccgagatcgtgccactgcactcagcctgggtgacagaacgagactccgtctcaaaaaaaaaaaaaaaaaaaaaaaaaaagaattcatctcactgtggctgtggaactacgggccacattttctcgctggctgtgatcaaggtctgctctgagctcccacaggctccttgacatttctcctctctcagaatatagcagcttacttcttcaaagccagcaaggtataatgtaacctaatgatgggaaagacattatgtcacctttgccagattctgttagttagaagcaagtcacaggctccttctgcacgcaaagagaggggatgatgtaactcattattacctgcttagaatgtgttcaccgtgacaatgttgtccactacagtctatatatatgcaaatgattggctacctttatctataacaatgtcagaaacaaagtctaatgactgggaagttgaccattatttcaagatatattcctgtgaatatatgaaggcattgtgctcaattaggggtaaacagtggagatgcagtccctatagctgtaaagcatagtctaatggggaagactaacatgaaagacaaacaaacaaaaatcctactcccatacataattagtttctaataagtactgaggaggaaaggagcagggttctaagaaaatgactaatgaggaaaatccactctggtgctataaaagagaataagaaaaagtactttgaagttggtgatcagggcatgcttccctaaagaaatgtcatttgactacctaaagaatgcctagaagttattcaagaggaagaaaacttgaggtagagtgaacacaagagcaaaggccctgaggcaggaacaattaggtctttcggagaaaatggaaaaataccagtgtaaatagagaatatgccctgtggatagataaaagtggggagataggaaggggattcaggccatcatgaggattttacatttatcctaactgcatgggaatccattgaagagttttatgcaagggactgacataatccaatttgaaaatcactaaaggagaaacaatcttttgcatttttaaaaatcctcattaacttgaaagggttcttgcctcttgtatgtagtgtgatgcttttttgtggagttgttgacagtatttcccaggtagtctctagggaagacactgccgaaattaaagtaattggtatttaatcatgtcttagttaacatttttagaatactgcttttagcatgatacttcttcctatgtcatttttttgtcctttttaaaactagtgattgcatttttattttagggacttaaaaacattgcaggtggcatacttctgttcatatttgttatcccaattttgtctaaggcattaggaagacctatgtgatataaatagcaagtttaaagtaaactgaccttatttttgatgatttcagtagagaattaaagagactagattctacagttttcctgtattattcagagaattcatggagtaaaatatttcaaatttcctctccagtaagaaacaatactttttttctgtgatttttatctaattagctctaaagcagcatttatatccaaaagctctctacagcaactccattcccatgtagaattcactgtaggcagaaaaaggacacactgttgaagttttttgctaccaattaaaaagcaaaatagcaaaaaccatcccactgagaaggcacagactaaaccttatctcattaagactaagtctacatgctttatttacttgtggttgagaatcaatgccctattgtcttctagacatacataatttgcaacagaaacaagaaacaggagatacatcttcattgctttgtctaacctagtaattaaaatgagggtttttattttcaaatggacagtattagcaagtcaacaatggcttagaatgatacaaacactacatggagaattatctgctacagtagaactttccttattaccttgtgcttagcaaatacacaattgttgaatgaatgaatgaatgaatgaatgagtgaatgaagttagattagtgcattgcatctgttatctcactagtttggtagacagtttgcagaatctgtccaccaaagttggggagcactggggtcaggatcaagggatgatggtttcttggtttcaactttggtaaaatgaaaagtagactcaattattcagcaatagaggatacctttccataatattctgggaagatataatagtttgttctactacccaagtagttttgatgaatcaggtaagtggtttggatgataagcatggaatcctgtgttttcatttgcatgtgtttaatgatataaattttcttcctgtactttgggagcaaggatgtatgttatccactgtagcattttacataagcaaaaaaaaaaaaaaaaaaagctacatttggctacttctcattgggaaattgtgtcccaagggtgcaataaatatgccaattttatgcaacagatgtaggactggacacattgaattatgaagatggggcagaatgcagacaattaataatgctactgctctaaaatatagatgagttttaaagaaatgttttgatagttgtcttgatgttgtataataagatgatttctactctttgctttgcacagttaatttaaatgttctttgttctgtaaagtctatgtcaaatagtctgaagggcaatcaaaacttagatgctattttttcagtatacggacatttgtccaaaggattgaattttaaggatggtattggccacatcatgtacgttcatgtcctatgtattgagtgacacaaatatgcaaaacatataaaaagagttatgtaagtttctatttgcaatttatcctgttcaatgtgctttttctactttggaagaatatatttaggatgtacgtaaaaaattaattattagtgtaatatttaatgggaaattaggagagctataaagacaccaggttctttgtctaggggagaattaactaaatcctttagatgcctgagtgttttcttactaacttttctttaatgttactatttaaaactccttggtagaatgggattagccaaatatcaaatgtgaattatcacatccatatttgtttagttgaaaatacaagggtggtgcagatttaaatgcaccagtttattaaccttggagtttgttagacatttttgttttgtgtaaagcacttatatttttcagaaacatttttgttttgtgtaaagcacttacatttttcagaaacatgagtggaacttctgttacgttctttaagaaattccttttaattcccacttgtcaaaaggctgcatttccctgctgtagactcttcctttggcacccagacaatacacacaagactgcccacccttccttttttccctgccccttctctggcactcagcctcctggcttcctcgaccctgaatgcatcaaacccatgactctgccatagagcctagcacatgagaggggcttcktaaatgttgatatgcttaagctttttgggctttgattcccctacctgtaaacttggtataatgacagtacctacttcataaagcattcatgaagattaaataagctaaatgcaaactaaattagttcagttgttaacatagggtcacaatcagggataatggtttcttggttgcaactttgttaaaatgaaaagtagattcagtaattcagtaatgggagtttttatgggcttagaatggggaaatgcatgctgatgggtccacgggtgggcttggaaaagcaccattcgattgggtgaaaggcatcattcagaaggaaccagtcgagagagggtaagacagggatagaagttttcactccagtggtggactccatctggaactgccagctcggttttcaggctttaaactgtcctttggcttgaaggtcgggttcaagccatccctgtctgcctagaaatttgtctgtctcctgctgctatcatcatcatcaacatcatcatcatcattgcctttagataaaattaaatactcattacaagtagagatatttccctgagaaaagaaaatgtatatcatttctctcctcttcttatctcacagacttagtaaattttccaaggacccttgaatcatgtctctaacacctttgctttaaagtgaaaagcaggaaatccagggggttggaatatcttacccaagatgatagagctaattaatgagcaacatatcctgaattcatgtgttctgatatctatgggtcagcacatgttttctacacagcagaatctctctcttcccctgtagcttctgaagttgctaaagacaaaccctcctattaatatcctctgggtttattctaggttgaaacctttgccctcgttattggttatctgttaatgatagcctgccggatggttcctaaggctcttactgcaaaggctgatacatagaaacatagaagtttccttatgatgaagccagagaagctgtgctgctctgaaagctgcccatctgtgtactccaactctatgagacccagagacaggccaacaggccagtcttcatgggcttgtggcttgaaggctactggaccttagaagggccccatgcttggtctaatgctctgctgtggctatcttaaaattcttaatgttctttgaatgaaattccacattgtcatgtttctctctgccctacagcttttttggcctgtctgctgaagaaatagtggatctttgtgataaatccctgggcactcagggaactactgttgtatgggagaaactgctatgcttttaataacaaaagtcaggactagaaactcccccgattagtaatayagatgaaaactttattttcattagagcagcatatattttttctaacaggactttttaactttgatatgacagaggaagagaaaagacctgctctcaggcagctatacccttagtgtctgggaggaggacactaagagaactctatagatttaacctggacaaattcctctcaagcactatttaaagggactttgttctaattttttaaaaaataaagaacataatttgacatataagaataaagttaataatgctttgataaaacctgtgcaaaaggaaaatagctttattgagacattcaccagcattttgaccatacaactagactaatggctttgttgaaaagtaaggtagtaaattcaaaatcacagaagtacattcccaaaaagcaaataactttgcatccgattagcattttattctagacaactggaggagctcaaactaatactatccataatatgggcccacctttatacactggtattgagagaggcttggcaaaatgacatgcccaccatggagagctccaccatatcatttccctcctgggcagacaggagggctgaagaagcagactggtgagaaatgggcagctcactctgaatctttgccctttgagttaattctagttgacctacttgagcaatgattgaggaatttttgattcagtttgccctgatctatcccctggtgagcatgggcttgttattttttaatgaaactattttcacagmctgttgtttttggtgtcagagatagaggagagtgaagttatttttttttttattcttattccatttttttcatcaatcctagtgccgcttatgctgctgaattgcatttwactggtgtcttgcagcaaagcatactttctagcaaacaatgcaagaacactaacaaaggataaaaataataccaggcaatgaccaatgagaaaagcacacacacacacacacacacacacacacagcaaataccttttcatagcagatgccagaattgtaattatataattttgtcacctttcttgctttatgtaacaatatctgttgggaagtacttgtcacgaaattgaatatttctcacccaattcatatcttatctcttaaaatcaatgtaaaagtactcctttatattttttgctggtaaagtgaactctgtttagttactccagttttcgccctttggcagttagggtgggtaaaagtcgatccctgttctcccaagaggagttttccaattagatgcactttatttctagaataaggaggatctgactacacagttagcaccccccattcgtgagatttcatcacctcctttcaaaacttgcgttagtgggattggagggttttttttttttgtaaattactattaaagtttcagaagtggatagaaatctgttatttagaaagcagctgggtacagaagtcaagctgagctaacttttaaaataaatcaaatggagaagcaatactgcagaaaagagtagatttatttcacagtatgagctttagtacattaaaagcacaactaaaggcaatgcactaacaatagtcagtacagatttgcagataagatgtccttagctacccagccatacatcttcatttgtttttccatttcttaataaaacgatcagagaataggtttacaaaactgagtgtcattatcatgactttaatcttgtttaaattcaaaactgtcctctaggctttgtgtctaaaggagagatttatagcaatctgtttttttaaaaaaaaaaaaaacagtagattgtataagaattactatttggattctatatttctaaagaaagcaactctgtaatttttggaacagctcactgtaataaaacatcagtaggcttttaatttcaaatgaataagcgatcacaggaagaatgtatcagcatactgaatattctctaaagctggtaaaataacactcatatctgtaattcagggtcaagatggataattggaccatagaaataacatctacagtcaatacttagacacaacaaaaaattaaatatttggaaatgtcaatggtattcagtggaacttcctaatcaagtcctgagtgccaagtggaattactctaacttagaaaatacttcaggagcagcttaaaatatagaaaatgtccagtgggcttatcacacatagtatgtgtgtcataatcatctccaagtgacagccttttgcctctttacttgatattccccccttgattcctccaacagtgttccaccatcaactagtatgactgggtcacgaaagttccatcttggaaaattcaaattacttacattcactcaacactttgtgtttaatcccttgactttaaaataataactcctaatatcttagggaggaggaagtgacattacagtcaacagtcatggcttttagattccttctgaaccatctaagtcctccatctgccctactcccaccttgcattttatcatgaagtgacacatagcagaagagcagtataataaanttaagccagtgacttactactttccccaagggtagaaatcccctctgtttcttttctcttttgtttccaggttaaagggtgcatttgcagacatctaataccatgcatgctgatctgaaggaatttccctgggggaatgtgagatgtatatgtcttttttatagtcttatgggagacttttacttttagataatcacaggtaaatcaatatggttttagtccctctgaaccaataatatatgtttactgaattggattataaaacatattataaattaaaattatcttattttctttcttaagatgctttttartactttgtagtgataagatttctgtagtggaatagtctatcgaaaaagcgtttcagccaggctccgtggctcatacctgtaatcccaccactttaggaggccgaggagggaggatcacttgaagttagcagttcragaccagcctgagcaacaaaatgagactctctcatctctaaaaaaaaaagttttaaaaacttatctgggcctggtggtgcatgcctgtagtcccagctacttgagaggctgaggcaggagtttcgcttgagtccagaagttcaaggctgcagtgagctatgatcctgtgcattgcactctggcccaggtgacagagtgaaacctgttttttttttttwwaaaaaaaaaatgttttgatacttcaaactcttaaaaattcctttgttaagtatataaattatgcccaaaatttgtgccattttaaaactgagtaagcattttaactagaatactttatcttagcctaaaaatgttatctgttatataattattttctattgactcacagaagatgctagaaataactatataattactcaataatgagctaagtttctagggagtgaagggagttatccttgcttaaaaattgggtaattttttaaacttacccagtttttaaggttagcttttctagggcttaaasatacatttctgtaaaaaatactcatttgtttttcaacctacattaaaagaatattatgattacctcttttttattttgagatggagtctcactctgtcacccaggctggagtgcaatggcacgaacacagctcactgcagcctcgacgtctggggctcaagtgatcctcccacctcagtcttcagagtagctgggacgacaggggtgtgccaggggtcagctagagctggggtttctctacatggcccaggctggtctcaaactcatggtctcaagtgatccacctctctcagcctcccaaagtgctgggattacaggtgtgagccacagtgctttggcctctctttaaaartgccttttttttttttttttttttaccatgaaaggacaaagctcactttatattttgtagagcatggtatttgaacaaagttaagggattggtcatcattaaaatagttatgacactgtctactaaatcatttgtatctatatttaatacatcaatacagagttatagaagttcacatataaaatgtggtattgacagtggaagaaaaggaaagaatacaagatatattggaaagaaatgacagatatctgattttctagctcatctcttataaatgatttaatacatgaaaattattcagcataatttctgtgattgtcagaaaatgacaatcagtataatatactgaaaaatgatttagattagttgtagtcctaggctcttcactttctaaaaatgtgtcagtttatcccagcacattaggaggcagaggcagaaggatcacttgagttcaggagtcggagaccagcctgggcaacatagtgagacttggtccctacaaaaattaaaaataagttagctgggttctattagtccattttcatactgctatgaagaaatacctgagactgggtaattcataaagaagaaaaggtttaatggactcacagttccacatgactggggaggcctcacaatcatggcagaagntgaagaaggagcaaagacacatcttgcatggcaacaggcaggagagcgtgtgcaggggaactcctatttataaaaccatcagatctcctgagacttattcactatcctaaaacagcacaggaaaaatccaccttcatgattcaattaactcccacctggtccctcccacaacatgtggggattatgggagctacaatttaagatgagatttgagtggggacacagccaaatcatctcactgggcatggtggtgtctcaagcctgtagtcctagctactctggaggctgagatgggagaatctctcgagnccaggagtttgagcttgcagtgagccatgattgttccactgtactccagcctgggaaacagagcaagaccctgtgtcaagaaaaagcctgtcaccaagttgctctgagttaaataagtggaagtggtgctatggaaaatgtaaagcattatgtaagtgtcaccttcttagaattcrtgtagaatcaccaactttagaactawaagtttgtrgagaccccaagcctctctgactccattatggaaataaggaaataggcccagggaggtggggacaattgcaggacttggacctcaattcagacctctggacacatttcatttgtttgcttgtgtgtttatttatttttgtatatttactgttggaatgtagtctaaaatagaacaccattgggatcattaagaagtgtattgttgtgtctttttttttttttggaaatgtggaagccaagaatgaaaatgctgtagagatttcttcagttgcatcctcctctgtttagaacttctggggaatgtgcctgtctttgaataaatggaaacatcccttgcaaaagttgtctagctagtttcaggctaagcatcttaacaaatcctggctttaacctaccagtcctatctgaagtcatggaatgagttagacaccccatgtctcccagttttcccttttatttcaggtgatttagcacttactgagtctccttcataatgaattagtatgatactttttactgtagcaactagaatrgagattatgatcgaaaaataatgtcatttcagtgagttttggggcatactattacactattttcaagacaattaatgaayttacagtcatactttctagcgtaatgctgtccaatagaaccataatgggcactacatacttaattttaagttttcttgtactcacactaaaaaagcgaaaagaagcagctaaaattatcttaataatattattttaattcaatatgtctaaaatatttcaacatgtaactaatatttttaaacyattaatgatagattttgcattcctttttttaatactgtctgaaattcagtgtctattttatacttacagcacatcaaatgtggattttaaattttcatcagaaatacatgatctatatttgatttcataaaatttatatttgaaaaaagtaaatttacatacccaagttattccaaagatacttaaaattattccaataacagaaataagcatcagtcattgatttaaattttaaatcaattattataaattaaaataaaaaattcagttaataagttatatcagccacatttcaaatgctagatagcmacatatagctagtggctaccagatagaataatcgttctagatattcagtgctgtcaccaggattattgctgtagaagagagataaaaagttcatctatccatctattttattttattgactagtgctttattttgcaatgcaaacattacctacataccttctgtaattaatacttagattttcctttcaatattgaatagtaaaacatccattataagcactgatgggaagataaaccttgggaaattgccttaactgtgattgttagtactggaattgaccagattttctttccaacagctttgcatgttttgtgggtttgtataaccatgtgccctgctttataaatactttcagtttaacctgctttgtttcacttgattgctctagtatggttaaagacaagtgtttttgaataacarcaggcctatcaaattgccaactgggaaatccatggaatatgcttagggcagctttttgcagcatttcctgtayctggcaaagaatttttgaaaaaaatgttaaatagcacaatggattcttaactggcagactctaggaaacacttttatatataatatataggcttactagttgccattactttttaaaaaaattagggctttaggcccatgtagagagacagtatagcaaagaaattaaaagcatgattctggagtcagaaccatttagaaatgatatraatttgtctgaagttactttaccattccaagccttagtttcctcattctagaatggagataagattaggacctactcaatgaagttattggagaattaaatgataatatgtccttgactttgtacctgtcacagagtaagtgctcagaatatgaactgttactctacaagactagtggaaccacaggcatcattacacttgaaactcatcaccaggagttaagaagaaggaaagcaaatactgtacgtgaccattgtgaagttaattcaaggagcataaaccctaaagagtggcataccagtggcctcatccccggtttgtttatttgttgttgtttttaattagggtgcaaaatctttacatcaagaagcaaaaggaattgttcatcagtttcactatgtgatttttgcttttctttacctgttccaagatggctagtttgattatattgtgaaacaataacttataaaaaaattctctaaaaccattctatgagtaatagatcagacttttaatcaaggtattattttatgttctgcaaattatagcaaagataaacattgtgaagtacatttgctagttttatgtagtgccagattggtaaattactgtacttttttgctgtcctattattgttggtggtggttgttttttaatttacatcatccttcatgttcctagactcctatttctcagagcccttttctgtattattattattaatgtggcatgtttaatgtttayagtatttccataaaaatagttcatctctgctaggtagttttcaatgttaaagcaaatgtgcttactcattgaatatgaaaaatatccctctggaacaaatgtagaaccatccatctcttgaacagaattcttacgggttttacttatctgcctaactgccttgaaaacagcttggaaatcattcccatacttttggggagcagtcaatcatttagacagtttccactgaacagcttaaaataatcaggttattacaagtaaaaatattttaggatgggtatctatgccagctaacatgaaaacccacactgaactgatgtttaagatgtattattacaggcaaaaagaaaaaaatcttactttgttttttgcactggcagattacaaaagttcatgggacagcagtcatagaaacacagagttttaggatgaattatgcattattttaaaaacctttagtattgagttgttagccctccatgtggatagaatttcagagcccttattacattttaaaagtgaagctagggcagaaagtgactcaaaattagaaatgtcaggatcttcaattttgaggtatggccatttattcttaaagatactgcattcaaacaaaaaggagtcagctgaggtggctyacgcctgtaatcccagcactttgggaggcctaggagagaagatagcttgagctcaggtcatcgagaccagcctgggcaacatagtgaggcccccatctctacaaaaccaattaaaactagcctggcataagggtgggtgcctatagtcccagctacttgagaggctgaggtgggaggatggcttgagccaggaaggccaaggctgcagtgagctgtgaccacaccaytgtactccagcctgggtgagagagtgagaacttgtctcaaaaaaaaataaaaagagagagagagtgagatagagagacagaaagaaaaagaaatagggcaccatttcaaagaaaacataaaagcattttttaaatattacttctttatgatttagaatggatattttttcttccagaaatgaaagacaagtgtctctagaagaccagactttagaataaacattgcagcaaatgtccaagccttggcatataccccatattttgttggcatcttgtataggtttctaatcttatattataacccatatgaatgtccactgaggaccacaaaaagatcttcatggagaaaaaaaacacagcttcacacattaaattaagcataagaggagcacaagactcgggctttttttggggggaagtgagaacagctccagcattcgttcttcccggcaaaggtgaacatatggccatggtgtctcctgctatcaacatttttgcccctgagggagactagcaagtcrgaactggttagagaccatcagagagaatgagagatcatctgcatctcaaaggattaaacaagcattggatagagaggaacagaaggcttcaggtagagacagtggtgtgtgatcaaagccattcatgtcttaactttacaactgtgtggagagctcagaaggaggaaatatgtgagcagatcaaaagatcagtgttgcagtaaagaaagagataagattgaaaaaatgtggagaagtgaatactcagcccataatacatgcagaaagtattatctgggctcaaaagttgttgtggggtagggggatgggggagggatagcattgggagatatacctaatgctagatgacgagttagtgggtgcagcgcaccagcatggcacatgtatacataagtaactaacctgcacaatgtgcacatgtaccctaaaacttaaagtataataataaaagaaaaaaaaaagttgtgtcaaagaactcagttagaaattggttgtaataatacagtggtgagctaggacagaaggaacaaagagatgggagaaacattagaaaaattacagggagaaacactgactgcaggttacaatggctggtcagaagtgggtcaagacaagtttccaaatgggtaccagcagtagtagtggtaccattaacagacactttgaggagagcgaatgccaggagatactggttggggaggactgaggctttttggtgttttaacttcgtataaaacagagtaacttttaggtttcattttatgtaacaattttcatgctataacagagcttgatttttctcaggtcattactaaaatatcaccaaagagaagaattctggatatattagaattcaaaaagatattaaatagaaaaacaagactggggaatatatttcttaaacatgtgtaagatgtttgcaggttacaagcaaacctccatgtagtctgtctactggaagaatcatgatgggactggaccttcaaccactggcaagcactagagataaagtatggatagccatcagtaaacatagtaattttgttgtaagaataggttagatttacagaagtcctctcatggctgtgtataagcactttttttttatttcctctctctaacagaagaaccatctacttgatagcagtggacacttttgatgcttttaattgtagaatcttggaataatacactgtgctattaaaattgctcttctactttctatagttctatgaaatggaaaatcatttggctttagttgttacttatttagtgatgacaaaaatgaatttgaatgaaaacacaaattttttacaagaacaaaattgagcagtacagcagtacgggtttatccatctttctgcaagtagtcatctaccatttttataggttacgagcacttccgcacatcgacacaataggaacaaaatcataaacagcacagttatgttcttagaacgtgtttgaaataaaatgaagtctttatgagcatgaaaagtttttttttctttgactgcaagtctacaaagcactgtgaatggataatatgaacagggtgcccataattgttctaatggttgagaacatttcacctcagtctggaggatttctcattcccacttccaaatcagctccagacctcccccgggcacaaatacaacatgaagcactcctgtctcttctcctttttaaccctgtcctatctgtacattctccacctaatttgttagtagcaccagtcttccaaggagacacttcattcctaacttgtccctcccctctagtaaccacatacaatcagaggtctaatctcaatttagcctttaagaatcttaaattttgttccctcttctccgaagatgctattttggtagaggctctcctggtctctcaccagctttgcaatatccccctgcctactcacccgctttctgtcttctatccctccaatccctcttccgcatatcctacagcatagtcattttcaaatggaaatctggacttgtcattttccccctgaaaaattatttaatgacctcctgccaggatgtcattcaagcttcttgatttgacccattaggttcttacccactctccagcctttatctacactcatgcagtgttgactgtggtccagctttaccacactcctggacgttcttcgtacctgctctgctcagccccctcctggaacgtggtgagtgtttagagtgccctggacacacactcccacctaagtkgctcatctttcaaggttccgcaaaacatgatctcatctaaacttttcccctgcatgcccatctgttccctttgcttcacacttatactattactcctgtatttgtaatcattttcaacctctctctccatgacaccgtgtgctttttaaggatagaggctatccataagcattctgtttccaagaccaggtacagaacctagcacgtaatagttattcaataaatatttctctcatgaaactaaaaaagtaggtacagatgggcttcacattgggcccttatatctgtacataatgaaatatttgggcttggaacatagcatcctagttattactttatcttagagtaaatcatttttgaacactgtactactaattaatggctctttatgagttaaattagttaatactatttacaaatgtgtttagtattgaagtaaaataacattctgagacaatctagttcccattttttaaccaaagagacaagtttgagtttcctgatgtgaagaggaaaccatttggtcttatcaaaaattaagatggaaaggttacatgtgcagttatttgctaatgtaatgagaatgtccatgtctccatttattaaaaactgggaagtttatattaaagctgattgtcatgcttcaattaagttagcaaatatggatgtcaattttatcacaaatgcaatattaaaactgatgtttggtcttgtcttgaatgcaatgattaaattcaatctagtactcaactctctcatattgaataaaaagtaaacagcctggtgttttccatatcatggaaatctccctggtttgctgttgttgggtatttatacatacatgcagttagcaaaaggtaagcagattcatcattaagttgttgtattgaatcagtaaggtgataattgaatcttaacataccaaaacagaaatctcaagaatggctattatgggactagttttataaaaggggaaaacataaaatcagtagaagagatttgcttttaacttcccagtatattttatgtgtttaacaataacaataaataaaacccatgcacatataattgaatgtgcttgttcattagtttggaaaagagatctgctcattagtttggaaaagaggtataacaataaataagtgtgtgtgtgtgtgtgtgtgtgtaaacacacacatatttatatttctcagataactgatgtgtcctttgctggaagaagaaaactatgagaaaatgttggtgatatactttttcttcttctgtttttgtatttgttatttttgtgcttatctttagttttgatattggattaaactttggcagctttgcttactgtttattctagggatgcttcttgtatggggcctctgttatcatatcctgctaacaatacagtaaatggaaatttggggaaagcaacagtaggaactgctgtgtatctgcggttaagttaatcwgattttgataccccaaaaccaacacagcccacaagactgatagcccaatgctgcagtaaattgtttcttagcaggaaatctacagtagcagtgtaatttggacaatggagcgtttgacagctaacccatcaaaagcagtgcaccctgaggaagttgctcacttctggctttacattcagccaagcattgataaagcagtggctaagtaggagaatcaatttaaaatcaaatgatagcaaggctatttatcccattgccaaaagaggacagagacagagagtagattattccacctgaggactctatactgtccttacccaaatgaggggatgggtcaattatgccttctcaattccttttgagtgccagttttctcatatattaatatttctcatatattaatataagcatgattaaaagctaagctattgtctattctcaaaagatggatttatgcaaaatgattttggattattcatcttaatgaaaacactcttttttttttttttgacagacggtctcactctgtcacccaggctggagtgcagtggtacagtytcagctcactgcagccacaagtgatcttcttccctcagcttcccgagcagcagggagtacatgcgcatgccactatgcctggctaatttttttattttttgtagagacagggtttcactatgttgcccaagctggtctcaaactcctggactcaagcaatcctccctccttggcctcccaaaatgttgggattacaggtgtgagctgcaccacctggcctgaaagtttttaagcttcaagtcccacaraacttaaatatgttcctgaagggccacrgtaatgatcctggtaaaaaggrcaaacactwattgaaacctgctacacttgacctgagcaaactcattagcaccaattgtggattgactgggaagcttggagacaagcttcttacttcgtctgggactcctgagcttgagagtggatgccttagtaaccctacagtttgggatttgctcttttcttctaagagactattacccaccaactgccccatacacacacctatacctgcattccagggttgtgatcaataaccaatcactattaaactggcatcataccaatatgaaantcctccgctgtctcaatatcccaataaccacaaagatctatagttctgatttaacattttagcaggttttttttaatctaagcacttacattgccatttaatcaatgtatatgcaatacatcatgcaataatttcagatattcattgttgacagtaaagcactcaaaatttagacataaactatcaaataattaagtggtacaatttgatgtgacattctaatatctgagtttagacatattccaaatttaatttttttgttaaatttaataccactcaagtttactgtctcacggacagtgatatatggtggtagaggaggaggactggtagttcttctttctggtaataaagctagaaaaggcatgtttgtttgaaaagataaaattaaaagacacacaaataggagttgttgccccttcactccagttttcttctagaaacttggcatccccacacatacacacgttttcctttcataccagatctgctgtgaacttcaggccattccgtacattcataaataatgtcacagaaatacacaatcaacacatccagctccatggtatagctcttcaaagtggctctcgtggatgcactatgatgttcagtgatgatgagtgttcatactcagaagcaagcatacatctcactctgtacctataagaaatttttttcttgtttgatgatagtgcaataaactttttttaagtatatgtttctaaaacaaaaagctccttaagaatgtagttatacaaagtaattatctcaggtatttgaattaagaatattaaatcctaaatacgttgttttcttctcctatgtaatgagtaaaatcatctttaatataaattacatacttaacaaatattcattgcaacaaaggttttaaattggtatggtaaaattgcacaaaatatgaactttcacactgcagttgtcacatggtccctgggagagccatcctttctgtaatgaggttaagttaattaaagtgggctcaatgctattagctgcatgcaaaactgaaggtaaatgcttaatcatagaaattagagatgattatttaatgaattctgaataaatgtaaggttttwgtccagcacgtttgcaaaaggggattgtttgttacacacagaaaggtaagaaaaatgtcattatagaaaatctgggatttagttcrcagggtttttgttttgttttgtwttttgtcttttctgggtaaatggtgatcttaagaagttatgttaaaaatagtttgtaggccaagcgtggtggcttatgcctgtaatctggtgatttgggaggctgaggcaggatggcttgaggccaggagttcgagrccagcctgggcaacacagtgagacctagtctctcaaaaaaaaaaaaaaaatgtttcttaagtattagacatgaggaaaaatagcaatttgtagtaataattgtattagtgatctcaagattctttataatgtatgatttctatctctctaaatttgaccatgttaatgagacaaaatgtaaactgaccaccttgactttttaaaataaattgaactgttctatattattttaaacattaaatccaaaatatttttagatacgtataaagtacacaaaggagctagatatgggaatatagctaaaacaaaagtaagagcatgagaaaatgggacaaaatatgattgattcccatcaacgtggacaaagaagcagcgaatcaagacaacagagagggcattaaaataaagtagggaccaaagagaattttggaagtggaaaccttaaagaagatgtttcagaaagtttctaatggagtaggancaaagtaatcaatgamacaaatgctgcaataataggtattattttacgtcatgcagccacacgtctttcagccaccatttatgtcttaacacacctacaagcccaaactaacaacccttctctaagagtagctgacagaactaacgaaagcctgaggcagcgcagccatcttgtcacctccgtatcttagcgcctctgccctctcggactccttatcgsgcctaagaagtaccaagccgttcttattctgatggctgcggagagctgatctaccaccatgtgaaactaagtcatgtgaaactaaatccaaaattccacaaggaatgaggtcgatctatcagtgaaaataatagcccatttgagcgcttcttctttctctgaccggaaggcaagctctccagagtccactggggatatttcctaaaaacactttgaaagctcacacatgtgtactgtgatttttagaaagcaggatactccgcttggggaataggaaggcctctgtaacaatgaaaaatggtagaaatgggaaagattcatgaacatgtccagagaggttttcgcataatttaatgttgtttgtattttctaaagcttagataattgcttgttaaagactccagcaagtttatagatagagtgcttgctacatgatagtcattgtatggcataaacctattttagcaaattttccaatagtgcacagcatgcatctgtgactgagacaaaaatcaatgcttatggatttagcagtgtaatcctatcacttgttttgtgagatatgatttgaaatgtaaagtacgttaagacttaagtgaacttggaggcatggagtctctggggtgtttcttagtatcctatttattattgatcagactatttctttattgtctctctactcctcgccccagttatccttcctcccctgcaccaatagtttttaaattatgtgtatcagaaccaataagttatccttagtatgagggcttagttcntacttccaaagtaaggaataatatgtaatttttcctacccagaacataatcatgtagccagtcaatttaagtcttagaataaaaatactagtaaaatgttagctcaagtttccaagctttgcaaagaagacttggtgttttttctagacacatttcacaaagacagtagtaaatcaactacttctaagcaactttaaataaccctaaattattgtgcttagtagctataggaagtcactagtgtaaaattttagaaattgtagtttttaatctgattttgtcaagattttaaaaccacatgcttgctctactctcaaatttactatgaaagaacaatcaaatacagtttgaagtagttctacctacctggaattattcattcattaaataaatatctattggagatctatggtatgccatgtactgggacaaagtcctcagcccttataatgcttttattctggtgatccatcaaaagctattactctgtggaggctattactaattagaatttgcaaaaattgtgtttgtttaagtaaatgcaaaaagtccgactcttttcttagcttctgaaatgmtcatcagccacaatacccttaagatataaaaattatgatagttaacgtaggctttcttcagtacttcaacctagcctgatttgagataaaattctgttgaatttagtaaatgttcttcttattaatagattatatatctaaggatctgatttttaattcctactttgaaagtgagttacattttgcatttactgtacacttttgatgtggccaattcagttgcaaactaacatgaattgttaaaactataattctcatttccatcagcgtattcctttgggaaagaacataacctgtccatgaaaggatactctctctatatataaactactgaatcttggatttctattaactatgtggcttttagacataggtaaatgtagtgaaagaaaataatgtgagcttccatctaataagaccagactctgtctttgaaaataattattggaaggagggtggggaaggaacctgtgcccattcacatgagctctacttgctgtatatttaaagcaagtcagttatcgagaaggaatccttcagaataccgcgaacatatggaaactagctrcttatacatattgtctaactcttttaaaagttattttgactttaaaagaccaaatccacagaatgaccttgagctactattaatccacctaactgtagggcgtgaacacagaacacatctgccatctgtcagctgagaattcccctggcaccacccagactcccactcctcacaaagtcctcttggggctaagatgacttagagagaggtctttctttgctggcaaagaaggagtgcatttagactaatcattaaaacccattacctaacaaagtgcatgttcttagggaacacagwgatacttgccaatgaattaatcagcaaaataggctaggagaaggtgggattagcagtctcagaaaagatcagaatccatgagatgccaaagcggtttcacttgccataaatcttcacccaattagagggatttttatcttaacatttcaggyttctatctggatttagtttctttgttgctccacagtatgttatagctggggctggaacaacgaccaaggttttcctggagcttgatagggaaaatcatttatttgaataattgatcattcaattagcaaagcaaatgttgaacagttggacagctctttttatcagtgttgatgggaagtaattggctgtagttcattacaaagcagaaaattgaaaagtgtgattttgaaataatattaaatacaacccccaccaataaagccctcctgcctactccttttgtcattgttgtttggttttcttttccctcagtgctattacattccaaagtaaaaatcaaggaactgattatgttccctggctactactgaacagtgatttccctataccagtgtgtctagtgttaaataattctgcagagtaaggcctgcaagtggagaatgatattagcacttcgctggcttaaaacaacagcaaaaaggcagacaaccagaactgttgtaaagggagcactggaggggctcttgggctcagctgagtttccactmaatttgtaagaagaaaccatattttcagtaaaaatacttgcatattaagtggtcaaatgtgaatttttaacaataaaatattggatggatgtagagtgtattcattatacacaacaatagtggtttatcttaaaagtaatttgaaaatacttagaaacaatttgatacaattgcagcctattcttatttcaaagtaactttaacccttatgtcaaatgactgtattttggttcaaaatcatgtactcataaatcagttgtcatcataataaaaatattttataggatcacttgaacatttcaagaggttcttataacttggaaagagttatttaaactgatttttcaaaataggagcttctaaaggtataaattgattcctggttctcaagctgaccctgtttttagccaacataaatattgataaatcagcatagcatttatatatacttgttcatatagaatatgaaaacgattttaatgtttaaaaggaatctattttcttttagtctctaatatcatataacctgcttcttagagtagaaactggattactgtatagttcagcagtacagaattaagaacaaaataatttactgaaaacaaatatatatttgtgtgtatgcatatatatatacatacacatataagatatatatgtataaatatgtatgtattcatacatatatgagatgtatgtgtaagtatatatagaaaggaacagatatctcaagggaaaattttaaaatgagttaatgaatcaaacattgattctgtttattctgtatatatatatatttttgtttgtttgtttgtttgttttttgagacggagtcttgctatgttgcccaggctggagtgcagtggcatgatctcggctcactgcaagctccgcctcccaggttcacgccattctcctgcctcagcctcctgagtagctgggactacaggtattagtatttttagtagagacggggtttcaccgtgttagccaggatggtctcaatctcctgacctcgtgatctacctgcctcggcctcccaaagtgctgggattacaggcgtgagccaccacgcccggcctattctgtatattttaaaactattcttggatgagaaataacttccacaataatgctaaataatgagcatgcttattttattcctggatttaaaggaaatttctgaagaattttcccataaagaatattgcgtttcgccttaagataggtactttgctattagaaaattgttcttctaatcttattttcaatggttttattaagaatgagtgttaaatgtcatcaaaaactttttgcctcaaattaattgtatgatgcttttgtgggttttcagattagcattttatattaacatgtttctttataacaatcatctttatattccaacttttatcctgtttcttcattgtaaaaggaatactgacgtatttcttgaaaatggtctcctttaaaataatccattgtcatttttttaccctgtttggaagtatggataatgtatttttctatgacatgaaagaatcttaagagaaactactttgatattggtttcttcttatttttacctaagttttaaaatgctttcttcaattatgttcttcataaccaattctaattcatttttatggtgattctgaactcctattatgtatctctgtgtctgtcattttctctcatcatttcttaatttagcttttgtttgttcatctccttcttatccaaatgtttattgtgagtctactacgtgacaaattactaggcaagaaggatgaaggaaagataaatacaataaaatatccactttccagtctctgttaagcatttttactacatgttactctaacctatattcttttctatatcaattcaactatttcatgcttgaagtgctgatttaaatattcagcattatagttcaacctgcgatgttattataatttagcaaccataacatttttaacttcctgagagtcagtactgtaaatttttctaaactttgtatttactttatatgacatatatattatacttgatttccatacttttctgcttctttcatgtcctcttgagaaggagtctgactgcaccagaccatgcctcacttagactgggttagatggcctgccaccctgggcctccctctccagagggtccccattttgagcctttccccaactatgctcctcctcacctaccttctcttctagattatgccttgggtagtcaagattccagaattttctgctcaaatggctctagcttgctttccagggtctgcatggatcatttgcttgggcctgtcctctcaagtagaagccttgctgtcagtgtgtaaatccctgattctgaggggaggccaaggagcgactgcttgtaaggggtgtggacagagcatgtgcagtggaccaggatggccatagaggcatatgcagggctgyttatggcaactaaggaatctggtcattgaaaacccgtgacactcaaagcacttaaagaatgataatttggaacttagctttataatatatctctagaagatatatttgtcaagattagaggataataaatattttacttaatactttgttgccttgatatataaccttgaagtatctaggcatatggtgtgcaaacctccatttgcactcttatcctgagcccggcaaatgttgagggcaagtctgcattgaaatattattctcctttgttttcttgaattattttcataattcattaagaagagtcctgagggatgttgctttgacatctccttcctgttttcttaacatcagagtacgtgctccccgagttttttgttggtatgtcaacttgcttatantntaatttaagggctaattcagacccattcttcaaatgcaggaaaagatcacagttggaggccaactggagatcagatctcatgtgtagtgattccattagagattgtcatcaaaataacttcatcatatttagyatggcttaacaaactaagatgaaataatttttactcctgctttcttattttgaagcataacatagttcaacatcagagggacattaatggaagctcnccacccccttcccacatttgtaaaatgaatcagtgtctttccatcccatattcaacagctaagctatttatgtcccataaactcagggctcattcacttattcagcagctatttcctgagtgtctaccttgtgccagttgctgtgctagtgctgaggatacagccrcgaaacaaacaaactgttaggacatttgggaggaagaatcagataaacatcatatcaacacatcaacaattgccacagtattgggcagggatwaaagtcaccaagaagaatgaaatggtgcgtaaggagacggatcacagtcagggaagtattctttggcaaagcaacagtagagagtgctcctggatgcgtggagggagcaggatatgtggatacctagaaggatattatttagtaagtattagaggaacaccaagaaagtctgagtgactggcacagattatgggagggagaaaatgttaggaaatagaataagaagagggtcagctcatatagatgtagggcattctaggccatggtaaaatgaaaccatggaaagccggggaacagttaagtagtgttgtggcatgtgtttacttatgtttttaaaagatcactctggctgttgcgggatagttgcgtttaggggtcaaaacaaggaaacctgcaaggaggccattactatagtacaagacaagagatastgagatgatggtggttttgactctgttggtagcagaagacgttgtaggagttgaatctgaggtatatttggtctttaggaaatcagaacttaatcctagcttcaaggagtgctggcagaatctgctacaaccttgtattgtttttactctcctgtgatggtgtagctgcttgaggattcttcctgatcaggacctagggcctggtgctacttcttacacccaacttttcagaaatctaaactgaactcttttgttatatttgtgcatcctctgagcactatagaatgatgtctcagtaccttgcatagaagcagagcaagaaaatctctcctgtgttaacaaaccaccaaccacacattcgttctgcctgtaagtgctatattttatatctatttctattgtaatatgccttagatctaattttgaatgtggaacgaatactcatttttaataaaaatgtaatagtacccaaacagggccaaagaaactaaaaatcaggatgttaaatcccataaaatgtttttgactatttctcaattttatggaataacaataagaggaagaattaagaaatctctttgaaatcaataatacctaacagagcaacctttcccgtttggaaatcgcttttctgtatgtgataggggatgtcatccaaaatatcatggagaccattatgtctgcatttgtgtcagtgggtttgcctaatttaggtctcaaatacatggatgccaaacacttagaaagcagctgttcttctaaatgtattaagcaatttactttaggtaatgtagcctataaaattttaattttggattaaataagccatatcctgcagcatgcctactgcaccttgatattcaaaagatgaaatacgggcatatttagtgaatttcttctcaggatgctccactggagaagggtcaatagtttcctaatgaaagtagtcaatagcaattcctcttaggaagctcaaggaaattagcattaaacaacaggcatgggtgtctagggttttacacaattatgtgataggattgttacatgtttcaggaaatggtttcaggaggcattgcactgaagaggcaattgataggaaacagtgcaattgtcctggctctggggctggctgcattacaatgtagaaatcagaaagacacatagcttgaaaatctatactaagaaatgcagaacatggtttttataaataaattgccaaagttagtaagggttattgcattttaatgtcatgatttggaagagaacagatgttttattgggtgaaaatttgagttaaatacccatttgatttccagcttctcaagtgtcctttatgctactgtgaggttttgagctgtgaaaaactatttattgaacaaacacttacgtagccctggtgtttccagtgctttgcacatgttaacttatttaatttacataacaatactttgaagctggcgattcagttatccctgtttctcaagtgaaaaaaacaagacacagagaggttaagtaactcatccaaattcacacaggtactaaatagtgaactcaggcaatgtatgtagatgcaggacttgcctctaaaccatcagattatgctgcatcttcctatcagttttcatcttttccaactctaacctcaatcacatttgataccccccccccacaaaatatactgtgtttttatttctttcttatcatagctgtaggttcagcaaatgttgaagaacagtgacaggtctgccttatgtacagtggggtttgcaacattttaaaaagcagtatggatttttctcatcttttatgtttctttttatttcatgtccgtttttctgtcaagatataacctatggagaaaygttatgaaacagcattacactgaggagactatcacagctaggggaaggctgcctcactgaagtgttactgaaaacagacaggctttcaatccatgttttttggactaaacaatgtttaaagtaactttatcaataaacaactagaagtttctaatttctaagtaattggcattactcttttcttaaataatgtactaaatatgaatagataaataaacctaaaaacttcctaatggccccaggaccctgctatgtattgtgatcactagataaacaacgtcaagacaagcttaaacctatagctttccctctacagaccgcttacttattagaaaaacgaatgaccactttgaactacgtattcttttgaatgacatactcttttgtacaacccagtgattattttattcatataatcattggaaatcatgtagtgcttttcttatgatgctgttgtcttactgtgataaagtataaacctgtacgcggtaattacatggagtcacccacaatgggtggtgcagtttgctgcttttgcaacttcagaagaatgaaaaacacaaatcaagctgccaaatataagtgagcaaaagaaggttaacaaaacaaaacaacaattagctgaaaatgagtacaaataaacctttcttttcatgtaggctctacttttcatgagtgtacccaattttgcttgcaaaagccagtgacaggaaaccaggtcctaaggcccaactgtggccaggaatatgcagccttttcctgctagcatttttcctgctagcatattggtgaatatcagaaatcgcatgtacaggcaatgctgtgacataagcaaaagtaaactttctctctagatgatgctatataatataaatataatatgaccacatatgaaatttaaaattttctagtagctgcattaaaaaaacaaatgaaattaatcttagtaatataattatatagcccaatatatctaaaatatcatttaacatgtattccataataaaatattattaatgagatatattaccttcttttatggcctgagtctttgaaatttaatcatatttacatttaagccacatctcagtttggataagccatctttcaaggctcaatagccacatatggctactggctaatgtgttggagagcgcagctctagaccaagcctttctcattctttaaaagaatttgaaatgtatgctcattagtttttttctacctctaaaactatatcctgtgtattcttgtggacagtgaataaacagatggtaaagttattctgggaacacaatatgatagaataattttggaaacagttttgaaaaaaaaaagggggggctacaaaaagcagttttatccatacttgtcatttcaactcgttttcttcctctgcaatgccgtccttcctatttattcatattttacctaccgctgtagtcgaaactttctttgttgcttaattttatttctatctgtgctatccaatatagcggccccagttacattggaccattgataacggtatcaatggtattgctaatgtgactgagaaatttttaattttattaagtttttgttaatttaaattgaaaactgctactggatgcagttattaagaaactttttagtacacttggaatatttggataggttaatctcctttttttggagatgcgatctcactttgtcgttcagcttggagtgcagtggcgcaagcaatctcggctcactgcaatctctgcctcctgggctcaagccatcctcccacctcagcctcccaagtagctgggactacaggcatgcaccaccacacccagctaatttttatatttttttgtagagttggggtttcattatgtttcccaggctggtctcaaactcctgacctcaagtgatctgcccacctcagcctcccaaagggctggcattacaggtgtgagccaccacacctggccttactttttgaactataaattttatgaaaaccgaattaaagtcaagtatttctggtaaaaatttagcacccaaattgagattgcagaaagtatacataaaaatacacactgggctggtcgcagtggctcatgcctgtaatcccagcactttgggaggccgaggtgggaggatcccttgaggccaggagttaaggaccagtttgatcaacatagtgagactccatctctacaaacaaattcaaaatttagctagatatagtggatgtcgaggatgcagtgagctgtaattgtgccactgcactccagcctgggtggcagagcaagactttgtctcaaaacacagacacacagacacacacacacacatacacacacacacaggattttataaacttggtacaaggaaaaaaatgtaaaatatatcctcaataaaatttaatgttgaatayattttgcaataacaatattttggacattttgggttaaataaaatatatcattaaaattcccttgttactttttacttttttaaagtgatgacttgaaaattttaaattacatatgcgatttgcattatatttgcaatggacagtgctggtttaggtctcacctggactttgagaacatctcaaacacttgatttggagagtaatggccaagaatataatgcattcctaaaacctgtaagtcataactggcttacaggtggcctcttgaaaaagtcacagggtttaatgaagtgcatcataaatatacattagctgtcatcagagacagcctacctttcaatttattgctctttgaaataattttgcctttttttgtttctagaattatttgtttttcttttttcatttatttacatttttaaatgaattgataattcttaccaatgccataatgggatgtgaaatgtagtagtaagcctataatttgtaaagcattttgaaattgattggtttttttttttttcaaaaaagatgttataaaaacatgttattttacttagtttctatagacaggaaaagcacatagacttattagcttattgaatttgcttttctaaatatctcagtattgaattgaactactcatttatgatataatytcatacatcacagatagctagacrgtgttattttagacgtcaaaatgtttttaaatcatgaaaggggtattcatacgctatgctaacaggctgtcagcacaccagagactgatttagactgtgtctgggttactttcatgacctctaatgcatctgtgaaagcatctattcactgcaccatatctgtctttcatcagaatgaatttgtcagccatttctagggaagataatgtaaaataattttccacatgtcttatttgtatttcattgctaacatgatctataatgttcttagatagaagctgatcaattcaaaaagaatttcttaagcacctacaatgggctaagtatggtaggtaatataattgatctccttgaaacaactaaaatttacagagtcactgaaattagcctatgtgaaaagtttaaacatcagagtaaagaaagataagttaatattattaggataaatagtatgttcaaagtttgattatcatcaaggtaacataattaatattcttatagtccagttgtctaggagttaccaataagattttagagaagaggtgatcacatttttagagggtaagtataaaatatttaatatatagaatatttaaaatatttaacatctacattcaaataaagtggcaacaaagcatagtgttaagaaggacaggaaaaggccagtacggtggctcacgcctgtaatcccagcactttgggaggccaaggtgggaggatcacttgagaccaggagtttgaaaccagcctgggcaacatggcgaaacccagtctctaaggaaaaacataaaatacaaaaaaattagctgggcatggtggtgtacgcccataatcccaactacttgtgaggctaaggtgggagaatcacttgagcccagaaagtggaggctgcagtgagccatgatttgccactgcactcctggatttttctttgaaaaaaaaaaaaaaaagaatgggagaagtaagaagactcaaattctaggtctgacgtaccagtgagcagtggtatgatttggggatatgttaagttttttgagcctttatataatatgttaaatggggattaataaactctgccctacctaattgacagggtcttagtgaagatgaaatgatacaggtttgtgaagggttttgctgaacttcaaatgactagtcaaatgcaagacattattataaatgtaacttcctaaattcctgtgatggcttacaatatccctctgctgccagcaagcctgatggcattgcaaattatacttgggcnaaaacagaaaagttttggtataaattgcctcacaaagaaaagttatttttcttttgaaataacagcctcaatgtttagctctgctgttttaatgtgacaaaaattcgcttaacaattaaaaaagaaayaaaaccaaagttaggtttgactggacttaatcagaagacctcttagggttgtcatctggagctayagcctttgaaaatcattttgcacttaggtttgcaactagcaattttatgttgacaaaggtcctaccaataattgcttcttgttacattttacaatcaacttcatgactaggttagtatttgattgttttattcaaatagaagattttggaatgtgaagcaatttctcaaaacatagagccatccwggaaagagattgggattttaattgtgttgccttcattattgttggatgctccaggcagttagagttcctcaagaagtttaggataaaagaatacagtgactcatctcttacagtaaatcttggatgaaatataatttgtaagttgatcagtgttttcaggatcacatattttattttatttactttattttattyttgagatggaggtctcactacattgcccaggcttgtcttgaactgctgggctaaagtgattctcccacctcagactcctgagtagctgggactacaggtgcacaccagtgcactcagcccatcacatgtattttattaatacaaaataatgcttacctcgacttcacttcctaaaacatcataaaattgtacctttctcttttgaaaagtaggtaactccaggccctttgtgacaggaccagatagtgggttggcagtactttgctgtaggatattccactgaaccaaatttaatttctcttcaaatggaagaaaacatagcatattacagcttataattttgatttaaaaaaaaaaaacttctcagaaaattctttagagcagagaaatcctgggggaaaaaatcacatcactttttacatagcagctaaaccctagataaaaaggaaaataacacctggtagatgagtgcctgagctcagatctctagaaatcatcagtcatcccagacaactgggtcttgctattgtacttactttaatgttgtttattctcagtgatttttcatgtgcattgatatttagaacatgtctcattttaactctatgtatgttagaaattgatctgcatttgaaaagataaagatcaattggcacttygacacatttgagcattgaaaagaatattttaaaataggtttgagccattagaaataacattatgaaatataatatttaaacagaattataaaattttcagtaagggtattattgtaatagcaaaatggagtagtacttttagtgatatattttaattttgaaaatatatatttatcttttacattatatattgttatattttttacattatttatatgaaaaatatagaaaataaaatatatattatattaaatttttgtattatatatttttaaatgttatataattttttattgtattatgttgtattgtattttctttatttcttttctttttttttttttttgagacagattcttgttctgttgcccaggctggagtgcagtggcacaatctcagctcactgcaacctccacctcccaggttcaagagattctcttgcctcagcctcctgagtagctgggactacakggacatgccaccatgcccagttaatttcttgtatttttagtagagacagggtttcaccatgttggccagggtagtctcgaactcttgacctcaggtgatccgcctttctcggactcccaaagtgctgggattacaggtgtgagccactgcacccgacctaaatatttattttttacatgtaaataaatatatacttaaatataaatatatctatattagttacattgttttgttttgcttatggtgtcctttcttgataaagaatttgacagtgcttacaaaaatacataaactgcaatgaataagataaatccttgagaaagttagtagggcagaaaaataaggcaatgatgataatgatttgatgacgatgaagtggttgttcagtgtggcatcaatactaagcactgctgtagacacttttgatgtacttactcatgtaatcctcacaataaccttagaaatatcttaggatgaaaaagaaattaaggtacatattccaagtcacagagttaaaaaggcactcatttgaaatctgtcacccggcctttgagcctgggctctgggtcactgagctcccctgccttctccgtaaaaccagcaggtaaaattacatatacattttacagggtgccacacatttggttctaagacttagcagctaaatcaaagctgcaaaagcaatcatagtgtcaataggataaaatatcagtcattttgaagataaagtgaaatgctttacagatttacttgaaactacctccaccaaatattgaatgctgtgtcaaattgtccccatatcaataatgggatatagttcttgaaagcatccacacctcctaacatcaacattttagcagcattttggtgtatcaaaaagaggtttccttttcagtatctccagacacaatgatgtagcttgtgcagttgttggtggagtcacatgttctgtgccaggaaagcagtgttgtattttgccagctcagctacagtcaaacctgtcagccttcagacctttggtatttttgaaatgcagtccaggaagtgctccagaaagtttcacggcatggttgagagtggcagcagaaagtgggaccaggagtcattgagatgggtcattttgaacatgcagtcaagtggcacatcttaatatgttggtaaacacagatgtaaaagtatatcaatatgtcacccccacactttatccaaacactttgcccagtatagttcaaatgaggttttcaattgcttcccccagaagtgtgagattcagcatckacgtatggtaggccaattgccccaagcctagggctgatgctaccttgctgtgcaaggaaagaggtgattaggtctaaatttgactcctggagtgaggcctcagggtggctctccaaggtgtcaaggggtactgtagctgttatttcaccagtgaaaagcggcatctgcatgaaactctcagaggttttttgtttttgtttcttttttgttttgtagctaaacaatgaactaacttggcactgtttcagaaggggcattatatcaaagaacattctttcactctcttttgtgactgacaagagacaagcaaagcctcttttatagagtgcaattaatcactatcaaaacacacagctgttgctttaatttggctactaatttacttatagtttgattttgccacttaaaatgaagtattatcactgaggcaacaatgtgaaagtatgctgttgtaaacgayctctgagtcataaaatctccacttgttttgccaaaaacttaatctgatgttcaatgaatctcccactgcccgaagacctctgtaatcctgggatgcgacattttgtttgcagactcttgatttagtggtgcctctgccaaatgatcactaacaaatgatagcacagccaagtgagatcagtgagatttgtgtctggtttgtgtaatggtaagccggtggtgcagctgtctgccagagactccccctaaaaactcagatatagtgagcaataatcagctcattaaaaaatgaaacagccaagaagaaccgttatggtgattgaaaacacttgctggtgcaagtgtgtccatggcccagtccaccagctggcagaggtgtagctagggtttctgagtgtgtgtaactccagggggtgatgtttacataaactacaatatgaacggcgccccctagagctgtgtaatatgatatccctgcattttgtagtctacactttttaccttttccatggtatcctattattatttaacacatttgtatttccacttgcctataaactcctttataacttgtttcattttcttgatcttcatattcccaggccctagagtgcctatggcatagagaaggggttttcatttaaagttattcaatgaatgaaataaaagtgcaaatatatttttcaaagccaaggattttagcttttgtgttttaacaagtaagaactttccaaaaataccattcatattggtatgtcagctcagttgtcacatgatataacagtgaggaatcctgcgggtgcaagtgaaagaagcccaaatcaagcaggtttaagtcaaaaagataaaaaacacatttattggttcatgtaacagaaaatcccagaattagacccatctggctccatcacagtcaaatccattgctctaaatgatgacctgaccacattcttgctccatctctcagctgtgcctttctttgtgttgctccatgcaacctcgctgtttccatcccacatcaagatggccatgaacagcgtcatactaacagccagtctttcagcaatcattttctccccatcacagcaaaatcccagatttcattgtaattacactgccttgggtcatgtgctcatcctgaaccaataattgtggtcagaggattggaacgctccgatgggcaggaggggaagcgagtgggaaaccgaaccacgtggcctaagagggtggaagaggtttctttttcaaaacaagaagaaatagatgatagaaaaaggaaaaacaagatgttttcctgacatcattcctcatttaacaggtgttgaaactagggctcagagaagacatgtgacttgacaatgtaagtcttctgacactgagtccagtgtgttttttaccttatctttcattaattgttgggctgtttcagtttgtaagtgattagaagtaagatatatatatatataatagataatagataatctgttttttatatatatacgtcacgtagcatggtgctctgagaacactgaagaacaagaaggagtgaatgggttgattgatcattagaatcataagactattttttgagcctttggttcagtatgattcagcttgatttcctaatctgtgaaaaaaggcagtttgatttttttgacagatcatacaagtaggtagaagctttttcggaattactggcagtgatttcaacaaaaaacaatccaatgcaaatggctgtcttatttctctgcactcttgactactgaaatgtttgttttgtttgctttgatttggatgtggttctagttttggtgagagtgaagtggcactttggcctgaaggactgtgtgttttagagagtcacagacattcgatctgcagcccacactcacaggagacactttcataaatgctgcatgattccatgtccacatctgcacagagcagcacatccttggtgatcacattttattttaacttagttttgtttgctttttaattcactttttgtggcagttcatcttgaaggtatgaaaaggataatgatttcacaagaacttgagttgaacgcatgcagaagaagagagagttaaagggactgccctgaaatcaacctgcttatttaagtagatttgaagaaaaacagagtatgaaaacaacaaatcagcctgacttatctaagaagagtggataaaatagtccctgcaggaggaaatgtgtaaccaaatccagtactttatcacatcttcatgaaaccttgaaatagctctatgaatttatattgtttccgaaagacatgtgatccgtgctgtcttatcctgccccactgtgaaccctgaaatcaatccattgctctctcaaactttgggaaaatgatatgctggaaatgtcaatgaactagctgcagtcacagaacgtgtttttactttctgagtttactgaagtggaagacagaaaggatgccttcctaaaaaataaccgcatatactcacagacctatattttctagacatgagtacgtttctattaaaatgcctccttaacatgagaaaaccttgtaattactttctttcacaaatcatttgcctcctttatatttccaaagatggccaattctaatttcttttttggaggtttaataaaacagaggccttggagaaaggaaatggataccgttcaaagaaatccacctcctgaaacacaagaggccagagttagatctttggtgcttccatctttccacaaatcactctcgtctgtttcagcttacattagctcataatcattgttttgtattgtagatattctgaagaagcacactatcaatggataaaatgcaatttaagatttctggctcataaggaacagtgaaaggtggctaaacattacagttgtattgcactacttaacttggaatcctttccctgtatgttttttgcaaattttctgtttgtttatttatttcacaatacttttaacagtgctaatctcttactctgtggagcagttaacaattctccaactggttatacatatcctgtgccattcgtgtcttactgctcctcttcatattgtggacaatgatttgctaagtctttttcctttaacttacagattaccagtaattttaaattcacagataacttttaaaacatttttataaatatattggttaaataaattagaaagtaatgcaaatgaaagaataataagaacatgtcattgtaatctctgaagagaccagtatatatagcatgtataaacgtattgttgaaaaggtaacatctgtatatttctcgtttagacctataactaataaatagatgttggtatctccttgggaaactccacagagtttattattcatcagatggttctctaagtctatgtattgagtatttktcaagcaaaaagggaatgtttgctacttactagctttataaacattgggcaagttaatggacttctctgtgcctgttttttaatcttcagaatggcagtaatgatattacccacggtgctattgtgagaattaaatgagggaaaatatccaagtccttagtaggatacctggcatattgtaagtgcttcttaagtatttgttattctttaaaatatttttttcaatattgttactaaccataatactgttagagaattattttcaaaaccaagctttcacattttgggaggcagtgtcatgtttacagcagtcaggcttaccaagccagaggtacctagattcctttcctagctcttctattaaacagatggatagtcttgggacacactcaaagtttcaaaacccaagttttcatctaggaaaaacacagggagctttaaaaagttgcgtcccagagggtagctgaaaaatgagaaggtaatattattaaataatgtagaaaaatggcttcataaagaaaacttctctcaccttttttttttttagaaacagtataggtagcaattattaaactgagaaaacacttctctagtttaacaaatgatgctgaagcttgtcgttaaatctcatccaattttttttgccctagagctgaacacctttggccaacaaaagaagttacatgcctgattcttaaatttgtaaacaaataaaacattattttctgtttatttgtacaatgtagaagtaggtctaaagtaattggcaacttggcaagtttttattttatctcaacagtgaaaatacttaagccatggcatagccccagacttaatttcttatatcattcaatcttcacttttgtcttctgataaatggatactagctacttaattcttaaatccaatatgatttccaaaacaaacttattgggcatgacttcaactatactggttggttaatcttttacttttgatgtagaatttaattacagacctcaaatataactacctccaaatacaayatgaaatcttaaractttaactgcctttaagcatagccagagtccttggaactttttatttatctgcagacttctacagaataacagtttcatggctgtggaaacatttgtcatatttcaaaatctagtctttatctgtggccctaaagtagatttaggtcttgcaagatttttttatcttataaaaatagctcacttctttcaacttcatgtaaagattgcaggctgggctaaagtgacaaagaatgccttaaggggaactttgaatgaataactttaaaggaaactattttcaccaaagacttgtccagatttaattagttatgagggtcaaagggagggagaaaaggccagaagcctgaagggattgccagagtaaaatgttaaggagaagtgaggactcacgtggagaaggaagtgtagccacttgaagktttaataattttgtgacctggtgtcaagtattgtgatttctaagggcaggagaggtaaaaatgtgaaatattaaccagcactgttcattgctagaggtgactcatacccttaccatcttcttcagtatattgggtatattatccttcaaaataataaattttggaagaatgtcatttgctccatcaaaaaggatgaaataaatgtggtttataatgaacattttctctcaacagagttaacactcttcttgcaaagccacaaaaaaatgaattctatcacatgccacaaggaaactatgattttaaaaaaggacacacatggatctagaattgatctactttaagctaaaggtagaaactgcattaataaggattgtgatgcttttttgtttttgttgtaaaacacctgccaaaattttggtaccatgtaaacattaccaaagccataaatgtgcagtggtgttttttttgttgcttgtttttttgtaaatattgtatgatggtagcttatactaaacatagtaggtcagcagttggcacataattggtttatgatagcaccaagtttgtaagggatggatcaagtgaggcagagtatttatttaaaaagcagtagtcaagacacagaacatgtatagcattatcccatttatctgtttttgaacactgtatgtgattcacacacacacacacattcattctttactgtaaaattttagctactaacatatgttactattagtgttttttgtggttgtcatttttgtttttgtttttgttttgagacagggccctgctctgtcacccaggatggagtacagtggcttgatcatgcttactacagcctcaacctcctgggctcaagtgatcccttcacctcaggcttcccagtagctgagaccacaggcatgcaccaccaaacctggctatttcttcctttttttaattttttgtagagacagaggtcttgctatgttgatcaggctgacctcgaactgctgggctcaagcgatcctctggcctcagcctcccaaastgctgggattacaggcatgagacaacaggcctggacagtattttagttttttaataatagctttttaataaggaacatgtaacagcataaaaaaaatgcaaggccaggtgcaatggtgcacgcctgtaatcccagcactttgggaggctgaggagggtggcttgaggccgagtttgagaccagcctgggcagcatagcaagatcccatctctacaaaaatataatttaaaaaattatctgggtgcagtggcacatgcctgttgtcccagctactcaggaggctgaggtgggagaatcacttgagtccaggagttggaggctgcagtgagctatcattgtgccactgcactacagccttctatgtcacagagtaagaccatgtctttaaataaaaaaaaaaacaaaaaaaaggaaaacaagaaatcagtagtccacaggggtagctcaaaattaagaagagaaaataaacctcagatgaattagaaatgggttggaaatgttgtcacagaccttacaaagtcagaaaatacatagcagagccatgaaattttgatactggcctggaaggtcttccccttaatacctgtgcaatctcagaaaagtcactcagaccagttgcgcccagtttcctcttatataaaacgagacagttttaccaactctaaaattcactgtagatatttacttatgcaacagattacttctctataacctcaagcaatactcactcatgttttcccaccctacagttttgtractgccagttagccagtgagaatggccacaaagaaaggagacatttctctggacctctttctcttgccttgttacccaggcctctctctcacacagtcctgatacacagccatggtggaagcacagactcctagagtgctaagggacttctagactatattcactttctggaaactgccatttgtgtgtatgatgtctttacaacttggatttttgtttatagaatatgaatcaatccatcagctcacttaaacacacttagaaaaggcaaaagatcattatgaatgtggctggaaccaataccaaggcctcgaactcatggttcaatgttcctttcaccacttgctgatgcctcccaagcagtacttgaaaataaacaaattttggtaagtgatatggtaactggaatttctacatagggagatttttaataagcaaattctgaaattttgattataagttatagcctaaattttaatagggagagaactaagataagacaaaaacmattttgtataccataggaaagaatgaggaagaacgaggaatctgttttttttttgttttgtttttttttttttttttttgctacagggtcttcctctgtcacccaggctgaatgaagtgcagtggtgcaatcacagcttactgcagcttctaactcctgggctcaaatgatcctccaacctcagcctcctgagtagctgtaactacaggtgggtgccaccacacccaactaatttttaaattttttgtagatacagggtctctctatgttgcccatgctggtctcaaattcctggactcaaatgatcttcccacctcagtcccccaaactactggaataasaagtgtgcacccaaccagtaataaggagtcttaacaaggcattaacacaaaaactaacgtattgtttattaaaagtagtaaaatgaagagtattgacttttatatttttaaaaattgggggaaacatagttttaggaatctctatgtattcatccatttattcagcaaacctcgtcttttatttatctttggttttgctatgtaccaagagtcccttagcactctaggagtctgtacttccaccatggctgggtactccagattaataaatgaaatgcacagaaacttgttcagataaactctgtttcatgctgggggggtggggcgcagaaaagaacaatgtaatatattactgtgtgataggcacaacrgtgcaatgatgcccattgtgcactggtagcagggggagatggcaacaaccccatgctggaagggcccagaatgacttgctggaggaaataaagcttaaggtgaacttagaagactaggagttcaccaggcacaggagagaaaagacattactggtggagggattaaagagtactagagctcaagtgtatttaggaaaatgagagaagcttgataccaaaatagacattcaacaagaaaataaggcaagtagaatatttttatatgtggatatcttatcttgtggtcatctctaagctaggtcatttacattcccttatttcatgtaacccacacactgtcgccacattgccatatctacagattttatagccacaaaaactgagatttggtgaaatgtcagaagtcacatacctaataagcagcagtactcatatttaaaactaggtctgtggaatctcaaagcctatttttatagcaattacacaattcttaatctatgagaacaaaatctatattctttcctagatacagacagctctgcaatcatttattcaaaaaatacaaattcaactccctgagcataataagcaccaagtatgcaaagatgcataacagccagctagttagctacagagctaattataaaaggtagtgttagaaatagatataagcccctaacaagttgaagatacgggtgggagagagatagaaaatggttctaaactggcacaggtgaagagagtcagagaaaacttcctaaaagaaatgatgctggctgggcatggtgactcacacctgtaatcccagacagcactttgggaagccaaggtggaaggatcacttgatccccggagtttgagaccaccctgggcagcatagcatgaccccatctctacaaaaaaatgtaaacattagccaggcatagtggtgcatgcctgtagttccaagtactcaaataaggctgaggtgggaggatggcttgagcccagacatttgaggttacagtgagccattattgcaccactgcactccagcctgggtgacaggacaagaccctgtctcttaaaaaaaaaaaaaawatatatatatatggaagagttaggtaaaatacgatagaaaagtcattgaagacagaaggtgtagaaactgcgtgttgtgtgcataggatgatacagggtctgtgtttttggaatgtggagggcaaggcagggagtggtgaaagatgaggttggagtggtcagcaagctatggaggccctatagaccatgtgggcaagcttggattcatcttataggaaacgaggagctacaggaatttaaaccacagggggacttagtcagatcttacctttagacagcaggcacacaacancagttatgaagatttgaaaatgtttaggcaaaaaatgatgataatagtggaatccgaaacagaaagaaacagattcaaaaagtatgtaggtcatacaatgagtagaacttygttgtttttatgttggaaatgagggagaggaaagagtcaaagataattcttagatttctagcttggggcaatcctttgattttgaaggttttctgtgctcatgaacttcattaggacttatggacttctgtacttttcatgtgtattattaacaaatcatttcactgaattgaagtaataacttctacattctatagtcactaaaatagttttttaatttttaaagaaaatcttaaattagagtttttaaatggttatttagttaaaatatactttaaaccatatggtcttatcgttggttataactatttttagtgtcacaataattttaatgataaacattgtaccacatcaactaagttttctttttttaaataaaccaaatattcttattttcaatatatttctattttcttttcatagtttgcaatattataaatttaattcttgttttcagtttggtgatgttagtctccttcactatcttagcctaacactctgatataattttccatgcttgtgacttctaaatatttataaaacagttttttctttggaacaaaattggcacagtgttgaaaatttcttgaagatgggttataggtacttgaggttctttaattttgcatatacttaatttttataatattatgaaatatataatgcatgcatatttttgatatagatagatatggttagattatattcaggtaatttaatttataatatataatctatccatggggatgacattaattttcttcatagttcttgaaacaagtcatcacttttagatgtgttcacttaaaatgaaaagttttagaacccgcttaggtgtgtggtagagctgactgcagtaaaaacaattgagacccccaaattgcattaaagcatttttacagttgaagagcaagtaatggttttatctgggaagatcattaatagatttttgaatgaactcaaagtcattaaggaataaggcattaagtgcagaataaataagtgaaagtggaaaaaattttaaaggctatattgatggaaaatagaatcaccaaatttggctttggtggaatggtattaagtgaaatggaaattaaataagctttgggccatgttgtgtggaatgctgaaagtttccagcagaagctgttataattccacattcatttgggaatgctaatgtaatgatgtggcataaatggagttgagagaagaaaatctagagcaaggcaaatcagtattgaggctcttgtaacaattcaaataaaaatgataaggacctcaacttgagtcctggtgatgaaaaggagaataggagttgagggtgagtgaaataatgaagagctrgtatgcactgtaattgtcaatggattaggcctgacagggagaaggaattccaagcttttgaacgatcttgtagtctggattggggagctgtgtcaacaggggaaggtagttttagaaggaagataagttcatctgatgtcaagtgttgaacaaaatggacaaagtttctgatcccataaagcttggagttttattggaagggaaaggaaataaacaactaacttagtaaacaagcaaatttgagaaaatgataggtagtaagaaataatcagatagaaggaaacgttcttggagggagaaatagacttgagatacaatggtcaagaatccctttgtccagggtacatcctgagctgaaacctaaacggcagtgagaagaggaaatatccttcctagagaagygaagggcaagtgtgaataccctagggtggaaatgagtttggtgtgttcaaagatacaaacaccagtctgtctgtctggagcatggccttgaaaatgagacatagaggctggcagcaatcagatcaggggagttcttttcggccttagtaaggagtctgatttcatacttggtcagtgcaaaggcattgaagggttttaagaaacagcagagtggagtggaaggttgtgtatgtgacatgatctgctaactgaagccacagttgggatgagatgccttggggagagactaaaggagaaagcttggtaagtatctgactgtatccaggcagcaaggaagaaagggaaaggtcgaagacataggacaggaagcaatagagtgctaatgaacagtcccccaaagaggaggaagtttgcaaaaggagagagttggtgcagtggggtcaaatgtcagatgaggccgagaggttgaaggggcactgtattcagaggtgtcatcttatttctcattcacaacacgtattagagtcaacttgaattattcagtgaaggaatgtatttagtccaaggctctacacatctcatggtggatggcattagcacttgcatagaagatacatattttttttaatttttaattttttttaaagacacaatctcactctgtcaacccagtaggagttcagtggcatggtcatagctcactgtagtctcaaacccctgggctcaagcaatccttcctcctctgcctcccaaagccccaggattacaggcatgagccactgcacctggccacatagaattttttaaatgtgggaactggatctgtacttacaaacactaaagggacagtttttaaatatgcacatttctgttttattttgtacaaggatttcttccaaagtttcatgattttgattaatagagtaattcctataaasttctgtcatatcttacagaacctctttaagaaccacaatgcaaattaaaaaaaaaaaaagcctaaccctaaagtcaggtttactgcctgaccctgaagtagacattggttatgcagcagtgagtaagataggcactgcccttcaccctctgaacatgccatctcgtggggaagaaaagtgaaccaggaaaacagcaaggagcaaagggagaggttagcaagggctaatgtccaggagtggggaggccttcaggtgaaggggcatttaaactaatatctgagaaatgtgtaagagttatgagaaatggtggggatgacattgcggggaggagaatctgacagtgtctgcctggccaggctctagtccccagttattcaatcaaacaatatctagatgttgctctgagaagcttcagctctgattttaaggcctttcaactgattgaatcagacacatccagattatctagaataagctccctcacttaaggtcactaattgtggtctcaatcacagctacaaaataccttcacagaaacacctaagttgatgtttgattgaataatggggaactctagcctggccaagttgacccatataattgaccatcacagagatttttccagagaagagagcatgtgtcatgcaaatacattgtaataatgaattttcaatctttattagattattctatattataaatcattcttattagttagctagtaaggcttaaccctatgtttaagttgtcctatttgtctgtcaataattattgaatttttacaatattcctatgggtaatctttttttattcttcaaattcctgaggttcacaatactagtacagggtatgtagctctaatcattaatagggagtaaggaaatggtagaactttttttttttgagacggagtcttgctctgttaccaggccagaatgtagtggcacgatctcagctcactacaacctccccctcaagggttcaagtgattctcctgcctcagcctcctgagtagctgagactacaggcatgtgccaccatgcccagctaatttttgtatttttagtagagatggggtttcaccatgtttggccaggatggttttgatctcttgacttcatgatctgcccacttcggcctcccaaagtgctggaattacaggcgtgaaccatcgcgcccagccggaactttttcttaattccctatgtaagaccctccacatattagcaaacgtttctgatatcctaaaattaagcacgttaaagtgaatgtcaagtactaatgagttacaaattagttataaacatgatatttacataactagactaatagaccaatttctatcataaagtcagattatcttaaatttactatcttctatttcatgatttctttttataagtaaaaagatttcattgaaatataaagtgtggcttccactatagtagctaagacagtctcagcaaatagaaagtgatcaaccaatattgatttctaagccaaatttgagaaagctactaaactatgttagtttaaagtcagaggtcacagacatgaggacgttagggcattggaaaatagagaaaaatgagataaaggcaggaagaattaaagaaatgttacacattatacttacaagtaccatggtctataaacacaggttttaatggagacatcaagtgattttttttatagagtcagtatcactgatttgggagggttgaatttaatgaagagacttgtggttattctaagctgaagtaataggttgcatgtgggaatattttatttctctatctcttgatttgaataaaagctcaaaaagcagaaaaaataggaatcactgataatctaggatttgaaaaatctgtttcaaataaaggttaaaatcccccataaagccctccagtccttttccccagaagtaatgaccatcaatgtttgtgtgcatcagcttctaggttttaccttatatttcttgtaatgtgtgtttcatcaaaaaactattggaactaataaacaaattcagtaaagttgcatgatacagggtcaacatacaaaaatcggtagcatttctatatgccaacagcaaacaatctgaaaaagaagtcaagtaaataatcccatttacagtggctacaaataaaataaaatccctaggcattaattaaagaagtgaaatatctctaaaatgaaaactgtaaaacattgacagaagaaattgaagaggacacacaaaaatggaaagatattccatgttcgtgggctggaagaaccaacattgttaaaatgtccatactacccaaagcaatctagattcaatgcaatccttatcaaaatatccatgacattcttcacagaaataaaaaaaaaatgctaaaatttacatggaaccacaacccacccataatagccaaaactctcctgtnnnnnnnnnnnnnnnnnnnnacagacagactggtgtttgtatctttgaacacaccaaactcatttccaccctagggtattcacacttgcccttcacttctctaggaaggatatttcctcttctcactgccgtttaggtttcagctcaggatgtaccctggacaaagggattcttgaccattgtatctcaagtctatttctccctccaagaacgtttccttctatctgattatttcttactacctatcattttctcaaatttgcttgtttactaagttagttgtttatttcctttcccttccaataaaactccaagctttatgggatcagaaactttgtccattttgttcaacacttgacatcagatgaacttatcttccttctaaaactaccttcccctgttgacacagctccccaatccagactacaagatcgttcaaaagcttggaattccttctccctgtcaggcctaatccattgacaattacagtgcataccagctatctaccacattgtgcatatctaccacattttctttatccgttcatctgtggatggacacaggttgctttcaaatcttggcaattgtgactagtgctacaatgaacatgggagtgcaaatatctcttcaatatactgatttcctttcttttgggtatacttagcagtgggattgcttgattgcatggtagttctatttttagttttttggggaacctccaaaccattctccatagtggttgtactaatttacattccccccaacagtgtatgagtgttctcttatctccacatcctttccagcatttgttactgcctgtcttttgaataaaagtcattttaactggctttactggtcattaaatttcattgtaattttgatttgcatttctataatgatcaatgatgttgagcacctttgcatatacctgcttgccgtttgtgtgtcttcttttgaaaaatgtcttttcaaatcttttgctgattatttaattagattattagattttttcctgtacagtttgagctmcctatctcttctagttactaatctcttgtcagatgggtagtgtgcaaatgttttctatcattctgtaggttgtctcttcactttgctgattgtttcctttgctgtgcagaagcttttcaacctgatgtgaacccatttgtccatttttgctttggttgcctgtgcttgtaaggtattattcaagaaatctttgcccagcccaatgtcctgcagagtttccccaatctttatttttagtggttccatggtttraggtcttagattcaattctttactccattttttattcaatttctgtatatggtgagagataggggtctagtttccttcttctgcctacggatacccagttttctcagcatcatttatttaagagactgtcctttttccagtgtatatgtctggcacccttggcaaaaatgaattcactgtaggtgtatgaatttgtttctgggtttgttattctgttccatgagtctgtgtgtctgtttttatgtcagtaccatgctgttttggttactatagctctatagtataatttgaaatcaggtaatgtgattccttcagttttgttctttttgctcaagagagttttggctattctgggtgtgttgtggttccatgtaaattttagcattttttttctatttctgtgaagaatgtcattgatattttgataaggattgcattgaatctagattgctttgggtagtatggacattttaacaatgttggttcttccagcccacgaacatggaatatctttccatttttgtgtgtcctcttcaatttcttctgtcaatgttttacagttttcattttagagatatttcacttctttaattaatgcctagggattttattttatttgtagccactgtaaatgggattatttacttgatttctttttcagattgtttgctgttggcatatagaaatgctaccgatttttgtatgttgaccctgtatcctgcaactttactgaatttgtttattagttccaatagttttttgatgaagtctaggtttttccaactatatgatcatctcatctgcaaacaaggataatttgacttctttctttccagtttagatgccctttattttttttctcttgtctgattgctctagctaggacttctagtactatgttgactaacagtgatgaaagtgggcatccttgttgttttctatatcttagagaaaaagctttcagatttgtcccatttagtatgrtaccagttgtgggtttgttgtatattacttttagtgtggtgaggtatatttcctctatactcagtttgttttagtmtttctatcatgaaaggatgttgaattttatcaaatgggttttcatcgtcatatgttgttkattttcattctctcaataggatgtatcacactgatttgtgtatgttgaactatccttgaatgcctgggataaatcccactgggcaatgatgaattatctttttaatgtgttgttaaattcagtttgctactagtttgttgatgatttttgtgccaatgttcaatatcagggatactgacctgtagtttgatttcttccgtatgtccttctggtttgggtataagggtaatactcacctgatagaatgagttttgaagtattccctgctccttcatttttttgaaatagtttgagaggattggtattagttcttctttaaatgtttggtagaaatcagctgtgaagccattgggtcctggcttttctttgctgggagactttttattacttctgtgatccccttacttgttaatggtctgttcgagtcttggatttcttcatgtttcaatcttggtaggatgtatgtgtctagaaatttatccatttcttctccattttccaatttattagaatatagttgctcacagtagactccaatgatcctttgaatttctatagtatcaggtgtaatgtctcctttttcaaaaaacttttgaaaatgaaaccaacttttgtttcattgatcttttttattgttttcttcatytcaatatcctttatttctgctccgatctttattatttcttttcttctactacttttgggtttagtttgctatagcttctccagtttattaagatgaatgtttaggttgtttgtttgaagtttttctacttttcagatgtaggcacttaaagctataatttcctcttagtactgcttttgccatatcccataggttttggtatgttgtgtttccattatcatttgtttcaataaatttttaaatttactttttaatttcttcattgacccactggttgttcaggagcatattgtttaatttccatgtgtttgtacagtttccaagattcctcttgttatttatttctaggctattccattatagtcagagaagatacttgatataatttcaattttttaattttttaagacttattttgtggcataacacatggtctatccttgagaatgatctatgtgctgaagagaagaatgtgcattctgtaactgctgagtgaaattttctgtagatatctatcaggtccatttggtccatagtttagattaagtctgatgtttctttgttggttttccatctggatgatctgtgcaatattgaaagtagggtgttgcagtttccagctttaactgtattgaggtctatctctctctttagctctaatatttgatttatatattatatttgggtgctccagtgttggatgmatatatatttacaattgttatgccctcttgctgaattgacccgtttatcattttataatgaccttctttctctctctctttatatagtttttgtattgaaaaatctattttgtacagttattcctgctcttttttggtttccatttgcatggaatatctttatctgttcctttattttcagtctatgtgttcctttataggtgaaatgtgtttcttgtaggcaacagatcattgggtcttattttttttgttttgttttataatccattcagttactctgtgtcttttgattggtttaatcaattcatagtcaatattattattcacaaataaggacttattcctgacattttgtgatttgttttctgtttgttttgcagtcatcttctcttccttctttccattctccctgtcttccttttagtgaaggttttttcctcagttggcattyttaaatttctttgttttttattttattttgtgtatgttttctgatttgaggttatcatgaggcttgtaaatgatatcttgtcatccattattttaaacagatgacaacttaacactgacttgtataaacaagcaaacagaaaactaataaaaactctacactttaactttgtcccctgactttttaactttttgttgtttctatttattctttattgtactgtctatgtcttgaaaagttattgttattatttttgatcagttcaccttttggtctttctactcaaaatatgagtagattacataccagaattataacgttataatattgtgtgtttttcgtatacttgctattaccagtcagttttgcaccttcagataatttcttattgctcattaacattttctttccaattgaagaactcctttttgcatctcatgtagggcaggtctggtgttgataaaatctctaagcttttgtttgtctggaaagtctttatttctcctttatgtttgaagtatattttctcttgatatactattctaggaaaagaagattttttttccttcagcactttaaatatggcaggccactctatcctggcctgtaaagtttccactgagaagtctgctgccaggtgtactggagctccaytktatgttgtttttttctcttgctgygtttaggatcctttttttatccttgagtctttgggagtttgattattaaatgtcttgaagtagtcttatttgggttaaacctgcttgatgttttgtagccttcttgtgcttgaatgttgatatctttctctaggtgtaggamgttctctgttattatccctttgaataaactttctacctttatatctctctctacctcctctttaaggccaataactcttagatttgtccctttgaggctatttgctagttgtggtagatgtgcttcatttttttctcattcttttctaatttgtctcttctgactgtgtactttcaaataacccgacttcaagcttactagttctttcttctgcttcattaattctgcttttaagagactcttgatgtactcttcagtatgtctgttgcatctttcagctccagaatttctgcttgcttttaattatttccatttctctgctaaatgtatctgatataattctgaattccttctctatgttatcttagatttcattgaacttcctcaaagcagttattttgaattctctgaaaggtcatatatctctctctctccagcattggccagtggtgtcttatttaattttctcggcatggtcatgttttcttggatggccttgatacttgtggatgtttattggtgtctgtgcattgaagagttgtaatctaagtttttggtcactccagctaygtgtgcattaggtggcatcccaagcccagtaacactatgacttttgcagactcatagaggtcttgtggtcttggataagatctggaagacttctctggattactaggcagagaattttggtctcttcccttactttctcccaaacaaacaagcagagtctccttctctgtctactgagctgcctagagcttgaagaggggtgacataagcatccctgtctctacccaacactgggacaatgctgggtcagacctgaatccagcacagtactgagtctcacccaaggcccatggtagccactgcctggctatcatctatgttctctcaaggccctagggctctggcagcaaaactagccaggcctttgttcttccctccagagaagcaagttgcccccagccctgtgyggatccagaggtaacatctaggagccaaggcctggagtcagaaaccttaagaatctacctggaactctattctactgtggctaaactggcacccatgccacaagacaaagtttctcccrctcttccctctcctttccaccatcagaggagtctttttccatggccactgccactgccaccccaggcccacagcaagtactgcttgactaccaccaatgttcacttaaggcccaagggctcttcagtcagcttgtggtgactcttccttcagggcagtgggcccccctttggcccagggcagtttcagaaatgccatccaagagccaaggcctggaattgggaacctcaagggattcatgtggtgctctgtcccactgtggctgagttggtacttaaggtgcaagacaaactcccttttactcttccctccctttttctcaagcagaaggagcctcatcccagtccattctcactacagctgggaatgtgctcagtctgaagccatatgaagccagcacgtctctgagtctcaccccagaaccacagcatgtaccgcctggatattgctgctgattattcagggcctaagttctctttactcagcaggtgattaattctgccaggacttggtccttcccttcaaggtagtagttttgcttctggcccaaagcggctctagaaatgtagcctgggaactatggcctagaatatgggcctcaggactgcccagtaccctatcctaccgtggctgagctggtagctaagtggcaaaagaaagtcttctttactcttccctctcctctcctcaagcagagggaaggaatgtctcctataagctgtcagccatgctgcccatggttaggggaggggtggcacaagcactcccttagccagcctggctggtatctcactaggtagcatgttccccaagtccagtggttccgagcctggcatagaaccattatttgcccaagaattgtagtctttgtggcctagactgcctttcaagtttatttaggaccttacagcccttagcccatggtggcaaggcttaatagaacgcaggttctgacggtaaggatgggtgagtcccctctggctagggcagtataaatgctccctctgtgggccccagctgaattctgccccattttggtttctgctgtgacagggtagcactctgttccaatgcaaagtcgcacaatcactgccctcttcctcccccaaggacacagattctctctccacacctcacagctactgctgggagttgggagagtggtgacattaacaattcaagactgtctttcctacattcttcagtgcatttttcagtgatatgaagttaaaaccaggtactgtgatcactcacctgagttttggttctcatgaaggtgctttatggtgtatatagtcaatttgatgttcctgcagggaggacaatcagtgaaggcttccatttggctatcttgctctgcttcctcccctcccttcctccctctctccctccctcctttctttctttttcttttttcttttctttttttctttctttctttctttctttctccctctttcttctttctttctttctctctctttcttctttctttctctctttcttattaaaaaaatggtataattctacacaaactggccaaaaacttgttttatttgctygcccttctaggtcaataygtacaaatcyactttcttatttctattggccagccagtgtacttttgcttggatgtttcagaaattatttaaccattcctcagttggtggtcagttgttctcagtcttattcaaataagtaattccagctgccttttgttgtaatatatcatgtattctttagacaaataatgctgcagtggacatcttcgtacatatgtatttacactttcatgtcattctgtctgtaatatggattccaacaagtgggatagcttatttggagatatgcagagatgtaatttttacttatattgtcaaattctatcttctgtgatacccatttacactccagccatatatgcaattgcacatttcttcacctcctcatcagtcattgagtattttttagctaatytggtaagcaaaaattttcttttgcaaaaaacatcacattrcatttattaaattatttgcaaaagggggtaaatgtgtttgtgtgaaaatgtcttctaagaatacactgtagactacatggcagaggtagagatgataggctggaaaacacttaggaggatagattaattaataaaagtcagagttcatgaaggcttaagcgggcagaaratggtgcccccttttcagagttaagtggatatcaactagcatattagctgtatattattaataatgtatgggcatgatttggcaagtatttctttaaaagcaaaaaaaagtttgttttgaagttagaaatcattcagtacttccaagttgtgcaatacatttaaggcattatgtagtcaacgacttgaatttaaatgatgaatccattaatatattgcttgaaatatagaccatagtctttgtcttcctgaggatattttaatcaaaatattaaaaataagctggagtctcattcaactagttaattccagctgccttttgctgtaatatatcatgaattatctctctgatggatgggtagccaaatgcagataacattagctttgcagtcattcattttaaattgctcttgaatcacttggaagtaaattccatttcagaggagtatgcttcaagtctcagacaaagagataatggtcctatattttatgatatragcaataatagtttaagtcttatgattcagaaatatagaaacttatgtattaagttgatgaaaattaaggcttgatatwtagcaataaaatcagcaacctaaagctccctagattgatgttcatagcataatatattcctgtgaagaattaggtggaatgaaagtctataaaaataatacatggtgaaaagctttctcttcttgggtataaatgaaacagcaaaagcctatgtgagataacagaaaaaaggaaatactgagatttattgatatcaagataaaaatggtactactgttggaatgtcagtattgagtaatagtagaaagtggaaaattaagtcaaatatcagaggagggtaaaatgaataatagcgttacatctaaatcaaaaatgcrttaagttaayactgaattcaatgtacagaacaaaagcaactctggaaattttaccttgttaatttgaatgaactacatgtacaaaacgtgtttcacaatttaattaatcaagtcattttgcccagatagcacaatgcagtcaataccagcagctggggtgtgcatttatagaaaaggtaataatttgggrtacctgtggcatgttgccagaaataagttcacagtctgaagttgctgttcacaaactgaattcytattatcaccctaatgtcactccttcagatatttatattaaaaaataaagtggtaagaggatgtactcactgatgtccttgaagaaaaaaaaatcaatttttttatagctccaagttttgcagcatgaccttawgctbtttttttcattttgttttgtggggtttttttgtagtatggtaatattaattgaattgaaggtactgatctcagtaaacagtctaccacttcagggtggaatcacagattttcttatccccatgggttcagcagtcctttaatgccctgaaaaagtaaaaattttagcatggcagggattttacttattttggaacagaggacctttgatgggcactagggaacatccaaaggaaggccacagacacataaagtcacacaccttcccttgcacaccattkcaaatacgcttgcttagagaattgatatgagcctgagtttctcagtctgaacaattgtgttttcctttagaaaatagctaattaccacaagaagctggaaaacaaactaagttccaaaatgaatatccagtaataaagatgcaatttcatttttcagactttccatgaagtgagatgctcatttacctgacatttgtagacagggctggtttcacgggtatgtgacctctgctgtcacacaggaccagtgtttggtttaatgttctgctgtcacaatctcagaattcttaataaatttttaatcagggatcttgaacttycattctacaccgggccacacaaattttgtagccagtcctgtttgtagatatttctattgttaaaacatcttataattgtaaatgaatctgaggcactataaactctaaaattccttgtgaatctcttaggaatgatcaaagttgccattagtataatattcatgcatttgtaagatttttattgaccccatataatgtgctagacttagggaaaatgaaaatgaaatcaatatagtccctgctttcaaagagtttcatctctagtgttaagcatttattgtatatttcaagttttttgaaaattggtaatagtcttataaaaccaattgcaaaactgaaaagtagattcctccacttgtatgactggcaaatgcattacacagaggagctaaatattcatgtaggataaatagtatttgtagctgatcactttatctttaaatacatgtagctatagtcatgctggatgtttaaattaaagttttcatctattatttyagttgaagagaattggcttgcttgtttcattttcaaaactttctctagaatagaaaaaagttaggatacagtttcgtaaaaagatgatttctaaaataacactgtatctgagaattaatgctgaaacttgacagttttctatggagcaagaatcagaaagtgtncttttagtatgttaacttgatggtgggaccaacttcgatggttgagtaaggtacccagctcatttttgtatgtggagaaggcaaggatttcacaacaggggtgagcccactgataatcagcttatttgcattttatcatatctgtcccactgtacatatctactaaatcaagttcttgaattttctatattaatatcattctcaacaactgagttgagtaatagaagtgatatgccatattgcctataacaggaattcatccagggcataggcttgactttactttgtgaatattataggaaatcttaataaactamtatgctgtggttggctaaggcatctctctagataaacttttaaygattgattctgcagaaactataatgatatgcaaagaaaaactggatttattaaattaaaacatttctaatgatagaaatcttccttaataagttgcattttcaagtgttaacaaacatcttgaaaaatcaataactgtgtgaaacctcaaaccaagatataggttcatctctctttacttgtggtgatcatgttgtcttaaaagtcaaaattaaggaaatacaaagttagtttgcccatacattttctaaatatattgttaaattatcacttttttcccagcatttaacagagctgcttttgacttgaaaatgtgtgacttttttgcttccatttgtcttttcagtagtttacaataaaataatcagaagaaagagatacatgctttggcaaggcagagtaatcaatttttagtgcctatgaagtttttctatagcatgtgaacatttaaatacttttgctatattattgaataaggtaaggtagtatacaatcatctgtatcttgcaatcattccttttcaagttttaccttctgaaacaatggctgaaagatttattatactttgcatgcttaaataaatagttattaaatacagtcacatgttttatgtgtacaaacatagttaaaaaataaagtctagttgaccttccaccttcataaatagtaataattaaaaccaacagctaacttctrtagaatttgagtcatgttttgcggagctttattgattatcagcactgtccatcatcacatataacagtaagtgctttagaagaaaaaaaattggttaagaccttcaagacatcagtttcatgctgatggatttgtcaatagttcagttcctcatccctttgcctttctgagctatgtttatttaagcagtcttgaatgttcttgcatattgactaaaggagctkcaattgatggaaacaaggttattctttagtaagctgacaattttggtccttgatgttcaacaatggaaaaactagaaatgatgccctgccaaaagaaagcaaattaaggaggtaaagtgagaagaaatatctaggtataggaaacaacatttacatttcagtgtcaaaaatttactactgtgggcagcttggaatgctagttttgtcagtgatgcaagtgaagtcaatttttactgcaaaacagagtagcagagaccggacatcattactatttgacagctatcttatgacttgaatgaaaaaagttccaagccagttttcttagtggacagatgtccactataccaatggctatcttccaacacagggcaacaactgaaggagaaataaaatgactttcaagacaatatgtgagcaaccagcctttaagtaccaataccatgctctatatttactactgaatatacgtacatttaaagaacttgtaaaaaaattttaattttgacatcagagttttcaattaygtatttgtaaccagtttggggaattagtaatagctctgttctcctctgtcccaattggaagattattattaggctgaacttatttatggtgtgttggaaagactgtttttaccttgacttttgtaaaacacaataataggttttattataaaaagcacatttattattaattttttattttgaatcatgcagaatccaggtttaaaatgtatctcaaagtgtgcaaattatctaaagtggtttttaaattttgggttgaatgaatatttcacacaatgacatcttttgaaaataacaacagatttgaattggaacgtaaatatccttaattaaagtttctaatatttctgctcggctccttgcaaagtgtgtaagctttatctatgagccttatgattttcaaatacatgtttctaatgaagttgctcttgcttttgtctgctctcaagggtgacactctataatgggaaatgtagtgatacattgggaagatcatggtttttaattgagatacacatgaattccagtttcagctctgctwtttactacctatgtgctcagggcaacttacttatcctccctgatgttgagttttgctgtgtatagaaatgggaataataatccatatccttaaatgaccagtcaatagatctaacatacagcctggcacacagcaggcattcaaatcacttaattactgcatttataagtcactatttttacatgactagcaagtagaaggcaagttgttacaatgtgttaaccatcttccactttcttcttctttctcagatgatgacttttttcatgaactcccagaaacttttccttctgatccacctgagcctctgccacatttccttattgagcctgaagaagcttatattgtgaagaataagccngtgaacctgtactgtaaagcaagccctgccacccagatctatttcaagtgtaatagygaatgggttcatcagaaggaccacatagtagatgaaagagtagatgaaacttccggtgagttttccattgcatttgcattgcacttcaagattcacttactcactactctagcatgtggacatactgttatttcaattagtggaatggaaaatggagttattctctgacaaaaagttttgaattggtttggttaargtttggtgatcttgtttcatgtgttgaaaagtaaaatggtgtgaataaatcttgacttgcttcctgttggactacatgaaattaaaacatggttcatacttaagaagataaataatgcgaatgaatagactgacaatgttaaatgcccaagcaaataataatattcttgaattgcacctgcgtggtagtcagatctaaatatcccgagatctggkgagcatttttaacttggataaattgaangtgtttacattaatgtctaatgttaatccatgtgcatagtttgcccttatatttgttaaggatttgtaaatgtcatagattcaaagtatcttatactcataacttacatccaaagtgaatcctaacttcctaactcttatctaaaattaaattgagggtgattcagaacagtgatagtgtaggattcatgaacagaagaaatggtaattgtagccctttctcagagggtcttgatctgattatctttgcccctggcttggttaaaactcctgactttgctgctctgtaaataccatccttaaagataaaatactaaaggcaaagaaaggatggagtagattctaataacctgtgggatttcaattagatataaaggatagcaattttctgctacacaatggataaattagggtagttgtggaatctcctggagttcttttaaattggaaacatatatatctttccatggtagcatacgtgtttttgctctccagcagacagaataactctttgaactttcagatctcttccagacttatgattttgtaatgttgacatatatttaastattaatactttattattcaacattttcaagccaaagawtatcaagcatgacaaaaattgaagcatttaaatatcttttttacccttamtagatatctctctgaaccaaaatggatacacatgttcaaaatccaaattgtaaataattcatatttgttcccaaatgttggattaaccagagacaagtagagaccagcacttgagggctctactttctactttcaagatctccgacaagataaatagcatattgatgtgacagaacataaagaaatagaacagactatgagaggactgagaagaggcaactttttaaaaagcatgtaggacatattctttataacataaatggtctttggaaaatcaggtggcaactctacataattgcttgtcaatttgtgaatcaatatgctcactgaatgcaagctgatgactgcagatataactgggtatccaattatagggtagcttacttcagggaattgtcccacctcttggtctaattactcagaaaataactcyaccagatgtcttcaaaatctcaagtggattgagttttatttgtttcagctcatgtatttgtatagatttcaaacaaataagctttaatgataaaaggaaagagaaataacaaaaactcaaatacgttacaacatattcaggcttatctttactaaaataatgacatgcctatataggaagattataaatagaaacaaaactattctttttttattattatactttaagttttagggtacatgtgcacaatgtgcaggttagttacatatgtatacatgtgccatgttggtgtgctgcacccattaactggtcatttagaattaggtatatctcctaatgctatccctcgcccctccccccaccccacaatagtccgcagagtgtgatgttccccttcctgtgtccatgtgttctcattgttcaattcccacctatgagtgagaacatgtggtgtttggttttttgtccttgtgatagtttactgagaatgatgatttccaatttcatccatgtccctacaaatgacatgaactcatcattttttatgactgcatagtattccatggtgtatatatgccacattttcttaatccaatctatcgttgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttccagttctagatccctgaggaatcgccacactgacttccgcaatggttgaactagtttacagtcccacaaacagtgtaaaagtgttcctatttctccacatcctctctagcacctactgcttcctgactttttaatgattgccattctaactggtgtgggatggtatctcattgtggttttgatttgcatttctctgatggccagtgatggtgagccttttytcgtgtgttttttggctacataaatgtcttcttttgagaggtgtctgttcatgtcctttgcccactttttgatggggttgtttgtttttttcttgtaaatttgtttgagttcattgagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatgcttttaggtctaacgtttaagtctttaatccatcttgaatgaatttttgtataaggtgtaaggaagggatccagtttcagctttctacatatggctagccagttctcccagcaccacgtattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgcagtatagtttgaagtcaggtagtgtgatgcctccagctttgttcttttggcttaggattgacttggcgatgcgggctcttttttggttcaatatgaactttaaagtagttttttccaattctgtgaagaaagtcattggtagcttgatggggatggcactgaatctataaattaccttgggcagtatggccattttcatgatattgattcttcctacccatgagcatggaatgttgttccctttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttgttggtgtataagaatgcctgtgatttttgtacattgattttgtatcctgagactttgagaaatgaaactattctaatatcgaacgcttataacaatttcatgctatgttggtaacacacccacacacacatatacacatatattgagagagatttcttctctgtgaaatctttattttttataattgtacataaaaattaattaatattacatacatcaatgawtaagactaccttataaattaactgtaaactaaaatagtttgcatgttttcatttaaattcaggagagatagatgagaactaagagaagatttaggaaattcagtactttctcagttcycctgagattcaggaatggagtaatatacaacatagctttattaggagctttcattttcatccagaactttacagaaaaggccagcatccagccaaaggctgacatactagactcatgtaggtattacctttaaagttttgaaaaacttggtgggaatgtacattagtacaacctctatagaaaacagtatggagatttctcagagaactaaaaatagaacaccatttaatccagcaataccactacttggcatctacccaaaggaaaagaaatcattacatcaaaaagatacctgcactcayatgtttttcatagctctattcacaatagcaaagatagggaatcaacccaagtrcccatcagtggataatcagataaggaaaatgtgatatatacaaacaatagaatactattcatccataaaaaagactgaaaccatgtcttttgcagcaacatggatggaactggaagccattatcttaagtgaagtaactcagacccagaaatatattaataaatgccacatattctcacttgtgagagctaaataatgtgtacatgtggatgttgagtgtgaaatgatagacaacagagactcagaaggatgcaggtgggtgaggggggttggtaatgagaaattacttaataggtacagtgtatgttattcaggtgatggataccccaaaagccctgactttaccactatacaatctattcatgcaacaaattatacttatatcccataaattactacaaataaaaagaatgaagttaggaaaaaggcaaagatgcccacagataccattattaattggtattattctaatctactagccagtgccattagacaacacaagtaatgaagaggtacaaaaatagtgaagaaagtagaaaattatcatttatgacaaattatgtgattttttactcctggaaaatgtatgcattttaaaagaaaaaaaatctttaaatgaagagaatagagaaaataggtgataaaaaatttgtatcaccaaccaactttcctatgtacagacagccaattcaaattaaaatgcagtaaaagatgtcatttagaatagctatgtaaaagaaaacatgtaggtatatacttatcaaaaattttgcagaattttataaaggaaatttaaaaatcctacttagaggcaaaaaagatatcatgacttacattaaggaaagacatattcttgaatggaaaggtcgaatatgtttaaatgtctaatgcttataaatgaatctgtaatgtcaccatcattttattaaaaataatttgggaaaatagctgagataattcttaaatagtagagtaatgaggaaaacccaactcattataaatataatgctaaagaagttaaaagagtttgatcttagcagaggacaaaacgtacagattaatagattaaaatagagatcaagaaacactaaaagacctaaggcatttgtacctattacattacctagaatgtaataaagatcagtttttcaaccagtgaggaaaatagtttattcaatacatgaattgatataacaagataggaagttggaaatagaaaaataataaagaaaacttgaatctatctcattctttagaataaaataaatgctagatgttggggcttaaaatcatcatcatcatcgccaccatcaccatcatcattagtagaaaatttggcagttggttggttggtttcagtgrtgggcatagtcttttaaattaagacacacaatctataagtcttacaggaaggcattattaaatttgaatatccaaagcaagaaaaccacaaacaaaaccaagagacagatttaaaaactagttatagtatctgtggctatatattagccaaagggctaattttataaatacataaatatctcctaaactatatttaaggaaaagatcagcaaccgaatagaaaatcgagcagagttgttgatataacaagatacaggaacagcaatgtaaatggtaattaagtatctaaggagatgtcatcaggatccaaacatttgttaatatgtagtgttgattaaaggcataatttcttgatgggtgtttaaattgatacaatctttttgaaggcccatttgaaaataccatcaatattgaaaggtatatagatttcactgattagttacaaacctaggaactatctgaaaatataattccwaatgtgcacaaagcttgtccattgaascttcattgctgttgcatagcagggactgtttatccctactgtgatacttttaaatttattttttatttttctggaaacagtgtcttcctctgtcttccaggctggaatgcagtggcatgatcatagctcactgcaagcttcaaactcctgggctcaagtgatcctcccacctcagcctcccaaatagctacaactacaggcacaccaccatgcctgactaatttttcattttttgtagagatggggtcttgctatgttgcccaggctggtctccaaactcctgtgctcaagtgatcctgctgccttagcctcccaatgcactggtgagacaggagagttccctccaccccttctgggacatggaacaggggtatggctcatttactctttaagcyacactcaaacagctttcgagagggggagcatgcaggtgagggggtgcaggagctggggcgagtgcctttgggctccagcaggaaggaaccctttaccagcctgcagcagtgagtagaagttgcctaaaattttcttttttggttgtgtctctgcccggctttggtatcataaatcaaaaccactatgagatatcatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccatccyattactgggtatatacccaaaggactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagtcataaaaaatgatgagttcatgtcctttgtagggacatggatgaaattggaaaccatcattctcagtaaactatcgcaagagcaaaaaaccaaacaccgcatattctcacgcataggtgggaattgaacaatgagatcacatggacacaggaaggggaatatcacactctggggactgtggtggggtcgggggaggggggagggatagcattgggagatatacctaatgctagatgacacgttagtgggtgcagtgcaccagcatggcacatgtatacatatgtaactaacctgcacaatgtgcacatgtaccctaaaacttaaagtataataaaaaaaaaaaaaaattaaaaaaaaaaaaaaaaaaaaaaagaagttgcctgtgacagagctctggagccccagagggcacatgttataaacaatgctattttagctttgcctccacggatggcttaaatgttaacagctccgtgaagagtcagtgtgacagcctttttgggttcctgcacccagtgtgtcctgaattctttttcatcattaaggaagaatcaggtcacaggaacagtttatgaatgtagaggattttattaagtggcagaagtggctctcagcagaaggggagctggaaggaggatggtatgggaagaaggtgatctttctgtgaagcccggccatctgcggccaggctcctctccaaagtcatgcagtcagaagttatactgccccatatcactggggctacaggggaagaggccctaatacattttaaaacaatgaggttgctccagatatgaagctatagaaaactctctgagataaaatttagaatgaaagccaaagtagagaacactgtgtgtgatatgcttccatgtataaagaaagaggatgcatgtatatttgtatgtgcattggaatttttctggagaaacatataacaagcagttgacagctcagagtctggggtgataaagggacttttattgtttgagtttttttcaatcctgtgaatgtgttattttcataataaataatgaaacctgaaaaaaagcccataccactttattgcctctctttgcctgctatcataaatccccaatatggacaaatattggtggagaaatttgtaggctttttacgttaaagctttttgctttcctgtgagatcagaaatattgtgaatgcaattgaaataaaggcatttgtttttttaggggtggaggttggggggttttccctgaagctagatccaccctgcaactttggttctcaactggagtctgactgtagtattgttggggacttagtggttcttaatagcaagaaatgttagaatacattaagtcttgaaacgtatttcaaatcaggtaaattttcttagtatttgaaaaaatcaaacctggttatcctatgataagacagagaaaagacattgcaaacaagttgcttttatacatacctctgacttataatcatatttagaaggatatttagtgacaagctacattaccttgagactaagaaaaattgactacattcaataaaatatctatcaaaggtaacttcatattaaaaacctgcaagacaataaaacttaaacaaaaatttattctccaactcataaaattttattttaaattatgaaatcattaaataggaagcaaataattatttctactcactgagtatatctatccattgatcataacaaaatatactgattgaagatcattcattaccattactctttgcctttccatcatttaaaccacagttgcatttcttacatgtatgcaatataagaaacagaaaagtggaaagcagcttataataaatgattcagaaattttcaatatttgaaagttcttgatttggtaatatagtaatacatacctatgttgccttcaaaattccatagaaatcatgatctactcaatattttgtggttacatttttaagaagaactcaggctcagctgtttgctttctatttacttgaagccttttcaactcttgtttccatggtacctaagatctaccatctaaaagcaaatatttttttctctgtgaagaagcaaaggagattagaaaaccatggttatgttgaaattgtaataatccctgagattttcctttttcatctttaattattctcaagttagcagaaaatatcaataaggtcaacacaacaaaaataaaagttccaggccttatactgagcaccttacatgtattctgttctttagtcatcacaagtgtcttatgagataatttctaagattctcctttggtaaattaggaatctgaggctctgcaggatgaagaaacaaacttgcctcaaatcacttaatgaggaagtgacacagccaggatatgaacccagagctctctgcttccaaaacctttgctcttggccctgcgcctggtgtctccctaaattttaccataactactgaacacagaacagttagtctaaaaaagagctatgcaatacaattatttgttttcccaggaagagaagggctgcttcagagtgtcagctgtatgtgcatttttcatgttttatttgccttccttgccttgtgtcaggttttccacakgcagacctttgtgattctttaacataataacataagctagtgcttagggtctggttttccattcttgaaggcctttgmtctttggccaattagcaaacagtcagccttaatggaaaaaaggaattgatgaagagaagctataattgggcataaatttaagtgaattgcttctaatcaaaacctagacttaggtatactgtgcttactcaagtccccatttgttgcaggagtgggaacactgaaaatcttcctccttttgtattcctgtttcagatacctcttctctccatccaggcaccaaaaattaaaatctcagcttcatccttcactccaacaagcaaaatgatcatcaagtcttgccaatttattttcaaattatccttctgttttaagtcttgcttatactccccttctactctttaatatatagctctttgattatctaaatagccacctacatcttctttattttggcctttttctttttccagcagtttattctccaagtagttataggcctaaaaaacaagcgttcaaatggtttttccaagtggttgtcattccccctcttaaaaatatataatggtttccctttgtccatgaaataaagcacatcctgcttgatcttatcttcagtcttcagtataattggctcctaatcaaactttctagctttgtcccatagtttcacctttaccacatgccttatatagtaagccgatatggtttttcctcttaaactgtcttcaacaaaccaccagtgtcttataagttcttaatagatgttattttggaaaacaagaaaacaaaagctttgcagccaatttaggaaacactgtagtaattatattcccgttttggagaaagtgttaagtcatcttaatccatttgggctgctgtagcaaaataccacagcctgggtagtttataaagaacagaaatttatgtctcagagatttggaggctgggaaatccaagatccagcagattcattgtgtgatgagggcctgcttccttctagatggtgccttcttgctgtgtccttacatggcagaaggggcaaagggtgcctctcttgcctcttttataaaagcagtaactcattcttcatgacaattgcccccatggcctagtcaccttccagaggccccacctcctaataccatcacctagggagttagtatttcaacatacgaatttgaggggatatgaatgagaccatagcaaatgtatattagcacaacagtccccaacctttttggcaggagggaccgttttcatggaaaacaatttttccgcaaagtgggagggggatgatttagggatgattcaagtacattacatttattgtgcactttatttctattattattacattgtaatatataatggcatgattatacagctcaccataatgtagaatcaatgggagccctgagcttatttttctgcaacagtcctatctgggggtgataggagacagtgacagatcatcaggcattagattctcataaggcrcatgcaacctatatcccttgcatgtgcagttcacaatatggtttgtgctcctatgagaatctaatgctgctgctgatctgacaggaggcagagctcaggatgtaatgctccctcacctgctgcacacctcctgccatgtggcccggttccagtactggtccctggcctgggggttggggacctctgtattagcatgtgaaagtcttaggaaaggtctgtagtgggaaaaccttatttatttatttatttatttattttttgagatggagtctcactctgttgcccaggctggagtgcagtggcatgatctcggctcactgcaacctccgcctcccgggttcaagcgattctcctgcctcagcctccccagcagctgggactacagatgtgtgccaccatgcccagctaacttttgtatttttagtagagacggggtttcaccatgttggccaggctggtcttgaactcctgacttcgtgatccacctgccttggcctcccaaagtgctgggattacaggcatgagccaccgcacctgacccgaaaaccttatttactatttgtcaactgtaatctttttcacagaatctctaatgaaatatcatgagatcttaatgtcacaccaggagatgatttaggaaatgctgctcacacattttcaaaggggaactacgggagatctgtataaattctatcaagtgatgcctactcttttctttacccttttgagcattataatcatagaaacatgaagttttgagaactatggcagtcatttagttcagcttaattaattattggcatgctcttcattaaattgagtgaaactaattttttattatcttgactttgtggacctacttacgtcagatggaacttcagaaaataagtttgttcacatcctgtcctcttattattagtcttagataacttgaaaaagacaattatcacatctctcccctcttcagtctaaacattatagctgaagagaaagctccatgaaatccggggtcgtgtctgtgttttttactgttcctgctcctgcttaacatggtgttgggtacttaataggggctcaacaaatacattttgaatgaattaactatcccttataccatagttttcttcactccacctctgtcagcatcttactcattcttaaagaagtatctcaaatgcagtactgtgaatgaatctttctatatayaaacccaagtcataggtaaatatgtcctcatttctgttatttgtacttccattttcattacattcatggtgattgtggaaatattttgataattcatatgaaattatcaatatttgaccttcggctttttcttttcttttttttttttttttgagacagaatctcgctctgtcacccaggctgaagtgcagtggcatgatctcggctcactgcaatctctacctcctgggttcaagagattctcctgccccagcctaaaaagtagctgggactacagatgctgctggcatgcctagctaatttttgtatttttggtagggacggcatttcactgtgttggccaggctggtctcaaactcctgacctcaggtgatccacctgcctcagactcccaaagtgctgggattataggtgtgagccaccgtgcctggccaatattcaaccatttttgaagtgcaaaaatcacagtcttatattcaatatcatgtgttatttattaaagttatatttatgtatacatatattaatagatgtgcatgtatatataatatatgtaatctctgtctcttcaactagattggaatggtatggtatagtttatattttgtaaagctttttcttttctgtagtttataacaaggtgctaagcacaggcaatgatcaatgacagtttattttctgagattatagctactcatcctactaaatttgtggaactgaaatttagtgagacaaaccaacagtgtgtatttggaatatttcatgaataagtaatttgaggaatacataaagatagcttaatcttctgtaagaagagttactttatacaataaatatacctatcacaccaattgttattctccatgtaatcattttaaattcagttctcattaacagagtgaacaatttcaaaaggaagttatgtgggttttgcttaaattttagtaaatgatgcataaaatttgaaaactctacttgaacctcattccataattttttatttaagtcagtgggagtattgccttggcaagaatggagctttatatctgtaatacagttgtctgccaatgaagataaatgattctggaatttaaatcaattatttatttgatttctttctcagaggtacttatttcaataccagaaactaacaatttttcttttcagtatgaggctggccccagggctgagtaaataaaaatagaaaattgataaggacccatgtagtacatgaagmctgtttcactgagttaatctgataatgtcacaagatggtagttgctggttagtcataacagaatatcaattgtcccggattgaaaggtgtaatgttttctcacctttactttgcaatcatattctaggccatatctgtgcaataaatagatgctattaaaattttctatacagtatgaagattcaaacattaaaaatcttccccatgggatactgaactatatagttcagcttatttttcatttattagtgttcacaattgattcatccttatttcacattgactttgtctttaaacacctgggctaacatggccaacataaactcagctgcaattacaaaaacatagttagatcagagttctagaacttatgtatttgttgcagttgcttctattatatcacgcagatgaatctctgctagctgacttatttgggctcaccttctgcgtataaacgtttttgttttcattctttttctracttacaaaaagaagagaaaattgaaaatttttaggctacacatttagattctttttgtttctaatctattgttgtcatgaagtttttatttttattgttatttgttcatttttggtaattccratatttgcaaatatcagtattatagaccctgtatgtactccagagcaccccgactatatcctatttgcagaactatgtaattttaatttaattatatcccatggggaagatttttaatgtttgaatttcatactgtatagaaaattttactagcatatatttattgcacacatatggtctagaacatgattgcaaagtaaaggtgagaaaatattacacctttcaatgcaattttagcaagttgtgtttcactaggggaaaagagaaattttctaaaattatatacagtgagagtttttastgtaagaaacataaaggaattctcccctgccaattaacacttagggcaaggttacttgtaacacataactcctcttcctttccacagtgaagatgaaagcactgattaatacaatttaatcaagaatatgcatataagtagatatgtaagtacagacacacatgtgtgtgtttttccaaatttagaagagaaaaaatcaaatcgtgtccaccctcaggcccacgcagaggctacaataagaagcaggagtccaaggaccgttcttcatccagataacatgctactgaaacggacatttcaggagcaaaattagtgattgtgttgctatagcaattttgccacatgctcagcaaccgtgcatatgctgtggcctgagttttaatatgaccacttcaaagtgagaatagaacaattgttaaaagccatattgtactttttaatctaacctttggctaaagtatgtgaagggtttaagaagagtctcttttactttcttttcttttcttttcttttttttttttttttgagatggaatttctctcttgtcacccagsctggagtacaatggcatgatctccgctcactgcaacctccacctcctgggttcaagcaatcctcctgcctcagcctccccagtagctgggattataggcgcccgccaccacactgggctaatttttgtatttttagtagagacgaggttttaccatgttggccaggctggtctcgaactcctgacctcaggcgacctgcccaccttggcctcccaaagtgctgggatacacaggcgagagccatcttgtactttatttttgtggaagaaacatgtttttaaaagtttggggttgtcatacaaaacagattaagcatcattttaaaagaagtttaagaaacaatgtatggttaaaagagatggtccgcttccaaaagagcatagcttttctcctaaaatttaaatattattgttgggtgtctgaacctattgtgctaaatataagtaaactggttggtaattatgagataatgatccaggctgttgttccattctatttgtttctgtaccactaaatcttagtacccattattctctcaataatttggtcaaaatcttgatgctatttctctctccccaccctatcatttttttggcatctttgaaaacacaacagagaacttnttagttaaaaatttccacaatcgatgaacaatcaaatgtgaacccttgagttgggaggacattgctaaatagctctggatcatgttgtcttcccccgtgtttaccatcagtcctgagtcttccctcagctagtgattctcagaccagtcctggggaagcctgttgaaatatccattcttgccagatcctctaaatagtaccttttggagatrtaaaaaccagcccatgtaacatgagcgctaccatttgccaactatcagggtctggcaaaaaagtaagcacagcatgtaggaaatacagtatcttgcaatgaaaagcaattctgatgacggagccttggactcatttctaatttcatcaaaggcttaacctgattataaaaattgtgttctggaagaaagtttccagaacatgaaggcaagagccgcaaggaactattagggcaggaagtgtcaaccctggctgcacttgacagttaccaggggggacttttgaaaacacctaggtcctggccccagccccagagataataatttaattgggaacaggccatagcttttcctctgtgtttgttttnagctctctagtaatgctaatgtacaaccaggcttgaaaaccagggtacaagagagatgttatttattgtaaaagtgtggcagagagggagtacatagatgttctgttcaaaatccatgacctagatactttacttggtgctgtaagtagagacataaccaagacttgattactgcacttaaggatattccagtctggagggagygaaagagaggagggaaaagagagatgggggaaaacgagtatgctttacgatttgctcaggctttcctctcattctgagaataaattcatgaaaccccttggtagtcctatggtatagagttacatggatagagctcctgctttcttcaatatcctttcccctgtctctgcctattaaactgctaaagcagaaggatagcagccttctgagggaagtgtggggaactctcaggcttaagtgaattaaaatttcactggcaaaacccaggggaatgttctgtacaaggcaagtccaggaatggcaggcaatgaatggcatgcctctttttatagctacaccctggatgaccctggacaatgatgccctctgtatgaagtgacctcagtgactaagaggctgcctctccacacccattcggggggcatttgtgaaaccagaaaaacactgcatggcagacagttttttctcacctttttgctctatcagatttctgcatccaggctttgaatggacagtaagtgcccttagtcactgcatttgtctcctaggcttaaaacaacagaaatatattttctcatggttttggaggctagaagtctgaaatccagyagagctgccctcctcggggagctccaggggaaaatctgtttcttgtctcttccagtttatggtggctgccctggcactcctgggcttccagctccatcactgcgatctcagcctccatcttcacgtcaccttctcctccacatctgtcttcctctctgtgtgtctcttccaaggactcttgtcattggattctgggctcacctggataatccaggatattatcctggattacctaaaagtcttgtttatatttttcaaggtgaacatatttttatctgcacttgatctgtattttcccctctgctgtcctcccaggctgttcatctccttatctcaagatctttaactaatgacttctgcaaagacctttttgtcaaacaaagtaagattcacaggtcccagggattcagacatagacatatcctttgtgggacaccattccgcattcagcccactacagccaccaagcatttgtcaagaaaaaaaatcacttaatatgacagtgcaggagggaagtgatggtggagagaccgagtaggagtggtgggggttgaaagtaaaggcacttacttacctggctgtttttcctcatttggtcggtatttctaaggtaactataaatggaacaggcaatgaaagcattccctagtgttctttancagctttctgaggcctcccccagtctgctgccttctactcggggccagagacaggaagagaactgctcagcctggctctgcatagcgctcattttcctcctgctcacagcatccttgccagcccctgcactgtgacagccattccgtctcattctcattgccacgtttctcatacaagttctttctccacattgttgccaaagccaaaccaaaatagccaatacaatcaaaagagcttcactttataatttcctttacacacgcacatatacacatgcacacacacgcacacacttatttttgcttggcctagcaacacaatgggaatgtaaacacgttgttaatgcagccgctctcagttggcttcccagatggcttgaattcaatagatttttccccctgatttcctcagcttctcctagcaagtgctaaacagccattatgccttttcctgcacattgagattcatctgcaactactaaactgcctccaaagtgcttcaattttgcatgagcgctaagctgggcactgggagacattacccagtgctgaaggcccagatcattagaaagagcatgtaaatcctctgaaccagaaataaaaagtgcagagatttcctttgtgaagtcccaactgctgctttatgtaaaacatgaacctttggcaaggttatatgtggtcccattcccttttatttttgctttttttttttcttttattttggcatatgtgttctttttttttctgagcagtgagatttccatcaggaacatatgaaattacagccattctctgtcattatttttctttttaggacctcagatccctcttcactttttatagggatrataccttgaagtattgctaaaggatctcctacatgattgactttttaaaaaacttgctgaataccaagaaactttgaggtgggatggattgacatttataagatatgtacaggggacaaaaatctatattatttaagtatagatgtaaggagtatgcagatattggattatggacagaagttggaatacaagctaaaagggattgtgaaaantgttaatgagaaagcagtggttctattcttctcattttttgataggtatttccctgtgcattattacctaaaagtcttgtttgtatttttcaaggtgaacatatttttatctgcacttgatctgtattttcacctctgctgtcctcccaagctgtttgtcagaccatcttgccacaaattaaaagtgtgcctgcggtcagctccgaagcgcctatgagagggtggggatgctaggcttggaatcctgagagccccacggttttgcatgctgtggggttgggtccacactccaagtccttggctttgtaacaaaaagcacttatgatggacaggttgactctccatctttatttattatttcctttgcagtaggattttttgatcagttgtaataacatttattttgatctatcatgtacccatttaagagtaataaaccaggctccttttacatgttttctctataattatttcccttttttccatgtacatatatagtaggtcatgctatcttccttttaggattctgagagtaaaaatgtgagcttgatgtacacttaatgatcagatacagcagttcattatttatctctaaacacatttccaaggacatttattaaccactgatttattcaacagtgaatatgcaactgaaatctgacagaagtgttaccaaatgggcttataataagatatgaagtaaatgcattccaacttggaagtaaaaagaaaatactagatgaataatatgcatacaaatgcacacagagacattaggagcctatgtatactctctgtgtaatatatccatttttatgctgaaactcagttttgtttgtcagcatgttgtatgtatccttcaagctaaatattcctatccrttaattttcctttactaaaaacatagctaatcatgcaaatgtcatcatctttattagtgctagtatcattgcaaaatattatttactatgatccatacctcatggctctaactgcatatattaaatagctacctttcctgttcttcttctagtggaaattgtttatccacaaaagtatgtgtcctttgaagcaatacatttgtaaaataaaggaagaagaacaaaactttgcctggagatatgaatagacatgattgaagctgtttgttcgattgtcaatattatacagttacataaatgtctcagggaattggagctcatagtgggaaacaatcatttttcttttttttctttgtaatgctagtgtagaatagacataaagacattacaagttccaaaaatactcagaatctgggttcactcctgactaaggcaggaagagctgccctgaacaaggtcaccttcctaagattgttatgacaatgaatgtaccattctaacatgtttcagccattccatcttgggagtagggggtgtctaaatgttacagcagcttaccataacacagacttaaatgatatggaatataatatgcttggcacacagtaggttttcagtaaatacctattgaataaatgaatgaaaaaaatacttataaagtccatgaaactttgttgcttttttaccatgatccaatgcttacctccaaacaattaaaatttatttttaatttgacatttttttagatacacaaagacggatttccattaattctgagggttttcaaatatctgaatatttgattttaatattatgcccaactgcctcaaaatgcagakgaatttactatgtgacaaaatattattttcacaatttcatgtttgcaatatttttcaaaatgtattttccagtataaatgttgaacaaattgacgtgaaatactaggtcatagtgtttaagtaccattatcattttctttacagtcaatcatgttttgatgtttttgcaagagataaaactgaaaccacagaaaagtgacatctgatttgtgaagagccttgaatagcagctagagagctccctgagggggctcacattctagttggaaagtgaaggaagcctccagaagacatgattatactcatgaattttatatcttttttaaaatatggatgttagcttattctgtccaaaattagtcagaactaacctacttagtaatttctgttcaattgcttaatgtctctgcctcacctgtgttattgaatagggatctagggaatgcctgatagaggagctgtgcaagcattgtggttgtcaaaataagtagaccttatgcactttgattcttcatgtcaggatagctccgctrtatctacacttcaggatggtggggttctggaggattagnaaaattccaggtggcttggctgaaggagaagaaacttaaaggcaactcccctgaactcatttctagtgttcagaatccatttctaaagaacctagcctcatctgcattgccctgaacaactgaaatcttcactcagacttgacttgcccgagtccactgaaaattccccaaaccagtcatgtctttctcatctgggtatgtgactaatatagttttcaattagtggtgctcttctcccctcctaagtctttatagtacctcaaatgataattttgtgaatagaatacagctttattcacaagataattatgatgcagtacattttaaagacattttatggatttcaagtactttcataactgttatttcgttccttttctcacaatgcagcaagacaaacacatttttagtcttatttcacaagatgggagaccaaggtttgatgaatttaagatttgccaaaagtcagccaatacgtacagagcagaatttactttcttatctcaataaatcactaggttgttttgtgttagatgaatatgttttcagtcacctagttgcaataataattgtcctgggtgagtggaatttttaaacatatgaatctttatagtatgctttttaaagttgcattaagattatgaaacatattgcttttaagataaacaaatagcaatcctcaatagaacatactatgtgtgaactgttgttaagtggtagtcactcagaagtgattgctcttaatgcttgttttcaaatcatttggaataaatgcaaaatgaaagcccatgaggatgagtaattattattctggatacatatacctggtttccactgtcagacagtgtttttagagggtcaataaggatattgctcttaacacttatgattaatgacttgatgtaagatcgaagatctgaaaaccattttgtaataataattaaaattaaaattattaaaattcctttaaagtaagtcagtgtatccttgtttactcatagagacaaattaatcttcctgcagcatgtcattttcaaaactgtcattttaccaatttacaattttcacaatctcactgctccaaagaaccaacttccctagctgccattcacagctcttcatgaatcttctcttctatctaattcaacacttattcctttactcaatgaatgtaaactactctcccctagagtgctccatgcattttcatctctgctctttggcttcatgctattctctcttcctgaagtgtctttgattcctttctctaaatctttaaacccaaaccttgtttcagtgtcaatctcaaatattccactttgccatggtccctcaatctgtccatctgaaatatttcactataccttttgtcatgggatttccagaattttctaagttttggactatttttattcagtagatcaatgtagagaatgctaaacaaaaccatactgagagccatgatgaggtgagtttctgtggctacgttgactgtagggctgtgtggtttaacaaattgagggaaaatgatgctaatctgtactaaacagacttctttactacagaacttctgaccaatgccttcaatatatggatgggcattctgagttttgtagaggagggtgtattgaacagaaattcccaagcttgtttgaccatggaactcttttctgagacatagtttcaggaatattggtgtagtgaaaggaataggaacattggattcagacacatgtggatataaatctttattttggtacttattggctatatgaacaattgtttagattctgatctgtgctctttacatatttattatagatttgacagtatgaatccccaaggattgttatgcagattaactgagatgcacagtagctgttcaaaaaatactagttacctttactcgtctaagctacaattaartttattctatgcctgggattaaacactttattttctgttgtaactatatatatgtacagatcattcacttatttaacatatattaactggacaaatawtatgtgccagttactgtactgatggatacagaatgcataggacagggcctatgctcaatgaacaactattttatctctagtcttagtatcttctgaagggaggattcataagcatttcatcagtgtggccacctaagaaactatcataatgaatgaaatatgtgcttaagaattatcttcatactggaatgtcacccacaggagaacagagaccttatctccttacgtgctttcttttctggttttggggktttttttgttttttgttgttgttgtttttgtttgtttgtttgttttttgagattggatttcactctgtcacccaagctagagtgcaatggtgcaatcatagctcaccataaggtcaaactcctaggctcaagcaatactcctgcctcagcctcctgagcagctagtactgtaggcatacaccaccrtgcctagctaattttctgatttttatttgtagagacagggtctctttatgttgcccaggctggtcttgaattcttggcctcaagcaatcctcttgcctaggcctcccaaagctctggaattataggcatgaaccagtgtgccaaggtgatatcttctttctttagcactgtatcctcagcacatggaaaagaaaagttcttgtcacatagtaaagtctcaagaaatatctattgaatgaatgactggacaagactaatagtgaggtctataattcacaagtgtatagttaactagatttccacgaacacattactatgccccactttcgttaacaggcatcattttgttaaattttattaaaattgtattaaaactactcatgaatgcctgaaacaaggaagcaaagacatgcatgtagtaagatttaggtcataattaggaattatattttccaagaaaaatgttggaatatacattcaaatatgtgtaatatattcggtgttttaggacaaatatttagaagaatgttgcatttgctaattcagtggaacatgctttgttcccttccaaattaaacaaagtgctgtcatgtattcacaaaattgttttttttatattccaaagaatattgacacacaaggcataagttaattacagaaagcattttagctgcccttttagtatcagaaagtcttctttgcacacatttgaaagatttttttttaatcaccaaagttaaaaagaattaaatgacagctagtgcttgtaaggttgatttctagcaattcgttgcaactttaaatgtaaaacagaaatattttgcacacccaccattcaagttatccctcagatatggactctaagtttgatgttagttggaaagtcaaatcaaaaatagaaggcctagttctcctgtaaaactcaaaacctgatgctcgcacaaaggaaagaggaaaactgtgttatgattgccagagtaagttttatttttcattctatgtaatattgtcttataattaaaatttcaagttttaaggcagaaaaccgtgcgttgatctatagttgtcatagagctttctagaagcactagaaatccccccccaacccagttacacaatccagtgaatattcttctcagttctagacaaaacaaaaatataacaaagcacagatcctcatttgacacaggctgccacacagagccaagttcctaaaaactatggccataaaaaggaattgagtcaatgacctagaaatgcttccaagcaaatcccttgaaccactcagtttcagtcatataaattatttaacytttgaataaatttagccttctacatttattaacagaattgtgtatatttatggtgaataacatgatgttttgaaatatatatcatggaatggctaaatcaagctaattaacatatacatcacctcatatatttctcattttttttgtaatgagaacacttaaaaatctactgtcttggcaaatttcaagtacacaacacattaccatcaactgtgttcatcatgttgcacatctcttgaacttactctccctgtctaactgaaatttaatatcctttgaccaacattttcccagtcacccatcttgggaccccctaccctctgtgaaccaccatttttgctctgcttctatggtttcaccttttttagaatccacatataagtgtgatcatgcagtatttgtcttcctgtgcctggctcatttcatttaacataatgttctccaggctcatccaagttgtggcaaatcaaaatatttcctttgtttttaaggttgaacgttttcccctgtgtatatgtaccacattttctaccaccactcatctattgatggacacttaggttaatcccatgtcttggctattgtgaatagccaagtgctgcagcgaatgtaggggagcagatatccctttcaaatactgattcatttactttgggtatacacytattagtggaactgctggatcatatggtagttttatttctgttttgttttgttttaaggaaacttcatacagtttttcatawggctgtattaatttacattcccaccaacagagtgcaagggttccctttgccccatatcctttgccaacacttgttatcttttgtctttttgatagtagccattcttccaggtgtgaggtgatatctcattgttttaacttgtatttccctgaggattagtgatgttggacatattttaatatacccttggccatttgtatgtcttcttttgaaacgtgtcttttgggatcctctgcccagttttttaattgggttctttttcttgctcttgagttgactgagttccttatatattttatctattgaccctttatcagatgtatggtttacaaatgttttctctcattccataagttgtctcttcactttgttgattatttccttgctgtgcagaagctttttagtttgatgtattcctatttgtctatttttgcttttgctgcctgtgtttttggggtcatattaaaaaaatcattgcccaaactaatgtcaaggagcttttcctctatgtttttttctagcggttttacagtttcagggtttatatttaaatttttaatctattttgagttggtttttgtatatggtatgagttaagggtctaatttcattcttctgcctagggatatccagttgtcccaacactatttattgaagagaccgtcctttccccattgtgtattcttggcatctctgtcaaaaatcaattgaccataaacatatggatttatttctgggcgagctattttgttccattggtctgtgtgtctgttttcatgctagcattatgctattttgatactgtaactttatagtagatrtggagatcaagtagtgtgatgcctccagctttgttctttttgctcaagattgcattagctattcagggtcttttgtgattctatatgaattttaagattgtttttctaatcctgtgaaaattgtcattggagttttgatatggatttcattaaatttgtagaccactttgggtaatatgaacattttaacaatattagtttttctaatccatgaacatatctttccattcatgtttttcttgttcttttttttttttttttttttttttttttttttgagacagagtctcactctgtcagccaggctggagtgcagtggcacaatctcgaatcactgaaacctccacctctcaggttcaagcaattctctgcctcagcctcccaagcagctgggattacaggggcctgccaccatgcccaacttatttttgtgtttttagtagagacagagtttcaccatcttggccaggctggtttcaaactcctgacctcaggtgatctgcccgcctcagcctcccraagtgctgggattacaggcgtgagccaccgcacctggccttccattaatgtttttcttcttcaatttatttctttcatgttttattgtttgcagtgtacagctctttcatctctttggttaaatttatttctatgtattttattatttttatagctattatacatgggattattttctttgtttctttttgggaaagtttattattcatgtatagaatcattactgatatttatatgttgattttgtgtcctgcaactgtactgaattcatttattaattttaaccgttttgtttaatttataggattctccaaatgtaacagcacatcatctgcaagcagagacaatttccttcttcctttgtgatttagaatttttttcctcttgcataattgatccatctaagacagtactatgttgaatagaaatggcaagagtgggcatccttgtcttgttcctgatcttagaggaaaaactttcaacttttcactgttgaacgtaatgccaggtctgggcttgtcatatatagctttattgtgttgagcattcattttctatccaatttgttgagagtttttctcattaaaggatgttgaattttgtcaaatgttctttctacagctattaagatgatcgtatgatttttatccttcattttgttgatgtgatgtattacattgatcgatttgtaaatgttgaaacatccttgcatcccagggatatatcccacttgataagggtgcatgatccttttaatgtgctgttgcatttggtttgttagtattttgttgatgatttttgcatctttgtttatcagggttattggcctgtacttttcttttcttgtagtgtcctcagcaggttttggtaagaggataatgctggctttgtaacatgaatttggaagtagtctcttttctttaattttttggaagagtttgagaaaggttaagtttagttcttcttaaataaaagtgcaggtcctgggcctttatttgatgggaaactttttatttctgatttaatcatcttactgatcattgattggtctgttcaggttttctattccttcatgattcagtctctgtaagtgttgcgtttcttacattcatcttaatcacaaagatagtagctgtaactttaacaaaattatactcataataaagctaatacaccagcaagttgcaattcccacttgcatagaataattttagttaaattatatagtttgcttatatattaaacattatattaaaaatttaattaaaacatttcaaagagtaggtaaattttgtgtatacaatgtcttcctgctatagtagttaaagattgttaagtgacttcatgtaacacatgaagtcttgattctgaaattctgccttttaagttatcacactttaattactttaacgagagttataagatgctgaaataataatcagtttttatagtatgacatccttctaaataatgacagggtgttttgtgatttaattaatattaagacatctagaactgatatgtttcatattttaaataatactagtaaaagcttataatagaatgaagcactggaagaaagaaccaaaagatcacactaattcaataaaactttgtaatatattccagaacatcccaacctgcagctttgtatatttcttaccaacctgtgtcctaactgtgaatgtactataatgaaatttggtggagggagctctgcagttcttctccaattagagagattgctggagaaagccaaattgccaggcctgcacaacatgatatcttaaaacttccttttgccataagaaagataaagccatggagaggaatcaactcaggcatacataatacctaagtctaaagttgagttaggatacttttgaaagaaatatacatggagtatcagaaggcgcaaattcactatcatgaaaatgtgttttaagatgatgtgtgatttttttcagtgtcacctaataaacaagatatgtttataaaatacatgaagaggcaggcgtggtggctcatgcctgtaatcccatcactttgcgaggccgaggcgggtggatcacgaggtcactagatcaagaccatcctggctaacatggtgaaaccccatctctactaaaaatacaaaaaattagccaggcatggtggcaggcacctgtagtcccagctactccggaggctgaggcaggagaatggtgtgaacccgggaggcagagcttgcagtgagccaagatcgcgccactgcattccagcctgggtgacagagcaagactccgtctcaaaaaaataaataaataaaaataaaaataaataaaatatatggagagcttaaggctaagtaatgtttgattcatccttacatttctgcaacttagcataatatctgttattaatggactttaatacttactttatttgatagcactgtagattacattttggggaaatacagatattattttaagtaatcatttaattggattaagcatgtatttgtgctcactttatggtagtatcctagaaaaacagtatttgtggtgccttaccactattatgaaattaagcatatgctaaaaataagaaataaatgtcatgtcattatcaggtcttattgccatattcatgtatgacctcacaaagatccaatcagagggttgcatttgaatctgaatttctatattcatttgaaatgtattattaacaagtgcacactcatactcatcataagacttcttggaataacatgctaattactttcctgcactctggctcccaaactacaacaaatcctattataaaaacaaatcactgcaaacttcaaacagcatgcatccttgagatgccactattaaaggaagcagcatgatgggaaatctttgatgttatcagatgtgatggaaactacacatttgtatttgagtaagtcctgtagaccaaagcatttcccccacccttaaataacctgaaaccaatttcaggttcccaaatgctcttcaaagcaacccaccttagaagtaatgctgatggcatttcaaattcaagrtagtttgctttttccatctccagacttcaagcagatttgaaattataggttcaaagagaaaaaatattatctacttttacccaaaccactaggctctggtctgatgaacaaactctcataggtaataaacttacctatggttatgaaaatatggcatgtaaccaagtagctcagagtctgaataatgcagtcaattctacggaattcttctgagtcataagtatttagatacttcatgcttcagttctttcttattcttgtgttgttgaccaaaagttggaatgtaaactttgggctatgtaataggacaactgtacacaactcagctcctcctgaatgggacatctgtgaagctgaatacaaaaatcagtgtgtgcttgactccagtgcccacagggagcctgagccaaacaattcagagcattcagactatgaataactcctgtagcaggagggttggtctgtggcttttaaaaaggcttcagatttgtggtcagtagaaccatccatgagcctatttgagctaaaggatacagtggacctactgaattcctcaagcatttaattaggcttcctgtaattgctttaagtaaaagtgggggagaatgagacctgaagttatcatcttgggacaccaaatatttggatgtggttmtaatatcctgagcatattagttgctgctctgcatcgtataaagaaccattatagttctaaggaaacacatattgcaaatttatcagccctttggtgactgtaagttactacagtaatcttaaaggaagaggtttgtttccagtaactgaatttccccatgaagagggaatgtataaataagtaaagcagggaaaaaccatcaaacatcagagagtagggggaaaaaaagagagagagagaaagatatggggactggggaaagaggttgtgattccatcttcccatagatttccagaattggaataatgtgaaaaaatacaataagataagaaaatgagaggcctgagtagggaccaggaaagaggaggcaaagtggtgttatttgttaatggcctaggattgttgctgagaggattgttacattagttagacattggctaamataatntactaatcttctttccatagaagggtgatggattggaatatgccacttacttggaaattctttttaaactggttaatatataaacatacaaggattgctaattttcaaaacattgaaataattttgaatgtacttcataagcttttcacaatagagttgccccttaggatcctgtcacgccttgggattataaaacccaccgtcttgggcttcattaccatttagctagtcattaatgggcctatgagcttagtagtttctatgacacaagcctcatcagctcttgataggaaatattgtttgttcscccagtgggacagctcctactcccattgggtagttgttcatttccctgagtgtgtttagtcatttgaatattttctaggtgttaaggaaagttctaaaatacagtttttaaggagttccagaaaatataccctctcctgtcacctataatcaaacattttgagaaattataacttttatgaacttattaaactataaagaattgaatacacatacacatacacacagatatacacatgtacacatacacatacacacatatctattttatatatcatatatgtatatatttaattctcatctgatcatgtcatctacttgcttaaaacactttagtaatatccatggcttttaggaagaaactgaaaatctttgagacaaagtctcgctcattgcccaggctgaagtgcagtggtgcgatctcggctcactgcagactccatctccaaggttcaagcaattctcctgcctcagactcccgagtagctgggattacaggcgtgcgccaccatgcccagctaatttttgtatttttagtagagatagggtttcaccatgttggcaagactagtctcaaactccttacctcaagtgatccgcctgccttggcctcccaaagtgctgggattacaggcgtgagccacagtgcctgggggaaactgagaattataaacattgtagatgtgagtagttctgaaactcagcatgcattgggattacttggcaggctggtcaaaacacagattgctggaccccacctccagagattcctattcagtgagtttggcatggagcctgagaatgtgcatttgcagcaggttcccaggtgatactgatgaagctgctctgggggccacactttcagaaacactggtgtgcacaactatgtaaactagaccctttcttgtctctagcttcatctcatgccactattctctgtggttggtgctcagttgtcttctcctaaattctcaaactcctaattccctttcctgctctttcccatatgtcctgtccctcctgctcaccatatgattgaaccaagctaactcatactggatccttcacactagattgggttccctgattactcacactcattcctatgcccacctttgcagcattgaatgcaattgaacctaaataataagttgtataatgcattgttaacatgatacctcttcacaataacataagttcattgaggggaaggactatcttactgattactttcacaagtgctgatacattatcttttacataattgatactaaataaatatttattcaaagaataaatgaatagatggacatatgaatagtgcaaaacaatatatttaatcattcttactatacctatacttgacccaaagcaaattctcctcctccctaggggtgttctgctggttccctcaatggacactccatgctggaagtgtgtgagttcaagctctgggagaactggcagttgcccacatatgttgttcagataacccctcttgctcagggcaaagaggcacattgaagaatgaatgtctgaaacagccttgataattcaagataaatacctctaaaatgataatcccagatgcttagttcaattttttgttattcaagattacataatgctgtgaaataaattccaattatttgagcattttagcaggaggctactttacctttaacagggttttagtatattacaattacagagaaacattttgggctttcaaactattatgcatgaaaactttaaagttatatattcttcggatacgataccagaagcttgttaacaaaggttagtatctgtttcaagaaaaacgatgtgccatttaattgaaacacaactgctaaagtaatttagttattaaataatcacaatgactgttggttttagctttgtaaatctgtgtacatacgtttattttacccacaactatataattgaggtaaaaaccctagaagatgtgaaactcaagtttatatttcaatatagagaggaaggttaaaaaatagcaagctgtattgggaaaggaattactttgtggagtgatagagcccttctactttcatcctcagaataatccagaagatgtgaaatagcaaataagagaatgaaaaagttgttgagtaaaataactggaacgagaagaaagtcaaaagagatgagagacaatatctgggttgttgatctatggcatcaaaagggatgactgggggaaaaatatgatgtgatggtttatatttctttagtatgaatcttgtgttgacttaaatctttctttttctcttgtcaggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatgtgagtcattgtacaataagcaccttgggtctcagaagttgatacacataagggaaagtttacactgtgactactccagcaccaaagaaaactggtcaaaaatcctggaaaggccaggcgcggtgactcacgcctgtaatcccagcactttgggaggccgaggtgggcggatcacaaggtcaggagatcgagaccatcctggctaacacggtgaaaccccgtttctactaaaaatacaaaaaattagccgggcatggtggcaggcgcctgtagtcccagttactcgggaggctgaggcaggagaatggcctgaacccaggaggcagagcttgcagtgagccgagattatgccactgcactccagcctgggctacagagcaagactgtctcaaaaaaaaaaaaaaaaaaaatcctggaaaaaaactgctcccagatttctgcatttgagccacatattcctcttaggtcgccaagatttcattttatttttaattttcttttttattttttaatttttgtgggtacatagtaggtgtatatatttacatggtatgtgagatgttttgatataggcatgcaatgcctaataatcacatcatggggaatgaggtatccacccctctggcatttatccttttgtgttacaaacaattcagttatactcttttagttattttaaaatgaacaattaagttattattgaccatagtcaccctgttgtactatcaaatagtaggtcttattcattccttctatttttctgtactcattaatcatccccacctccccgcaaaaccctgccactacccttcccagcctctagtaactatcttttattctctatgtctgtgagttcaatttttttccttttattttttgttttaaggcactgagtaatttttctttagggatgtgaaagaactgtgttactttccaaagattttgattttgtaaaaaatctagtaggaattagactgtaggaaaatcaatccttacaatggcatatatcattccttgaatgagttcattctaccactttaagacaaagttgagtcgttttcctgttcaaaatagagattaccaagataaagcttctctatttattttggaaccattctagtacattggaccacacacagcactgttttccaaattgtgttaatttctagagcatacatgttcaggaagaggttaaaaggtaccttgcaaaaaaggcttccataatcaaataaatgtaagaaatatattttttgacaaagttatagaagcttcattgcaaaacttctcagatgatttaatacactaatatgcatgttatcaccacgagggagaaggaggctgcagcttgcagagccctttcctcagtaaatattctgtctgtcttaagcaacatggatgccacgtaacctgtctcaaggtttcatattgagaaatgttctcatacatgagaaagcgctgaaatccatatattttcttttctgaaccctttacatctttgcattttactaattctattttgtgttggatgccaatatcacttagctctaagtcccatcaatcctgcttctaaagcattccccagttctatacttgtctctgactcccttgcttcttcatttagatgtggaccattgcagatcttccagttagtctccatggctcaagtctgttctctattccagcccttcctccctgttaccacaaacacagtctttctaaaacttaggtctcctcttgataaggtttggttctgtgtcccacccaaatctcaccttgaattgtaatcatccccatgtgttgtgggagttaactgaatcatgggggtggattttccctatgctgttctatgatggtgaataagtctcangagatctgatgcttttataaaggggagttcccttgtacatgccctcttgcctgccaccatgtaagatgttccttgctcttccttcatcttccaccatgattatgaggcctccgcagccctgtggaactgtgagtccattaagcctctttcctttataaattacccaatctggggcatgtctttattagcagcatgagaacagatgaatacacctctcatcttgcctccattcctgcttcacattttatagtgacatgtgagataggcaaaattccttataatggcatatatcattgaattagttttctagggctcccataataaaacaccacggattggatggcttaaacaatagaaatttattttctcacagttctgaaggctggaagtgcaatctcaaggtgtcagcaggtttggtttctcctgaggccgctcttcttggcttgctggtggcctctttctcactgtgtcttcacatagtctttactctgtgtgtgtgcacatccctggtgtctctgtgtgtccaaatttcttcttcttataaggacaccagtcagattgggttggggcccaccctaacagcttcattttaacttgatcacctctttaaaagtcttatatcccaatatagtcacatcctgaggaactgagggttagggcttccccatcagaatttgggggartgggatgtagttcagccaataacaactacattttgtggtttacatatccaacctatgtttctagctcggaagggtaaggatttctacattgtaatcacactagattaaaactactttgatttccatgcctttcagctattcttcatgctgaagcattgcacccttatcttactacctttcacaacatatatatgtatatgtttgtatgtatttgttcacttagacaaatactaagtgaagattcactctgttcttgggacaattgtgggtattggggttggtactagaaacaaaacatgcaaccatccttgccctcatggagctcatgttgtggtgaggaaaggcaaactctaaataaaatgaatgatcatcaggtctagagcagatggtaagtgccacgaagaaaaaatacagcaggaaaagggaatttgtagggctgggagggagtggtcaggaagctttgctgaggaagttgacagttgcgaagacctgaaggaggggcaagagggaatcaggcagaggggacagcggctggcacaaaaaccctgaggcaggagtgtgctggtgggtcccaaagacagcagtgaggccagagtggctagaatagtgagtgagaggacatccacagatgcagccagaaaggtaaggcctgggctaaagatgggagcagtgtgtgcagttggcatagggttctgtaggtgttgaaattatctttggttttgtttgtttgtttgtttgatttttgagatgggggtctcattctgtcaccaggctggagtgcagtggcgcaaacacagctcattgcagcctcagtctcgcaggctcaggtgattctaccaccccagcctcccaggtagctgggactacaggcatgtgccgccatgaccagctacttttttgcatttttttgtagggatgtagtttcaccatgtcaccgaggctggtctcaaactcctgggcacaagcgatttcgcccacttcagcctcccaaaatattgggattacaggcgttagccaccacactcggcccatatttggttttgaggataagttgggaacactttggaatcttttcagcagaggaactcatgacctgacatccattagcagagtcatcagagtcatctggctgctgtgttgagaatggaccatgctgggcaaggggagaagcaggaagaccagtgatgagactgcagctatgagagatgttaagctactgtagattggaagcagtggaggtggtgaggccaggatttcagatatatttaaaagtagagataacagcttttgttgagaccttggatgtgtgatgtgagagaaagaagagaaaggatgatttgaaagggctaagccttatcaaggatttctttcaaatgtctttagtgaagccattcctgcctcacagagggaggaggctgggcattcctttctcaatactttcagagcagtttgtccatactcctaatatagtgcttgtctcatttcaattatattcactcgtaaaatttgtgtttcatgccagtgagttccatgagatcaagaattctattgtacttaattttatatctctcctgcttagcacaatacctagagtatcacagatgtttaacaattttcttgaattaaaactgttataaagaattcccagtgaagtttgttcaaatgctcgacattaatctttcctctctgagaatgtctaaatagattttctctttgtcttaagtggaatctccatgaaatactgtgaaatggagtcatacatgcagccagtgtattgaggggtgcccttaggaacaatatgctaagggtactaggatatcaggtggaggaataaaggcaatggttgggcagagggagaaattgacctgcagagcaaatacaacacytgatgactccataggaatctgaagctcacatggcccttcagagttatagcaccctgaggctgaaggggtgagcagacctgtattcccctacatagactagtcagtggatgaagaccctcctttactccctaccccaccagcatgtgtaaccagggccaagtcagctctgcaccactgagggtgattccaggagagagaagctgagactttcaccgtcaacacttccaacaggtgggaccaggcctgaaaggggatcctggtagcataccacaacatccactgccacaaattctgaagaattgattttttattaattataaagaaaaatacttttaatcatgtttaaaaagaacaaaaagcaaatgtttcagtcaaagatttaattgaattcaaaatcagtttcaaactgtaatcaaaggaggcacaaggawagaaagctattcttttatctttcatttctatgtattcattaatagcaagcacaatatatacttaaaattgccagtctacattccacactacattgacttgctaaagctgaactttaagagctgcatagtttcaaataatgaatttttagttaataagccttcaattttcagtaatttgcagagaccattgttgtgccaatttcatatatatatataattatatgtgtttgagtagatatattctttttcagcacacaaacattaagtacatataggtataagacccctttctttgcagtatgttctataaactttgctatttacttcatggcttttcaatctattttcaaataaaaaaacaaactcttcttctaggtcaacattatttatccaaggtaccttttcaccctcatgtaataatattcaagagcagttcacctataattctgtagctaactgaactcatatgtgtgtaccgaaggaaccccacctaacttgtaaagattgactcataaagatatgcatcataatgagaacaaaaaaggttgaattttcaaattctctctgtacaggctgatccttatcattagaagccccttgctaatgttgcagaagtttgtggggtttttagtttttggtttttgttattttttgagagaaagtcttgccctgtcccagacgggagtgcaatagcacaatctcggctcattgcaacctgtctcctgggttcaggtgattttcctgcctcagcctcccccccatgtagctgggattactggcatgcaccaccatccctggctaatttttgtatttttagtagaaataggggtccctccatgttgcccaggctggtctcgaactggtgaactcaagcaatctgcctgtctcagcctcccaaagtgctgggattataggcgtgagccactgtgcccagccacttatgggttttctactctgtcctgtatcaagtgaactgtggtgctctgcccagtaatacttgaccgagggccatcacataaatggcaacttaagtttaaactcatcagaggtgaagatcaccacgatgctaaacttaaataagtatgattacctcttacctaattagatttatgctcatttgatgtactgtggaggggcccatagttctttcatgaaaaagctctattttcagtttataaaccataaatgaatattgactattaatttatgtatttaagcttgcttacaatatttcacacattcaaaccatgtaaaatgtaaaaataggtttgtgagacaatcaaggcagaggaaaaaatggaaatatgaaagttaggattcagccaggctgtgctgagaacataacacatctgctttaaaatcctgcacattaacaagacagcagtgccaaatttcctaggcgggtctggtagttttcattcagagaaaagtttattctgagagaattcaagttgccactacaatggtgtcctgtgcagaacccttactgtaatacagctcccagtgtcatcatggggttgtttcttccagtgtctcttgttacaggctgatgagtgaatcccaaagcwtaaggttcaggcaaaatattaacatacaaggtctttcctcaggaacaatttgggtttcaatagtgccgctcttgatgttaccattgttgacaatgttgtgattgtgttgtgggggtaaggatatgatggaaaaagcagcataggagactggttaatagcacaagctgagggacagattgactcatgttcgaatcctagtgccatgacttcctactgtgaccttagtcaagttacttgacctctgggagccttagtttcatcaaccatagcatgaaaaagagttattttaagattaaatgagataaacttgtaaaacatatgacatagtgccagacacagtgcaaatgctcagcgaatgataataggtgttcataaaaatrgatataaccattttaaacaactttatatgtttattttgaaacatcaatactgagcaaactttgaaaactgaaaagtctgtctttcctttaccatttcatgtcccagggctagactgtcaatcctagaggttgaaattctctgctgattcacataaaatttgactgtaatttccaaccccttctgcccatgcctgaggatggaagaacatgccatatggtcacccttatcctacagtcatgagctataatgggatttacrtgcacccaagattcatcttccggggaacagcaggatggctcctccggatttcctctcgatcgtgtgtgcaaaccaataaatcacagccagcatcacaaagcctgctggccacaaagaggaataaggtagttcctagaaagaattaaggatgatcaaggtggcccctcctggcttcctctcacagctcactcatcattttcactgagagaataactacatttgtgacccacctgtggatttggatcaagtcttgttcatattcgtgagtctatagtatccagcacactgtctaaaacagcagcgtccaatagaaatatgccagccacaaatactgtttacacttttctagtagccacaatttaaaaagaaacagataaaattatttcggtcatgtatttcactgagtccagtatgtctaaactatcatttcaacagtattaccaatatcaacaagtatttatgaaatacttttctttctttttgtcatactggtttttcagagctagtgtgtgtacccttacaatagcttcagttatgaccagctacaggtcaagtgcttgaaagcctcatgtggtttgcattggacagataggctccagaataataatactgataataatggaagtgctgtttcaatcatgtattatgtattagatcattcagtctttgcaaggactctatgtgatgagtgttattattattcccattttatagacaaggaaattgagagcaacgggagattaaaaatcgcctgaggttatacaggtggtatatggagcagtgagtcaggccagcatccaagtccatgtgtttaaccagtacactgggtacaaagaagggaggaggagacaaggatttgtagatcagctggcaattcacaaaaacatcttattctctacatgcataatgtttataactggtgcaatgtcttacgttgtaatcccagcaccttgggaggccaaggtgggaggatcacttgcacataggggtttgagaccagcctgggcaacatagcaagaccttgtctctaataaaagccaaaaaaaattaaccaagtgtggtggtgtgcacctgtgatcccagctgggatactactgtcagcccagaaggctgaggcaggaggatcccttgagctcaggaggtcaaggctgcagtgagccatgatcacaccactgtactccagcctgggtgacagtgagatcctgtctcaaaaaaaaaaaaaaaaaaaaaaaaaaagctcactattatttataatacagaaacataaacagaccttggcttcctgcctctcttcttattgctttgtctgctctaaccacatccatttccttgtttccagaatgcaatagattcattccacatataggctgcttgcaagaactgtttcttctcacttgaaacattcttaccccaagtctaaaactggcttactttcttctttcattcagatttatactgagatgtcactcctatagaggggtctgtctatccgggcctcaaccctgtcacttgcctaatcctaatcctgctttattgttctccataacatttttcttcatcattatttgttttcttttgagttaaccatctgccataccagaatgtaagcttcacaaggacagagactttcttttcttccttgttgtctccagtgcctagaagacgtcccttgcctgtggctgctgataaataaattaaaacataaaaaaatgaaataaaattgaattaaattgaaagtacatgatggggaaaagygaagatactattcaatgtgaatcatttgttcatttaataaaaatrctttttttccccaaggaattcaagaacatcaggtagctggacgtaattgcctctacactcttgtacttattacgtttctgcatagcacttctcaccttctaaaccatcatacatttacttatttattagttaatggtttgtattctgtaccccctcacccccttagaaagtaaggtccacataggcaaagatttgggtttggttttttcactgattaattcaaaacgcctagggtgattcctgtcacaatgtagggactcaagaaatatcataaaggaatgaatgaattgacatttctgtatttaagtatctccagttaaatatatatgtaatctccgggaggctgaagcaggagaatggcgtgaacctgggaggcagagcttgcggtgagctgagatcgcactactgcactccagcctgggtgacagagcaagactccatctcaaaaaaaaacaaaaaaaatttatatatatatatatatatatatatatatatatgtgtgtgtgtgtgtgtgtgtatatatatgtatatatatgtgtatatatatatgtaatctcatgaattattatattggttcacatgtacagaagtcctgatttgtggccttatgtgttacttttttattttctacctgtctactctacttggcataaaacaaaattaattatacaatttaacaaaaataatgcatttctttaaacaagcatcctgaaagatgaaggtcatactataaacagttctagtagcctaacaccaaatgtactggcaggattcagcaggctcccctgtacaccagaataaatggcatttttactaaggtacatttctgagttgtagtatgataccttgtataacaaccattaaagcccacattaatccaattataagtaacagaggccatattttgaattggataagattaaatatatactttagacatttttagataagggaaaaatatttaaacaataaattaattaatactcttgttttatataaatcttgacagttgtattatcaggttattcctatttcaagattaaatattataatgtatacctgattgtgtcagtctatattttttcaaacatatttgcttttgtagatggtcagaagttcccaagtttcatggatgccccacaaattcttaggcatttatagctcatatttattctgagaggtagacaacgaattcatagaacacagtctcataagtcatattttgggggaaatcatctatacgtatgttataggcagggctggtaacacactggacaaaaatgtgttattaaagtatgttttatgctgtatgaaaagtgaagtttatggctaaaatgcttatttgcaagaaaacagcttgtctgcaatcattgcattcttttttttgtactctgagaaaagagccttagctttttggtatgtcagtttcctcatccataaagttggcatatttcttattatttatccctaagacataccttaaaaaatactgtgatgacatataatcattttttttctgaaactaaagatgcattttgaatataaaagagtggcttgtatggattttttttcttcctcttttctgtagtggatgtcatttggagtgctagctgaaatatttatttttttaaaaaactctttaacaagactatctgaatacaaatgtgtttgtcctataaatgcccaaaagtcaagaaataacgaagaatggctgaaattgtcctcccttctaaagagtctttgttccctggaatttctctcatttaaatgatctcagtgcagtaagtgatagccagggcttggcacgactgaagaaattaccaagcttacctttctgctgacttgctgcagatcattctaaccgctcttcctggttatgagttatgatattatgaaagtgtttgtggtaaattcctaagagagaacgaaaactttacccyttacaaaagcaaaatgcggttataaaacaacaggaaaaaaatcaaagtcgattgtccttattctttcttctttagtctctgtcctagtagccancatttattatatgcttactgtatgcctaactctgttataagacccttgttcatgttaactatcataatcttcatacgacatcctatgaagtaagttctgttatcttcattttgtaaataacaaaacagaatcatggaaatattagctaacttgcccatgtcacctgtttaggaaacactgaatctgaattttaaacaaacttttctctttgcagtccagttcattgcacacagttgcaaaaaacatacaaccattcttgacttttcaaactatagagggaactgcatatagttgatttttgtttgttttattgtttacaatatttgagaaggaaagataagttaaaaaaaaaaaaacaccaccaaactttttatttctttaatttgttttttcagagacagggtcttgcttgtcatccaaactggactgcagtggcatgagcatagttcactgcacccttaactttcttgggctcaagcgatcctcccacctcagcctccctagtatctgggactacagatacctactaccatactctgctagtttttctattttttgtagagatgggggttctcactttgttgctcaggttgattccaaactccctggcctcaagcgatccccaatcttggcctctcaaagttctgggattataggtatgagccactgcaccgagcttcaatttttaaaatattctataacctttatatttacaaaccacaataagagttgcttagcataataatatttttctttatttttaaaaattccagcaaaaatcagatactctattcctggaaaagaaaaccatagctaacatttcagggctctatggcattaagtcaggcatttttcacttttaataaatgcccaaagctctgaaggccaatctagttcttccaaaatatgcttcactgtttggttcacagcagttatttcctgttaacagccagatttggtgatttaagcataaattctagtctgctatgacaacataattagcactttccatcattattggaagaaagatacatttttttccctttaagaacacagtattattactttgagtgaccatgaaatcatttgctagaggagcactttgaaaatatattaaaacagctttttttaaaaaaatattagaatgtgttcaacaccattgttcagtgagtgtgtaaaaagaattaactgaaaagcacctgaaaatatgaaaatgtgaatcatagtacagcagctgtatttgcttaatgcagggtcaggcctaggtcagaaagtgagtaagctggccagcagcagataacaacatgaagctcttctaagtacagaatttccacagatcgagggcctttttgtcaagaccagttcaatttgggaagcwagaagcttatttctgatatttggagtttggcttcttagtaaaatttaaagaaataaatatcagtacaaccatcaactctgtgaacacttgacagcaatgctgatttaggggctggaggaagtgggtatgtaaatgagtacattgacasaggactctttatgtaactgcactgtcctaagtgtgctatttatattaccttttaaaatcatcacagtaatcctatacaatatgtaatagaattatcttcattttatggatgaagaaatgaaaacatagcaacctcagtaagtacagaactasgattaaactayggcagagcagatccaggctccatgcttgtaaccaccacagcaggatagataatgacccccaaaggcatcaggtcctaatctctggaatttgtaaatattaaccttatgtggaaaaaggatctttgcagatttggttaagaatcttgagatggagagattttctgacattgcccaggtgggctttaaaggtcatcacaaatgccttgtaagagaaagacaaagggagattgacacagattgaagaagagaatgcagtgtaaccacagaggtagagattagagggatgtagccacaagccaaggaatgccatcagccactggaatctgggagaggcaagtcatggtctctccctaagaamctccagagggagcgcataatcctgctgtccctttgattatggctcagtgaaactgatttcaattatttggcctttagaactacaagtgaatatatttctgttgttttaagccaggaagtttgtggaaatttccactggaaacaaatacagctgctacgcggcatccattttccagcaaattcacatcatggagtaatccacttctaaatagctggtgagcttgaatgagtgagttagcctctcacagttctagttatataatctgtaaagtgcygggcacggtggctcacgcctgtaatcccagcagtttgggaggctgaggcaggcggatcacaaggtcaggagatcaagaccatcctggctggcacggtgaaaccccgtctctactaaaaatacaaaaaaattagccaggcatggtggcgggtgcctgtagtcccagctacwcgggaggctgrggcaggagaatggtgtgaaaccaggaggcagagttttcagtgagcagaggtcgygccactgcactccagcctgggtgacagagcgagactccctctcaaaaaataaataaataaataaataaataaataaataatctgtaaagtgagggggttggactatgtgacttgtaagacattttatagttatatatcataagggaaattgtttccaggccttcagtaaagggaattgccagattattttgggaactgaatttaactcagcatttactaagrcactgctatatacccagcaccaagcaccaagatttatttgatctcaaagtattttttaaattttaawatgtagcattcaaggctgggattaagtttgttttttgaagtaaaactaagcagtgacatganatcggataaaaacatggccataactgtgcaggcacattgcatatcaggagtttctgtgcagtgaactctaggctgaggatgcagattcattgcatcttgcctgttaatccctgctcngctgtggcctcccagagtcctgtgttggagcagatcctgaagctaaatccagactctggagaaaagaatatcytggtcagttaggtatagacacacgagctggaagggaatgtagtggttccaaatatttgccattcctactctaaagaacaataattcagatcataaccactcttaactgtttcctgctatacctgaaagagcttcaggtttttcttcaaagcaattgtagaaatgacaacatnggttccgaaaagaatgtagagacatttttattctaagtaatcatcaagaattacagaaatgactgcaaagtgtcttttcagccatcaagaagctttttcttttcctaactcaggtgctattggtttacatttattaaaaatgtcagctaatcttctgaagtgcccacatttatggcctaacattccttctgaaagtaggtaaaggagtataagtgaataattataaaatatgaatttatgaaatgttatgtatgcaatcctactaacaaaaacagctttactcaccaacatctcttgttggctttcttggttaagtgtctgacagtcagaagcaaaaggctctggggattttctcttgaggtgagagagaggccacaagaaacattaaggtaacttgacactttcagcattgaactatctggaccattggtctcaaagtagcagtccacaggtgcaatatggcatcccacttttttggtttagtcctcaaaatgttggcccacacaagtattttgataaagttttaagtagctgacaacatatacagttagaaaaaaaaatctcataaaactccayattaccaayttctgttagtcatcagatttggsgtctgtggcccattgagcctgcattcctattggcaccatgcagccggagctaagtaacgagagtaaagaggaagctgattgattggttttgtacccacatctccattaaaagttagaaacaaaagacaacccaggtaggtgtcatgtttcaagaaaaaaaatcttatgcctagctttctcccatttgttacctgaatggcccctggagacatatgaaactcaagtcctgtgctagacaatgtcagccatcagctggtacaaaagtgagctctgggactctgtggacacaccaacacggacccagtaaascaggcatttagagccacngtgcagaagcagatctgcatggctccccacagcctcctacagtgcccacagtgccatgcgtaacttggtgttccataatcaacgaatcaattcatcaaccagtgcttctcagattttagtgttatgcagaaaacacacctgtggagtttgttaaaactgtagattcccagggcccaacctgagtgtggaatctgnagtttaatcaagcacagcagggtaatacctgcatatctctttatgaaacatcaccttcaattattagccctcccaattgctttgtctcacttggttatgtttattttgattagtagtgataacantanatgtatagcctaataaaatttattaatacttcggggaaaaagtagagtgggggattattatcttttgggcacttactatatgctaggcatgtgcttagaattttataggtgacctttcctatataaccctgtgaaattatacccatttataagctgatgaaactaaggcaggaagaggttaagcaatgtgctnaaggtcaaatggatagtcaagtggtagggtcaggacctaaacccagggttttgtatgccaaaaccttgttctcagccacagtgttagcctacccagtggttttcagacctttttgacttacaataaaaaataggttgatatcatgatccactagacacatacccgcatccttacacacagaaacatatgagtgtatatacacaaacacatctataagactatgtatatcttgataacttctgttcattcagtttcacactttttaatgctgggttttaatccactgaatagatgttgtaaccctctcaagggtcataacactcagtttgaaaaacagcaataaacctgaaattccataagaacaataaggaatattagatactatagtttatggaccttatggccaaagtgtgtgtgagaattatgtgtacaaaatttatgcagatgagtaatcacctttcatttcagaactctctgagtaataataaatgtaattataataatttattacatacgttgtgctttataattttccaaacttttcagattcaatatctattttaatattcacaaaacctgatgaagtctaaaaaaagaacaacagtaataatgtaacrtatcatttatgtcttatcattctgtggaatttaaggatttagatttccactagaatagtctattgaagtatacccattgaagaattacttgcttcataatatcagtctatcacatcaccaatattttgttttcttaaaaaaagttattatgtgcttaacgatggatagaaaaaaatattttattctaataaataaatctttctgcataatgaagtacctttggtgagataataaatatttaataaatgtaaatcatttttaaattagaataaaacatgcttatcttcttcaaggcaatagtatccacaacctgcctgcttagctaacacagggagatgcttttgctgatattttctcctagtcttctaaaatcagcagggctcaaaggtggagagatgttagtatgacccatgacaatagagcctccactttcctattataggtcacactcacccttttcagacagtgacaggcaaagttgctcaagagatggcactgggaagaggcaggatgttctgccccttttgtaaatacgcacattggcatgacaggctttcttccacactgttttggataggcattttcctcccctatcctctctgtcccatggagacagacaattagttttgtcaaaataattcttagtgcatttacaatcatcagggcctgaattttcatctgcttttgtggattacattatattactctccaggatttatacaaagaatttgctaatttttttaaataccaaatttctgtaacccacttctctccctagtttctaactcttactcacacctgtagatccaagtgtccaaaaagttctgtgaaagtcgttctgaggagaatattataagctgttgtcttcaaagatgcgtcaactccttgacttttgaaataatttcttctattatttctcttggacacataatggcaaccaagaagtaccttactccacaaaggataagcttttcccccctaaaatgtgtatttaaaatctcagtctgttcagtaataggtccttacagcaaaatcatccttcagaattatctagtaattcattttcatttcgtaaatatggaaactgaaggccagaaaatctgtctcccagtgagtcttcttttctgctaactgcatttttttgtcaaaaagcagagctaatgtttgcagaatgccatgaatcatgtattctgcatcacagctaatttgtagccacagtatattgtgcaaaaaaaaaatcactgaaagcatcaaaattctaccacccaaaaaatgagactttgtatgcacatgtgtgtgtccaaagggactttctttggttatgtataaatggaaaatagaaatctatattgtttcaggtctgattctacatctgctaattggatttcagtgtatggatttattaagccaatattcatgttcttaagtaaacatctctctgaaagcatacatatgacgatagcttttaattggcagaatcaatgactaaattagatgcatgccaagttgactttgcaaaagtaatctaggttattaatgaaaggacttcatacttaattttagtagcagtcttataactaatggaaagaaagcagaatgtagaatcctaaaggtcttccaagggcagaacttcgtcttttttttctgacaggaatggccacattattctgaaccattctgttttacatctaattcccagctgacaagtgttcgtttttcattcttattcattcgtcacccytgtgttcactctgcctgcaaggcaactggcctgccttctatcacatctctccagatgataaaagatatgcttaaaatcttatctaccctcccttcgcagagtagcgaggcagcatgctgaaatgagcggcttctgtgctgcacggccgcgatatatcctatgctcattacacaatctgaaagccagagaggaggttttacggcaggaattaaaagcrtttttcaggaagaagtattgccttgtagggggttaaatgtgagatcattctagaaattagataaaatttacatagagcttaaagccaaacccttaaaataattctgtggtattcagtgatggtttagttaaacctgtctctggaagtagatgcctgtagctgtcgccattctcaattaggaaataagggcctacataaaatgtgcctttatatggcaagaattagaaaactgtgccaaaaattgcaccrtattctaagaagaattacagcatgctgcactcaaacccactgcccgttaatggtgctactaacttctgtcaccttaaaattttggaaaagagtagtagataccattgggacttagaaaacaataccccaaaatgaaggcctcagaagcaaaagttttctctgaccttctcctgccctcctgtctctcagtccattcttccccaagaccagccatggaaaagacaatccctcttcccccgaggcragtcatagaaacccccttagtccaaaaccagccacaaaactgaaaaatattattctaaatttccatcctccattttgtgtaaaaagtgaccataaaaaatttatctaacctaccttgtgtgatcataggtcataagacccccattccagagagggtcctgcctgacacccagatgaaggaaggaatgaatgctcagagaggccaggaagaatctagacccacagtcttgctgggcctctccacttagtctgttaacattaggtcagattcnttttgtccaatcanatttctacatggctgtccagactttgttgaacggaagcataaaaatggacaattatccctggatctttatgtcttcattccaaaggctcccatgtgtacatgttaaataaaatttgtctgtcttctctccaattaatctgccttttgtgacttagttgattttccagtgaaccttcagagggckaaggagaacttttccctccgcccctacagtacccagaatggtcatttccccacttcctggccactcctcatcacarcttggtttctgctcccggtcactcctaaacttcccagaccaatgacttctctcctatgagtacttctgagtccttcactgcatttctcctattgacctccccatttttwaaaattttattttcctcttggctgctctgaygctaacttccttgggttttctcctaccgctttgttcactctatatcattggatgacagcttttcctcttgaatgtcactgtcctcttttttttatgctgcagtctctccctggtgatgccatctgtttccagtgcttcagcgattgcctagttggtgaagcacaagaaatcctaccaggccttcttttccaagccctagacctgtggttctcaactgggggtgacttttccccttaggggacatttggcattgtctgaaggcacttattttgttaaggttgggatggggttctaatggtctctagcaggtagagtccagggatgttgcyaagtatcctgctatgcaaagaacaactgtaccgcaaagaattacccagtccccaaaattaaaagggttgaggtttaggaaccatgatctagactactrtacttttcagtttgaatgtttcatagatatgccaaacctaacatgtaccaaaatgaatttatctttctctctgcttccctgcccatcttgatactatgccactcagtgtttgtaccaagttaacaatgcagtagctgagaatataacattatccttgccttctggcrctctccaaatacctacatcttcttcaaggtatgatatatttatttctagaattgcttcctcctcttcctgtcctctatcactagctgagttcaggaccccatcatccctcatggtttattcaaatgagtccctaactaacttcaggctcctcaccaccgcctcactccatcagtcactctgatggacacccttgttctctgatcttgctcctttgagggtttgcctttccatagcatgacagaaaggcttttcataagcacacctcagcttacctttctagtcttctttctgtgtcttgtacatcttcatcctaagtacctaataaaatgtctaccatatggagacaatgaataaatgttaaatgaaattgctctatttaaatacatatatgccttactttttcttgttcttagccctcattttgtgatatcttgattaatttaaatcagagtgagtcactatgttatttaatttgagaactcattccagttattatgtctttgcccaaccccacatcaggcagaagtttctcagaatcattttttacaaacaagatatactttgtcaagaacattgaagctcataaatgatattcactgctgctctttttattggtatctggtgtttcatcaaattttatctcagtgcagatcaaaaaaacaagagaagccaccacatcagaagagaaaattcttaatgtttccattggaagagtacaaattaaccaaaagagatgtcgggggatgtgtggggtggcaaaatgtagaaaatccgtatcagcaggttctaaggcagccattgattattatgctgtgaggctccaggtaatttggtcaacatgttttttggaagtaagataatgacatggtttagataactttaaagttatgataactctgtggattccaaatgttcatttcttgttgttgttgttgttgttgttgagatggggtctcactctttcacccaggctggagtacagtggtgcaatcttggctcgctgcaacctccgcctcctgggttcaagcaattcttatgcctcagcttcccgagtagctaggactacaggcccacgccaccatgccaagctaatttttgtatttttagtagagactgggtttcaccatgttggccaggctggtctcaaactcctgacctcaggtgattcacctgccttggcctcccaaagtactgggattacaggcataagccactgtgcctggccccaaatgttcatttctacaatatattcaatgtcttgacaatcaaattagaagcatttttctgatagaaattctatcacatttggaggtctcttgtcttgcctcagaccctcatagatctatgattttctcacaacctttataatcttgagggttttcttctgctgagaaattcaacaatatggcaaatgtgtaacaatgcagtcctttctcagtgcatttttttccaggtgctttctggtagagctctattagggatataccttgcgagcaggggtcacaacccctgggctgagaactggtactggtccgtggtctgttaggagctggtcgcacagcaggaggtgagcaggctagtgagcattaacacctgagctctgcctcctgtcagatcagtggrggcattagattctcacgggagcatgaaccctatgtgaactacagatgcgaaggatataggttgcacacttcttatgagaatcaaactaatgtctgatgatctgaggtggaacagtttcatcccaaagccatcccccccatgccccgccccagcagtcagtggaaaaattatctgccatgaaaccagtccctagtgtcaaaaaggttagggaccactgctctagagtcttcaggtttccactcgctagttcaatccactgcaatgctgctttcagattcttatgtctttatcagggacctgggataacagaacagaggcattaattttttattaaaattcactgggtaaaattctaataactctttaatggaaggaactgaactgtacatgcatgaaataaaatttttgtaggcattttaaaaaaatgctgcttcaaagttctatgattaaattaattttctaactttagaaattagactaaatgtatatagagtttaaagccaaaccattaaaacaaaataattatatggtattcagggatgatttagttaaacctatctcttgaagtatgtgcctctgatgtgtttaaaatgacaaactggcttctaacatttttgtgcccatctaacaacagtttgtaaaactcagctgcatactcctgtatcaactatatctatataaatacataattagatgcctgggatatgtgagcagaaatgactagtcttctaattaaagaatggccatatgattaaatgtagtgatatcttgggactgttctcaattctcttttctctgccttgtacttgagacacctgaagaagttatgtttcttccttatagattccagcattctgttttccactttgaaatggaaactcacttagagtattaatcaaaagattccagagttactggagcttcagtagtatccattgtgagaaaagaggaaaatatgtatatacataagggaatctgtaggcataagaatcaagagaatggggttcttttgatttaaaactgtgatcatcataattgatgatcaaaaaatcctaacaaaaagcaattaatgaactttattaattgttaaaataaggactgccaaaggcttccattgaagtttaaagtaggaacagttcataacctctgaatttcacaatttattccacataatatagtcaccagattatagtaaagtgctaacaacatgtggttaaacaaaaatgcaagtccaggcaccatggctcacacctgtagacccagcactttgggaggctgaggtgggaggatcacttgaagtcaggagtttgagaccagcctgggaaacatagtgagactctatctctacaaaaaatttttttaaaaaaatagccaagcatgctagcatgcacctgtagtcccagccactcagaaggctgaggcaggaggatsgcttgagcccaggagttcaaaactacagtgagctgtgatcacaccactgcactccagcctgggacacagagtgagaccctgtctcaaaaaaaaaaagaaaaaagaaagaaaaaaaagcacagataaaatactaagccagaaaattttttgtactctctgtaaatgagaaaatgttgtttaattttgacatgtattttgtcacttttacgttccagatctacggaagacatttgagcaggaacccctaggaaaggaagtgtctttggaacaggaagtcttactccagtgtcgaccacctgaagggatcccagtggctgaggtgaataacaacaattctttgcatttagcaattggcactaagttattctaacagaggcctaatccatggctaatggtgcagtgaattagggtatggcatgatgaatggttggtaatagagtcctaactgcctgctgctggcaaaatagattgattgggaactgattaatgacttgggagtcaattagaatgccccattggacaaagccacaggcagcttggtttagttttgtcattctctttcaagaaatcagaaatactgctttattttgtctggcacttatcatagagagatggtatgacttaacaatgtgccatcaattttattattgttcttgctgatatgcraaaaatgtgagtgtaagaagagagtgtgtttttctgtgtctgtgagcctgtgcaccttacatatgtattttccattccatgatgaagtcatagacatacctaaaagccatgcccacacaccttgcataaaaacacattttaggagtaanaggtgtcaattagtttcatcctataaactttccatcaagtcctacattttccactttttgtttctgctagaacaaagcctattggttgctaatgaagtattacaaatcagatgcataccatgacttttcattagcaacacacaataccatgtcctttgaaaatatctctctttggggaagaggactctgtgacccagaagagattgcaagcactcaccatcatcttagatcacactgttgaggaaaactaatactgtgtctttcatttgttaacaaataaatcctaaactctaaaaacaggttaccctttaaatgattattaggagacatccttatatgcatctgacactattgccctaantgaccccgtgtcctacaagtccaagcacacattaatttgacaagtggcatagctgccagtttggtggtggtccttgttggcctccaaactacactgagtcatttgaaagttttactctctattgcatgtgttgaaagaggcatatttcagttgttgcaattgggacctatatatgggttcaatgtatatgaatttttaaaaattaagccctgaagttgtgcctatctctgaaacggaaaaataatactaatgagactttcaacatagtccataaagcaattaataattaataatgtacttactattttacttctcatagttttccatttttttcaagaagtaaagatggggtcaggtagttagctggtcccctgacaacaagctcaaacatctgattgttcttttaatagtaataataataattaattgaaaatttaggcagagtccttatgaaataaccccatttttctatcacagccattcatatctctatgagtcaatgcaaagaactcaaaggaaattttaatgaaattcctttttttttactttgaaagagagttatttttttnccttaatttggcatctcatgccaattgtatcagagattttgcttgatagtagctatttcattcaacagcatcaaaaccttatctcgcagcactaagacacagtatgatttaatacgactaggaaggagaaaactcttctctattcaatatttcattttgataatgacaatagtgcatatgtcttcttaatggtatttctaaaatattaatgcacacctcctccatgaaaccaccttaaaacccaaaacagatcatgagcaacatgggtatccatggcatcatttttgctcagggcttctaaaaggtaactgatccttgcaaagactttaggtggggggagatcttagtaatttcttcatttttttcagtctccttgacaaagtagttcactttgtcaaggagtaaagattcatgactgcaaactaattggctgtgaattctatttgtatcatcactagggaagagaccaattaaaacttggcaagctcaaaaatcatatacccatttgacattcaaagaactatatttaatatgcatttctttttcattttttaaagtcagaagagagatcaaacatacatgctcaagagcaggctaataaattcctgtgtagattcttttcaacactattaaaatcaccaagatcagaaaactaatgaataccttaacatgacatattacaactgccatttgctcaagaggagcagatacgttaaaaaagaaagggatgaaaggtaacttagtgagttaaaggattatacgaccattttccttctaatataaatgcattcattatttaatatttcatttatttgtttaaagaatcttnaagcataaaaataggataaagtgaaatattgatcttaaaggaaaaccagcaggtaaaactcatgtgttttgtaataattagatcagtcgttgggagatgaggccagactggatttgtgctccttttgtctccaaggcaaatgattccaagaaagagtcaggcaaaatatgttcaatgaacatatggctgattgtttcaattgatctttgttgtataagcatatggctagttctattgaggaagtagtcaggtacattctttgcagaatgtcaggaagcagtaattccttttctctccaaatcaataagtttttcaagaactctagtcttagttttgatataccactttggctacaaataatggcataggcatttctaaggtaataatattttacttcttccctattttggcatcctatagtctccaccatagaatgttttctaattttcttacagaattccaggttcaaacccaaacatcaccattttttactttggccaaagtatttaaatactgtgaaccaaagtatcctcaactataaaggggagataataatagtgtctttgcagaatgtggttgtgaggtttaaatgagataatatatgcaaatcacttagaacatgtcaaaagcactcaagaaacattggtactattgttatattataattttttaattcacacaagaccaaactcaacctcttaaattcaaaattcttactgagtaccttgcccctcttcttggcactgtggggtatgcagaggggaagcttctgtcaccaagattctctcctatgttctctagtcagttgctttggctggagtccacacacgctacaaatgaagacaatattgtgagctttaaaataaggaaatgctctttcaacaacactaccaaataattggttaatgaaactatttatagcaagtcatggtgtactgctgcccttaccctgatgttttgttttgttttgttttgtttgacacggagtcttgctctgtcatccagactggagtgcagtggcgtgatcttggctcactgcaacctccacctcccgggttcaagcaattctcatgcctcagccttctgggtagctggaattacaggcgcacatcaccacgcatggctagtttttgtatttttagtagagacggggtttcactatgttggccaggccgatctcaaactccatgccttaagtgatctgcttgcctcagcctctcaaagtgctgggattacaggtgtgagctaccacgcctggccccttaccctgatctttaaagctactattgttcattcagtccttatcaactcaggacactagaccagcccttatattttctcccaaagaggaaatttagcctgaggctactctttgtaggtcttcttttcagggcccagggaaagagtgtgacaaagtaagtctcagaggaggaagaggccaaccgaggactccttatacttctttaagccctttccaataagaaaacaggggaccctagggctgaagcacaagagtttcagaactctagacttgcctgctccttcgtctgttctccctaaagtcctttctttatatctggggactttattccaaagatttaataactgcatggcttccttagcangagagcagactcttgggggcctagcgctctatcagatataaccctttagccaccgggtcacagggtatccagaaatcccagggagccagccagggcctgcgggtgagggacactcagtaatttagcaacagatacagaactgtttccacatcgaatacctggcatggatgaaccagtgtacctggctaaattgcagcccccacatgccacaattttatatagctctgcctaccgattgtattgaaatttatctgtttactcttcttcttgcctgacaagctcatgatgaaataagaagcaaaaagttttttgttcatgttttatctctaatgccagcaggttataagtcacttagcagattctctaagtatatttaactaaatgacagaaagaggccctgctggatgtgacatggaggcagcacctcaggagatggaaagctctagaaaaagggtgtttctcgtccctgaagatgcaatcctattgagagatcttggtgtgggatgacagactccatcagtctgaaccctgagggcaaggttccaaaccactaggaccaggaaccaaggccactgggagtgggagacacttgagttccaggactataagggaggtgtcaataataatatataaattttcaagtaaaccaggtgaaagaaagaaaaacaaatcccaggaatactctaaaatgatatagctcagtgtttcctttaataacacttttgttaggatcaagccaaaaatgtgattgttttcttccatttctggtgaggcatttgcctttctttcaacagataaaccttccccccatctccctgaagaagcaagaaaattaatacacccatggaactggtgctgggttattccactagcataatagcagcactctatgaaattaatcctctttgctcattttattttatgcctagaaaatgttactgtcacatggagagccagaaatatattccgagatgctttatcagattatctcttttggagagtactaggatcaaaacatcaatggatacaagatttgttggcatggcagaaggagcaaagctgaatttttctctaaaacctgtgatttctttcacctttaacaaggggataattgcttctctaattataattgagctatttctcataggagtttaattggaggaacagggcacaatgttcaacttattgacccagttgtgcttagaaactgtcatcttatttatcaacatttgcatctctaattagcaagtaggaaaatatggggtgaggtgcaaaagaatagattattttactgagtatagtcgtgataaacagggaacagatttttttaagctgatactgacagggcagaaaactggtggcagctggaggctccgccaaatgtgcagcatcaggtggctctccatctaattgattattcatatggctgctgaacactttgtttcatgagtccttcacgtttccttgccattcttccataataggaacttcatattgatgaatttccatgcagctatattgtctccagagtggtgctttacactcttttcaggcaaaagagtttagagaggaaagaagaatctgaatactggtttggagggagatgttgctttcagtgcccagtaattacccattggaattttctgctaccacgtgtgtagctacaagacagagttttggttatgatatgattctcagccttgaagacyggttttcaaaagtattaggttcccttactagcagtcagccttcaagctttgctttggtccaatcaacattcgccaaagtcacctccttattatgatcatcccatactttttggggtgaaaangtatgggaaaaatcccatatttttttctgatatctgcctctaatagttacacacagagatcaccacaagcccagaaacactgtaagccaaattaaaattgcaataagtttaagcaacataaacatgcattttaaagcaaaagaaataacagattttatctgacttattatacatctgtggcttgatttttgcatgtacttagtggttgctttaagcctatagtataaaatgcagatttctaaaaatcatcaattcacttatataagaaagatttactgcagatgcatggtatgccagacatttttctggttgtaggaaatacgagtcagttaagtccctcgaggagaaaaacaataagcaagaatgtaagaaaaatgagtgagatattttcagataattacaagttaaaggaaattacacaaggtcatatgagagagggtgatggttgttggggattgcggatgactttagaattcaaggaaagtctattgaagagacagtaatggagctgagatctgaaggtaaggaaggagctagtcttgaaaagatctgagtaagaaagctccaggtgatgggagcaacaaggacaagtaccctcaggaggaggtgattggttacagggttaaaaaggaggccagtgtgtctgagacccagtgagcaaggaggaaggcaggacgacattcagtcaggaaagagggaacgagggcgcagacttgcagagacggtaagtgatttggagttttctttaaatgcctgaaaagccaatggagacattaaggaattgtcgagacctgacattcacctttaaaagatcattctggttgctgcatggaaaatagattttagaagtgcaagaatggatttagggacacctttatgggtttatttaatgatgaaaatctagaaaatatttagtctttcagaagaaactgaaatgttccatgtggaagttcagcagacccaccagaatgagctttattcagatgacctaagatcaatggttaataaacctcagctgtggccgggcgcggtggctcacgcctgtaatcccagcactttggtaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgaacccaggaggcggagcttgcagtgagccgagatcgcgccactgcactccagcctgggcgacagagcgagactccgtctcaaaaaaaaawaaataaataaaaaataaacctcagctgtgttcgagcacggtctctatctcagtagagattcagcagcaggcaaagacctaacctgtgcccatagtcacagagcaggagggttttcaaaaatttttgttggccttcatttgttcaaaaaaggtttttcttcaataagttcccttgctttgggatttcttccaataatttttatatgcctacacacactatcataaactcattatggagtcagagagagcaaaaagcatgtatttttctacagatggtcagacttagctatagacctgaacacttttaactggtaaataagaagaaaggctgagagttacttatcctgaaaggcaagtttatagtaaaaactggttaggaactagctacagattagtcaatttgttgcccttttgccctgtaaaagttagccttttacggacacttcaatgacattttgttcccttggatggtgttattacatatagtcattttactttaggttttggttattttattttatttggttgttgttggtattagttcatttgtcatcatgcttttatctcctcatagttgaacttaggttttagaagttttcagatttcaagacaagttcacctctgcaatatggcctatgtatgttcaaccctcaaaagcaataagctagacatatgtgcaattaagagagtgtttccccagcaggaaaacaaattccctttcttggcaaatgcctttcctttacagaagtaacaacaactgagcaaaatgccactagtttccacttggtatttttatcctttggctatattttttaccattgtctaaagatataatttcagcttgcttaaagaccaacattttttttaaagcacaaaaatacccagacttgcacaaacctactgaaaggtgcaaagtatatttcacagtggtcaacacagaagtgaatggatacttgtttttttccaaaactgagaagcaaaaatctacaaagtagcctctggtttttagcaagagagaacatccagcataattatccacagtagagaacttttttgattgtttaaagcacctacaagggaaggtgagatacctttcaccagtgggagaaataagaaaataatagtaggacttcaaactccggagcaattagagccaaacctacctgtgaaagtctacagaagagtattagctatcaatgtcttttagaattgtcaaggctttggccaggtacgggggctcacacctgtaatcccagcactttgggagcctgaggcaggtggatcacctgagatcaaaagtttgagaccagcctgaccaacatggtgaaatctcatctctactaaaaaaaatacaaaattagccgggcgtggtggtgcatgcctgtaatcctagctacttgggaggctgaggcaggagaatcacttgaacccaggaggcagaggttgcagtgagctgagattgcaccattgtactccagcctgggcaacaagagtgaaactcggtctcatttaaaaaaaaaaaaaattgtcaaggccttgctattctaactgtggtacatagattatctacatcaacacgatctaggagcttagaatctcagacccagaactcttaatgaaaatcttagcaagatcatcaaaccagtcttcaccaggcacagtggctcataactgtaatctcagcagtttgggaggccaaggcagtaggatcactcgagcctaggagttcaagaccagcctgggcaatgtaagagaaccccaactctacaaaaaataaaaaaataaaaattagccaggcatggcggtgtgtgctactccaggaactgaggtggcaggatcactcgagcctgggaggtcgaagccacagctgcagtgagccgtcatcacaccactgcactccagctggggtaacagagcaagaccctgtctcagaaaacaaacaaacaaacaaaaccactctgcagtactggttctcagaagtggaggcacagtggaatcacctgggaattgttagaatctaccaatgcttatatcccacccagagattctgatttaatagacatgatatatagccaggttatcgagattttttaaagctctccatgtgattctaaaatgcagtttgaaaagctctggtgtaaaggacaaagttaaaacaaacaaatacacaaaaacgtcagatttgtcacttccaaaccagtcagtaaaacttggcagattcccagctactagctaatgctccttggagaagcttggcttggctgagtgtacatttgataatagccccataattgcttttcccatttgtttgattaatgtacctatagacaaggattctaggctaaatctccattcttttaggtgtgcacacagttctcaactctgctatatcattttcaacctgtgctctgacttgatgggcctcagtatgagtttaacagagtaacctttctgatagacgtggagttttctagctaatgcttgctggactcacttttcatgttgggtggcatgtggcagtttccctctgttaattagaacaaatgtgccaattatgttaacgtttctcccgataccaatcagtgaataattagacacaacacatctgtctttcacaggagagtataataagaaaactgcaagatgttttgctctctattattgacatatatgattagacaattccttaaccaatcatagggttaacaagtttgtgtatcagaaggscaaaggatgccaaaagtggtttttggagctgagaacctctcattgttagcatggtcctgaccaaagtccacctatctctgaagtatctctgcaaagaatttaattggtctttccttcctttttaacaacaacaaaacattacattgcccttttggtaaaatgcagggatgttgtttatttatcctgaactaaagaaataaacaagttcttaggtatttgaaacccttaaaaagtcaactttatgtaaaaggttacactaaaagaaatcacaggccgggcgcggtggctcacgcctgtaatcccagcaccttgggaggccgagcgggtggatcacgaggtcaggagatcgagaccacggtgaaaccccgtctctactaaaaaaaatgcaaaaaattaaccgggcgcggtggcgggcgcctgtagtcccagctactccggaggctgaggcagaagaatggcgtgaacctgggaggcggagcttgcagtgagccgagatcgcgccactgcactccagcctgggttacagagcagaactccgtctcaaaaaaaaaaaaaaaaaatcacaaaattcagcctacaggatcatattgaaggtgttataaacatgtaaatcagaatcagattataatttgttataatttctacttatatgtttccatgatatatgaactttggagcattctgattgatggggaaaaaatgattttttttttgtattgttatttactggcatttgcatcccatacttggcaaggctttagaaagagatggggttatagtccaattatttcataatataagcagtgcctgcttgtattgattctaaaagtataaggaagacacttataaaatcaacacattagtcttcttgaagatagtcaaagtgtatcagaagataaagctttttgtttcatttggaattaaaagtctataccttctgccgactatggctcacattcctaaatgcttaatgatattcagctatgtatttgtatcatctaaaggtgcaacatcatcctttcttatcataatgtctatattattgtgattacaaatatattctccctcttgttagaaacagaaaataagacttgaatgtcagattataaatttttttcttactgtgacactaatttgcttattttaaaaaggaacaactcagaaaatacattaaatatattggaaaatagctatgattactactcctagtgtcagacattccaggaaacccccaaatatatgaatcaccctgggacacattccttctgcccagggcattgtgaagaatgcagcactgagggagaggccatagttgtccttttttaaaattatatcactttgccccagatatttgtcttctgttttttaatagtaaaacatgagcatagttataattctaaaacttttgatagcaaaccatgagaaaaattattggaaataagtattgtttggaaaataactgtcttatctaaatggggtcccattatatacactctaaatacaagaacattggaatctgtctttggtagcttcatttttatcatgtttaataataaagatgagaggggagtgaatggaagtgagaaaatgactacggaaagtcaagataaaactggattataacttatcccatatttagtgaccagctataaatggataatccactggaaaatttaatccatatttctctgtctttgctgatactgtaaataaataaaaatttaaactgaagaataaagtatttaggaaagaggtaacagagcatttttgaaatgtgagggttgctgaatgctggagttgctactcaaaagaaattatggaagcctgagccattgaaaaatgatctccttgttttgctacaaaacttctctttccctgacaggacttaggcagccaatggttctgactattataaaatagcagtaacagcgaaactataaaaccatgagtctaggagctataaaaagttgctccttaaatcacactgcacacaagtagggatggcagttttatacaccttttctgggaacataccatatactgtcaatatgctctagtcctaaaaattgtaatcaaattaggaatcattcatattcgttaataaaatcatgttagtattttgagaacactgtaccagactgaaggcgtcagtagaattgaatgacctcactgttggagggatttctaaacactttctccttctactgcaagagctggaattggtccccatgtagaaaggctagagatatgacatctcttctgtacatacactagcagggattgaggctgtaaataagacgacactttcctcactgggagtgttttatgtatgaagactcataaaccactacctatagtcctgtgcagtggtaaattgaaagtcagatttctttcaggtgtttttttggaagatattattaatttggtattatgaatttgaagatatgtacatgtacttcttaatagagacactaagaggcactgaatcatcattgtttaaaatacatttaggtaggtatagctttgtgtagggtcaagttagttctagggaagaggcaattaaattacacttattgactgtctcctaattccaggtgctttcttttcgtatctcatttaaatccccctacaaccccaggagggatgcaccctccatttgtacaggtgaagattatgattctgggagcttatagcctgcgcaaggctgcaagctcaattagtgggagggctgggattcaaagccaactctgcctgactccaaagcactgttttccttataacaaaaaaaagtttttttgactgtatgttttcaaaatttggttcattataatgacacaaattgtctgtgtgatctcatttgataattttcataagctaatcagataaaccccaggcaaatatgtatttggggagaagtcattcatttaaaaagtgtcacatccatctcatcaattttctaaaagtagagaaagcacatttcattgtgttgtgtgttattatttatacacacttcataaataatgaaaatttttagaaatttttgaatggaaaagagaaattcaactccagcatccattaatgattttattattgaagaagaataagactggaggacaaagtttatagagagaaggccaatgtgaggagatattgtgatggattcacacctattgcagtgtgaatcgatcacatcatattcagcacttattatgttttttttgtatttgttgagcatccagatggaattatctaaaaagtaattggaagtatgaatagagcttaagaaaagttgggactgaagataacgatttgtgagttgtcagccttgagagtgaataaagtcactcaaccagtgcatatctcattctcaaacctggctgcacattgaggtcacctgaggagtttttacactgattcttgggccctttgtctgcccaattaaataagaaccattgaaggtggggccccaggcatcaggatggcttaagcgctccccaggtgattctgatgcaggacaaaggaccatgatataaagtagaaggaggagaaaatgagagagagggagatccttgagaaggactatatgaaaatgctggatgttataaaaggaccagtgaaagaggtttgcaaaagaacagataatcaagtggcaggaaagacagcagagggaggcttttcagagggacagtggagctgtttgccatagagaagagaagatgcctttggatttagcaacgagaaaggccactgatcacctttgaaagtgaagtttgagtagagtggggatcaggaatccagacatggctaaatggaagagtgaatgagcaggtgcatagagagggattgggaatatttcactctttcaaggagtttagccactaagggaaagagaagtctgaagcatagctggggagggtgggtgtgtcaggcttaattttgttgttggtttgtttttaggttagaagagatgcaggcatgtttctgtattacttgagactcaaagaaagagcattgggggagttgatatcttttggactattcagtttgttgaaacagacatatgccatctgctcagattaaggaaaattacaaaaatattgagtactttgttggtgacccagggtctcaacaagcctacgaggacaaatattagaaagttaccagtgagtgaatttctgagtgcaagatttcaattgggcatggtcttcagagtggcatgtaaaccttcaagttcatgtcttctgaataaactttctcctttttcctagttgctaacacgtttcagctgaagtaggatgaccctatttttgttggtctttcattgattgttgaataaagactcacaatgtgaagattgttccttacagaattatatcacactgttgctcagcatcctcaccccagagcatattgcctgagaaagaaacaaaccacagtgttcagttatgctgaacactgtgagttctagcatctggaaatgtataaatagatggtgtctttaggacagaatttaatggaaaatgtatccattgaaaatatttttaagtatctcttattttatgctagatatcattcttccctgtttactaaacttttatcttagtttgtaagttatttaaagtaataaggacatgttgtagaataaattatttactatgtgaagaaatcaccataacaccagctcagagttatacagaagtcatcaaaagtgctttgacatatagtatccttttcaaacctcacaagaaccttatgaggaagttaggacagatattacttttcttgttgtagaagtagaaaaataaggttgagtgattttatgtgacttgctgaagagcatagactcagtgaatggcacagctgggtcctatctctaggcttttggccttgagacttgagtgtcttttggcaaaatctcactgggcttctgtgaaagtgcagcataaacacaactgcagaggcatccaggagacatatttggagagttccattcactgacctccaactcccactcctattaccctgttctttagtcttcccagttctcagccttcctcattctcccctggtagaatttcttgcttggtaacagaaccactatcctctcatgcctttgtgaagtgctctttaaaatttttgctagcatatccctaaaagacttaaaaaatacatatctccttgcacattttatgttggtatctaaaaaatattatcaaaaaaattaaatagtgggaaaagatgccatgtctgtgtatattataaacatttgacatctttaaaaagaattgttgacttaaagttatccaatggaatgcagacaccataatgatgtcttactcaacattaccgattaagaaaatgtaagaacaaactcttctttaatagtaggaaaacttgccaggcacaatggctcacacctgtaatcccagcactttgggaggccgaggcaggtggatcaactgaggtcaggagttcgagaccagcctgaccaacatggaggaacccccgtctcyactaaaaatacaaaattagccaggcatgatggcacatgcctgtaatcccagctacttgggaggctgaggcaggagaattgcttgaacccgggaagcagaggttgcggtgggccaagatcacgccattgcactccagcctgggcgacagagtgaaactccatctcaaaaaaaaaaawaatasggaaacttacagtattcctttttctattttaacttatatttctatgccatttcccccataggtttttactctaatagaataaattttaggcataaaaatttccattggtcatcatatttctctgtaataaaaatttgcgtataaactttatctcctttgaccatagggatcaaattgttaattttttttaaaaaacccaaatgtactacaagttttgataaataattacttggcataaagactgaatttttattggaaatacagcttttaataggagaaatgaggttttcatccctgctcgcctgtctaggtagctcatttagcctagtttgaatgctactgctgaaatgaaacaggatgaaatcaattacatttctatctgtyatttataatgaattcaaatactgagaaccttctcatacataagtaagtagraatacgtggacttatgttgtaacagtgtccctcaactctgcacgtcttccaagttacaggtcaaaaattacatagcgatctgtcatcaaaatttatgttcagtgacccatcatttgacatattaggccctccttcagttttgatgaaagcaaagaatttaaaccacctgatttgcaaaaaggatttgtcgcccagttattacagtcccttattttctcaactacaacactaatattcccaattattcccttatctggtgccctagaggtttttacactctcatgtaatatatgatggcaagattttcatgcaaaagatgtctttcttctgaaaagcagagggcaagttcttagagatattagttataagaaggaatgcagactgggcgcagtggctaatgcctgtaatccagcactttgggaggctgaggccggcagatcatgaagtcaggcaatcgagaccatcctggctaacacggtgaaaccccatctctagtaaaaatagaaaaaattagctgggcatygtggcatgcccctgtagtctcagctactcaggaggctgaggtaggagaattgcttgaacccaggaggcagttgttgcagtgagctgagatcgcgccaccgcactccagcctgggcgacagagcgagacaccgtttcaaaaaaaaaaaaaggaattcatatggaagttaaagatatactgtgattcccttaaaaatatttttgtttgtatatctcttagaaatttttgcatagtgctggatacttgaatccagccctatcttgaaatcctagcaccctgaactcctctttatctgcagtgttcccttagttatttatatgccatgttttaggaaactttatatgatttagtttgttatttctccaggtcatttacatgtgaagagatccttctaatagtggaatttaaaattggtctctcttaatgacatttcaagtcattgtcaaaaatttgggggagcaattttggagggtaaggaggctttcctgatgcccctaaaatcaaagcacacccaattctactgctagytctgaaagtaaacctgtattggtcctatgagtgacagggtcatgttgataacagaaagtgtgtccaatgcttcttttctaaggacctctctgcttccctggggacaccagcctgaggacagcctcaacccaagtcctggagtagctaaaatgtatgtgtcttggtgtcccagctttttccagcccctatctcgtaatctgcagcccactctgtcaaggctgaagtctgtagcactgtagttggctcctcctggttcttggttttatggacagaaaagagtccagagctcaggcggtcctgaatttggatctctgctcctttctgagcttataaacctgtgcaagctcttctctgtgagcatcattcttctcatctgaaaattgggaatgcaactacttctttcacaggctgctgtgaggaggaatcactaagtacaaagcacctcgctggggacctggaatgcaccatacaagcttcttgtttttctccttttttacccttgggcaacttctctccattcctcccaactgcttctctgtcgtcccaatttcagcacaaggaaaatgttcttcttttgaactctctctgctccctaaagccaggtcaggattctcatgatttgcattagggagtacaaggtgccctcttcccctcaaggtcacatcccctacttttcctaccctaaagaatggtcattattctttaacacagaatgtgtcccataattttcacttctcctttcccattagaccagcccatctgccccagaatcctttctgtggggagagagaaaagcaaagaagagagctcagggacaactattccatgtgtgtcatcaaagccatggatcgaaggctgctggaggtggcaaggtcaccaagtctgcccagaaagctcagaaggctaaatgaatgtcatccctaatacctgccaccccagtcttaatcagtggtgggagaatgggctcagaactgtttgtttcaattggctgtttaagtttaatggtaaaagactggttaatgataacaatgcatcgtaaaaccttcagaaggaaaggaggctgttttgtggactactttggggtttttttgtttcgttttgcatgtggcaattattcgtttttaaaatctatagtttttaatggaaacaacttgaccaaaaatctgtcacagaattttgagtcccatgaaaacaaagtttaatgaggaaaaagatgggggacagtccctttttggggaccantgcagtcataggaccaacataggtgtactttcagggtggtagggaaagcagaggtggctggaagaaaattccatctcttagggacatggataagggtgttgaagctaatgatgtgtatgccatggtatggggctgagagactgatgtcattaaaagaacaagtagactggcttgaagtactaggagaaaagaaatggaaaacccayaaaagtaaattaaaaattataaaaatatagatggtctaggtaaaaataatagtaatataaattgcctatcatttatgcctcattaccaagtatgatagtgaatatttcttttattttaataacctgtgtttcattaaaaatcttttctacttatttttttaaaactgataatgttttcttatactttagaattagaaaataatttttatgaagattaattaaaatgttaatacctataaagcaaatgcatgctaatgacatctctagaattataaactcatagagtttaaaggaaaatatgtatttagggttagcatacaaacaatattggccaatttaatactcaattacttacatatttgtagtgcaatcttgaagagttataacctaatattgagtggactttgccccacagaaatgccagcgaaggctgaaaggactcaggtgttaaatatttttcttctagtttttagattaacaccatttctcttttattttttagggttgtttggggtttgtctcaccgcttttagtatatccttaactaaatgttaataattattttcaaatacttaactgtatgccagacagtaggtgtcttgtgtattaattcatttagtttttaagaaccttataatgggttctaaaattatcctcattttgtaaatgaggactctaaggcatacagaagataagacacttgcccacgggagacataaacattagctccaaaatcgcagagttcagttttgggcccaagcagttgaaagcagccctcttagctggtactttaggaactgctccttagaataagatggtcgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaataagatggtcgattacacatagtgggactaataacaccaaacaacagcagaataggcaaacaggtcattctaatattgccgtgtaactgtttttagtacctgttaataaaatcccatgcctttataaacacttgagtaaattagttcaaatatgccccaaatcattgaaaggactatagttactgaaccacaaggacagaaattgtttgaacattattttgcatcattgcaaccatgacaacaagtcatggtttatggttgaagtcttttattgttttctgaactccaacctgtttttctttctcttggaatatttttatgtaactaaaaataatttctaactcagaaagactactttcttgtataaatcagtttgttcaatggaaggagtagagaaaagagaagcctcaggttgaaatcaacaaaaagcattgaaatgaccaaaatatgaacagaattcagtggccagaccagagtactgactcctggttaaccaagattagcttacaaataaatagctttgcaacaatataattaactacatactattcaatgcaataaatttctaacacaacaaaagattctgtattgtttcttggaattttatatacagtgtatataaggagactcattgtggaattgtttcacatggaagaatgttagtttagtagtgtgtgttctggaaatactgcatgaaaaggttatatgttttaaattgtatgttatggctcttatattgatttgctgattcagacaatcctttacatgataaacagaattattctcacacactgttttcctttccattcatcttctaagttttattaacgctttatcatttttatctaagccacaatggtaataaatgttgttgcagccatgctggccctgcaaatatcctttttatcaatatccatgttcagttcttaatgctaagataaagctgatccaaaagaagcagaagtcctcagggttatttttaaaaattatttcaaaactttaagagaaaaactcactttgttcatggaaataatgggaatttttagcaacttacctgttgtcaaaatcatgctgtgctagctggattccttgtgagatcagccaaatctgaatcattatcctttctaccctcaattactttctgcctcctgtatccctgctccgtaaatgggtccttaagccagaaatggaagatgagtgccccttgcacccccctttccacataccgtcaactcatatgtcctgtcctctgtcccttccaattattgtctgaatccattttttttttctccctgtctcctatccctatgccacttttttcttttcttttctgttttttggagacagtgtcttgctgtgtcacccaggctggagtgcagtggtgcactcatagctctctatatccttgacctcccaggctaaagccatcctcctgccttagcctcccaagtagctgcaaatacaagcacatgccccatgctctactaatttttgcatgtttcttatagaggtgtggtctcactatgttgtccaggctggttgtaaggacttcagcgctgacactgagtaagagaaggagccattaggagggtttgagatgaggtatagtgtgatggttgatagtgagtgtcaacttgattggattgaaagatacaaagtattgatcctgggtgtgtctgtgagggtgttgccaaaggaaattaacatttgagtcagtgggctgggaaaggcagactcactcttaatctgggtgagcaccatctatctaatcagctgccagcacagccaggataaagcaggcacagaaacataaaaagtctagactggcctagcctcccagcctacatctttctccctcagcagcacatttagcaagcgtcccatgctggacccttcctgacctcaaacatcagactccaaactctttagttttgggacttggattggctctccttgctccttagcttgcagaaggcctatcgtgggactttgtaatcatgtgagttaatacttaataaactcatatatatatatatatatatatttatttagttctgtccctctagacaactctgactcatacatatagtatgctctgacttacagtttatggatcactctaactacagtcttgaaaatagacagttgagttttcagaggaaaagcagaagataagacaaacagtgtttgcaataattcaggaaggaaacgatagtgacttggaccaggaagaggtgggagtgagggaatgagaagtggtccaattcctaatgtgtgctgctctaacattgaatgggctaagaaagaggaaaaaagtggtcaacactaagtcaggcttttgtctaagtaattggaaggctacagttggcattaagtgaggtgcataagactgtgagaggagcaggtttggaaaggcggttcaggaggtcattatcagacaaccaagtggagttgcatgaagacagttggatatacgagtctggagatcagcggtggggtctgggctggagataaatttaggagtcatctgtgtgagactggatgagctcaccaaggaagtgaatatggatagaaaatagaaagcagcagaattccaaggaccgagccacagggacacaaatgttagcctaaggaagctgtgaggcatgaagcaatgtaggacaaaacccaggaaagtgtgctgtccagagaaagcaagtcaggaggaggaagggagtaaccggatcacgtgctgctgtgagtcaagtaagatgagcactaagacctcagcagcacatttagcaaagagaaaggagcagctatggtgaagcagtggaagtgaacacagattagagcgggctcagtggggaattgaagacagcaaatgtaaacaactattccaaggagttttgtaaggcagggcaagcagagaaatataggtggtgggcggggggtgagtagaggcagaaacgggtgagaagggtttttgttctaagttttgaaagctaacagcacatctgcaggctggtggaaatgattcagtatcaagggaaattgaataatttaggagagaaagaagagaattgctgggacttgcccttgaatagaagagcgagactaagatacggagtacaaatccgaggtgacagataggaacacagagagctcccccagtgataagagacagggtgcagatgggggtgaggacacagatagtgggagagccctggaagatgtcttgtgattgtcagttttctcagtgacatagaaatcttggtcatcagctgaaagtgaggctagaaggggaggtagtggagaggagtgtgaaatagttatctaggagaaggagaaagtgaacaatgaaaacataatgtgctttcttggcagaaataaaggcccacttgtgatctgttatgaattttaagatgagcccactctccatggctatttacacccatgttccacctcaagaacacagagcggggtgccgggcatggtggctcacacctgtaatcccagcactttgagaggccaaggcaggcagatcacttgaggtcaggagttcgaaactagcctggccaacatggtgaaaccctatttctactaaaaatacaaaaattagcctggcatggtggtgggcacctgtaatcccagctactcatgaggctaaggcacaggaatcgcttgaactcaggaggtggaggctggctgcagtgagctgagattgtaccactgcacacggtgagactttgtcttaaaaaaaaaaaacaaaaaacaacacacagtggtgttgtaggcaaatagtggccaagtgaatatcttgaagtgacaaagggatgagagcattgacagtataatgcaagaatcatatataaagctagacattggaatttatacttgaaagtctgagaaacaaattggtaaattcaatagattgtaggtgctggtgaaggattattgaattcagtatcttagagtgaataggaaagacagaaaagggtaaaggaaaggataattggaactaagtttatggaggagttgtaattgatgataaggacaagagctaaatcatgcttctcaaactttagtgtggatataaccccctgaagttcttactaggatgcatattttgatttggtaataggtgggcagagccttagattctatatgtctatcaagctcccagtgacactgatgctattgatccagggattgcatttttaagggcaatgatctagactggtatttctcaaccctaacagtaaattacaacccttggggagcttaaaacacactgatgctagaccagtgaattggagtttttgtgggttggatttagcttctctgggttgaatttagaattaatatattacaaatgttttccacattattctattgtgaagcggagttgaaaacctttggcctagaatgtgtgaccttagaggataaggtcattgcaggatggagggtcatggaactgaagggccaagacgttggaagcgtcacctttgtggttattaaactcttcagaaattatgctttagataaagtgactataagcccagaggtctgtaaataactacaaacaaaaaaagagtcaaaattgggtgatataatctggtgacatgagattcaaggcaaagatgtttagagagaacagtctgaaagacacaatgctgagcaagcacagcacttacccatccccagacccagtggcacattggatttgggaaatcaacatccaccccttcagaggacttcagaagaaacaatggcatcagaaagacctagactttagtatgagaaaaacgtaaaggaaacaatctaaaaagagaccaaaatgttagaagattttcatgctgtcttccaggcggtatggaagagtgtcaggacttctggagttggtgatgtgtagcccctggtattacagcacaggaggtgaggggcggcctgcagtcctcactgagcctttcatggagatgattgtctcaaagcagagtgctgtgatatggctggcagcactggggtgttggggactgtggggtcttgtcagaagctggaggagtcctgggcccccctcttcattcccgcagctattttctagctgtaggaccctttgcttcttgaaacaaaggcgtgaaagcaaatccagtatggaaaacagataaaagcagagtttctgtgattcaagtgggagttaagggaggagagcagtgtcccccacaggggtcgtcaaacactgctggggcttctcaggggtcctgaggttcaggtcagaaccactgctccaacacaggcaagagacacccaaggcaaatgtgtaattatgtataatcgagtgaagatcatatacccagcaatcatgtctcttcaaatcttttgtcaaccatgcagattgaacactttcttccatgtaataaactcttcatacaaacaagtggtttctaatatcccttgggacttctttatgttgtttatgattaggataacatcactgttaaactgacatcatttacataggaggaaccgtagttttgaatagctatgggttctccagaggcaaaccatgaaccaaaggtatgaatgtgagtagttttttaagaaagtgcttccaggagaaccctgtaagtgggtgagcaagcaggagaggaaagaagcctagtacaggttgaatgttccttatacagaatgtgtgagaccagaattgttttggacttcaggttttggagtactggcatatacataatgagatatgttgggaatgggacccaagttcaaacatgaaattcatttgtttcatatgcatgttatgcacatagcctgaaggtaactttatataatatgttaaacaattttgtgcctgaaacaaagtttgtgcacactgaaccatcagaaagcaaagggatcactatgtgagtcactcatgtggacaatctatggttgtttggtgtcaccgtcattcccttggggatgctgaataaactgtgtgttacgcacctgcattttgactgcaaccggtcatgaggtcatgtgtgggattttctacttgtggtgtcacgttggtgctcaaaagtttcagattttggagcatttcagattccagatttttggattaggtatgctccatttataatagtgtcaattcaggtccagtctcaaggatgtagctgcagcctcatccctgcaagggacttctggaaagttacagctcagattctgacccaatgagacagaagtcatatttctgcacccattagtcaatggctaatggggctaatggggaagttataaaaaatccttggcaaaaacaatccgtgagcctgagggctgctcttcagagaagagggccaggtatgagtacttgaaagagaagcacactgagcacaaaaattgtagaagggatgcaagaacaactgagactaagggagcctgtccatgctttgtgtgataggaggctttctttagaagggcatagataacctaggtaaagattccactcaaaaactattaatttcaacttttaattatcatcaaagagatttttaacagtataaattgtgccaccttctcccgtgcacttccagcaggatcgtatttccacacatagggtgaaacgttgagaaaatccaggtcaagtgaatatgagtatatatctcagagatactcaggcatatctctgactgaatgtagagtctgtatttggaaacaaaatacatatttaaaacacccactgttgtaaatagattctattctttttctcactaccctgagtgcaaatatcaagaatgtttagctttttcagcatttacatcattacaaatagtttctctactctacaacctcatatgtttctatatttcaggattgttgttgatttttatttttctctataaatgttggcttctcttctaaggattagaggagcattatttgagagtccctgccttaagtgtaatttagagttgtgcaatgtcaaacccactgacagatttagagattaatttctagacgtcttgtggtgctagagtagctccttaaggttttgaaaatggcaacaatattgactccctaccactaaaggttacctgtatccacattcaccctaatgcaaaaggagagtttaagtgtggtaaatatcaacgttgtttgttgttttgctttatggaaaaaactgtgcatagaaaaacaaaaggcaactgccagaataagaagtagtttacctccagaagaacagcttatacaggtatgtttcctctttttattcagcaagtataacatcactattactacattaatattattcacatagaaaaaaatagttcagtagttttaaatggtcatgtcttaaggtcaggttccccaaaagcacaccctgagccaaagatttgawtgttagcattatacaaaaggagggatttgagtatgatttgtaagctattcagattgtattaagaattggtagaaaaacttaaaaaaaaatttggcttagatacatctccaactatgtgttttgctacattttgaaaggtattttcagggatatttaatccatacgtttcagtgaggctacacgtaaaycatccaaatgttattttattacagctatgtgatgtctaaaatgccttttgtgcttttaaaaatagtctttctattcttttctgaaaagcagcaggtaagttgccaagagtaaacaaatcaaatagtgaaaggtttgagttcagtttgaaacgcttatcctattattttttattgggttctgaacttggcagcacacattccccattcgtgcctgcagggcaaagtgaaaacaatttgaacactgtatttcccaactggttcantgacatttgagaataatgtagtacagacagaatcagcatgtttggcaggtgagtgatacttaacatgaccttggaaagttacttcccaccagtttgcagaagttcatggcctggaacaacattgtacatattacaaaacacaggtatcgcttctcggccttttggctaagatcaagtgtacaaaatgcaggttaggacagacagccatcaggggatccatgctgaggatttatctacttttctcatttatctttaggtggaatggttgaaaaatgaagacataattgatcccgttgaagatcggaatttttatattactattgatcacaacctcatcataaagcaggcccgactctctgatactgcaaattacacctgtgttgccaaaaacatygttgccaagaggaaaagtacaactgccactgtcatagtctatggtgagtggcccttcagggtctcaatctagttcatgtttaactgcagtttctcgttggcatcggtaaagctagaagccctttttttaaaatttcatattatttgagacagggtcttgctctgtcacccaggctggcgtgcaatggcatgaccgtagctcactctagcctcaacctcctaggctcaagggatactcccacctcagcatcctctggagtagctggtattacaggcatgtaccaccatgcccggttctagaagctccttttcaatctccatcgctgcttgcttgctgcttttcacaggggcaatgaggtttaattgctttcctcgtactgatatgaaaggataggctcagacaacctcagccctttctcagtcagcttctaggaaagcgaaggaagcctacctgagtgcctgctgcttctataagccctcttctctccagaacctgcaccaccaagatctagattgagttctaaagatgaatatgcttctgtcagcctgctgatgtttctgtggacctaacacctcagtcttatcattgcaaaccctcagaaagcgggagctgacctattcccaaaatacattagagcaattttagcttcttataactcattctactcactccatcagaggtgtgcagagtgaagataagggctgccttatctggccaagtggccctaatcctaacgatatgctaaagtccaacgaagcaacttcttaggaagattcctcccacaccctggtcctttctaagccagctcatctctaaacctatcaattctctggaagtactaagcaatttcataccccattctgatgtggcacatatgcttttatctccctgtgtggtttagcactcagttattttctagtcatttcatgagtagattcatctccccagctaaagttaagctccttgatagactgagagactggtctatatatttacatatttctcacaatgttagacctctaatagttcctcatattattgatgttttactgtctcagaggaaattgaacaacctgggaagtatttagaggttatgctacctccagaatgatgtccccatgcctcaccacctcttagaacataatgaagatttttatcactgttttagtgttaaactccgtgggccttggagtcttactgactgaaggagggggagacccactggcaagtatgtggctcatagtacagtcagtcatgtgtcacttaatgatggggacacattctgagaattgcatcattaggtgatttcatcactgggcaaacatcatagagtgtattcacacaaacctagatggtatagcctactgcacacataggatagatggtatagcctattactcctaggctacaaacctgtatactgtgttactgtacagaatactgtaggaaactgtaacaaaatggtaagcatttatatatctaaacatagaaaaggtgctataaaaataagatatcaaagataaaaaaaaagataaacctgtatagggcacttactatgaatgaagcttgcaggcctggaagttgctctgggtgagtcaatgagggagtagtgagtgaatgggaaggcagaggacattactctacactgctgtagactttatgaacactacacttaggctatagcacatttgtagaaaaagtaaagtaatacaccacaatgttacaacaactatgaggttattaggtgataggaatttctcagctttgttataaccttatggaacagaccattatggtatatgaagtctgtccttgactgaaatgttatggggtacatgataggactgaaggagttaagaatttgtcaccccaaaatatgccacttggcatattgactattttctgcattaaaggtccttgagaaacagcgggctcaagatcactctgctagtcctgtctcttaaaagcaggagaggagattttcagctgaaagatggcttccctataccagaaggaaagtaacattcttatcctcaaggacaggaagttgagaccacggggaagttacgatccagataattctgtatcgatcttattaaaataactcttaatcttcttttagccttaacacataattgactttttcataacttgctactctttgtccaattcaatatataagcattcaactataactgcatctttgggtcttcattttcttaggccatgtaaaagttatattaagtaaatttacatgtttttctcctgttgatttgtgttacaccaatttaattcttaggcccagccaaaaaaaaaatcctaaaagagtggaagtaaaatattgcctaccccacagtaccattcagatggatgtgtgtttatgagaagagaaaccactatgctgttccaaaggatgaatgtagtgctgctttaaaaatgtcattttaattacaggaaaaatggcacaaaaattttttgatcctctgattaccctgaggtttaatttcctagtccagataatggctgtgttgaattgtatgcaattgcctttcttaaatcacaataaaatgttttcttcttcttatctctttttaaactgcctgaaagacttgattaacaacatttgaaatgcaagaaagaaatggggcacaatcacagcatgtgccagtcataaataactaatgaaggcagactatatatagttgtattatatagatgtttaatgcacatgcaaatctcttcctatgtatattatgctttcaatatccataaatacaatgaatgtgttgtctttaggaaggatcaaacgcaagtaacttagtatttagaattaaggaaatagctttggactggggtcaggaatattgggtcataggagtatttctgtcactacctgatcttcagagggtcttttaaccaggattctctgagcccttgcctccttctctgtaaatgaagggayaaacctacgatcttcaaagactttttcatctctgaaaatttctgattattcatttctcattaaaatcccagcagaacagtacatatatcctaaaccccaaatatcagcttgccagtatgctagtaagcagtttatacagacaattccatggcagggaattttgtaaacttgagcaggttaagttgctttttggaacactcactgaaaccctacctatctaccatctgcttgtcctttacattaactcctaaaataacttgtccaagcctcataggttggactcaccagaactccatagaaaacatatatatctaaccagtatttcatatttagcaactgttttatatattttttgttaatgtaatttttagattgcaaatatacatccattaaagaaaatttggaatacagaaaaggtcaaagaagaaaatacctatacctataattctgccacccagagatagcatttaaacaaaaattatatgtatactacttgaattttctttcttttttttttatttttttatttgagacagggtttcactgtcgcccaggctagggtgcagtggcgcaatcttggctcctgtaacttctgtctcctgagttcaaatgatcctccctcctcagcctcccaagtacctgggactacaggcatgtgccatcacacctggttaatttttgtattttctgtagagatgaaggctagtctcaaactcctagactcaagcaatctgcccatcttggcctcccaaagtactgggattataggcatgagccactgcacctggcatatactaccagtastttatatgtatacataagatttaaaaataagcattatacattgttatattatacatcttttataatttaaaatgtataaatacatattaagtattgtatacatattatataaaattatatacatatacattatgcataatgtatccataaacattacttttatttaaaacatactgaaacattcatgtattatttatttatttggagagagggtctcactctgttgcccaggctggagtgtagtgatgtgatcatagctcactgcagcctctactcctgggctcaagggatccttctgccccagcctcctgagtaactgggtctatatacacatgctgacatgacctgctaatttttttttttaatttttgtggagctagggtgttgctatgttgcccaggctggtcttgaactcttggtctcaagcaatactctctccttggcttcccaaagtgcttgggttacaagcatgagccactgcacccagcctcatgaattattaaatagccttctacagtatcacttttaatggctgtccaggagtccattacatgaacatatgtggctggctttgccattgtcttgtttttgaacattacagttgtttccaattattcatctttatattaaataaagttgctgtaaaaaatgtttctgtctgtaaatataacattcatgattattccctattgtataggtttctagaaaacaaaatattgggcaaatgctgtgcacatataaggtttgtgttacttgaatggctaatacacttctttagtrtcaggaaacagatgcatatactagttgtattatattttagctacaaggaaataattttgttagaaattgtttaattacaatattgtacagactcacattattgaagtattaaaaatatatatcaaagtattttctaaagagaggtctgcagaactgaatagtgtgcagtcttacggtgtaggttttacaatcacatatgctgacagctccatcagacatcataattggcctttatacacaaagtaagtgtttatttcaatatcaactaatcgccaagtaactcaaatagccagtcaatttgtttataaccccagtactgtaagattttattttttaaccaggttcactggtttgtgcaagtgaataaaaatccttaaaacgttgtaaagtttacatatgcttaaaaaatcaatcttttttttaaggctaaattattttattctgttcccatgctatagattgacttgcaggcttttcatagagatgtaaacatttattatttgagacgagctgtcaaaagtaattttggagcttgactaggtgaggagataggtgtattttttaagaacactggccaaagaaaagagaacacatacagtcctatttatttttctgagtaggtgagtaaatcttgacaaacttttttttttctctgtctatacaataaaactttggataaaatgaggtccatggtctcttctggctttgaaattttggatttttataatggtcgcttggaaaaataactctttgtttacatattgtrtctgttttgtgtgtccatgtgtgttgtgcatgcacacatgtttaatccactttttactgtttgcctcctttcagtcaacggtggctggtccacctggacrgagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccaggtaaataaaccagtcctctcattccaagtatctcctattattcaagaaacatgcttttagagaatagatacacagactttattcttgatctgaatgtgtgatgaacgttatttaaatccatcctactcactgtttacattgctgggaaatcaagtattttcctccaaaagaatacttaactttgttaccaaaacatgcaaaattgtacaaaacaggagattaaacactactggatataatccctttatattattcaacaaaactgctggggccaagattgcagattttataattcaaaggatttgaatggcactggaagccacacattttaggaataacaatccttgatcttcagaaaaccgtagaaattaattggaactgaaatttagaaaatgttttagatggaaatattttatatttggtgtcagtttctggtgaagggcaaatacaacatttgaaatgaattataaggaatgcaaagttttttggtacttgggataatggattctgaaactacaatgcagtcagttcttygttatctgtaaatgttggtcatctatttttttgttatttgctgtagtacctacagcargagtgcatgcatctctccacctcttagcatctttctgtactatctcatattgctaccagctcttatccctaggtaaatcgaagataatatttgccaaaagcaaaaacaaaaccctttaaaatgcctcgttatacaatatattccaaagctaagctaaaattttgaaataatccataaatttactgcactcattggagtagctattgtgttttcaattttattgttcagatacacagcctccttacttctcctttttgcctaatttggtcatgtttatcctttaacctttatcttttaacctttctcagagatgggctggacaaatgaactggagagatatacataatctacactttacattcccaagtgttgatttccaaatgtcagagcagtytcccacagtgagccctttgagagcttttatttatgaaacaaattttgacacttagctagcttaaaatttcagattttgttttataggagctgactcccacaattaaaaatgcactgatcaattagagttgaaatagaaatgtgtgtgtgtgtgtgtcagtgttttggtacactggattggtgcaggtcaaagcaaatgtttttgctctaagtagttgggacttgcttatacagccagttctgtatgactgaaatattaatgcttttctcatttttcatgtgggtatgwttataaccatatccacattatacacaatatatttacataataatttgaatatgaaatcacttagatttctcaaactatgtagactattaaaatgatataatttttactaatatgtagatataaaaggttaaggtgttcaagaaatgatgtttagcattgttttacattgaatccttgatcatcataattatatatttcagggaaaattaatattttaaagctcttatttcaatatttttatcctatttttgtgagaagcttaagctgcattttgaagtgtgattgaaatttactatatcttttttcaaactgagacttaagttgtgtgcttttaaaatagagatatctaagttcattatctttgaagttgctgacaagccagccaccaaaattaggaagaaagtaagtcagttctaaatgactgaatcacaagaaatattagggacttacctaaaattttttaataaaaatagaaacagaaacatcatcaaataataaatgaaaaataatagtgttttcatgaaaacattacaggtttcagcagaatcaagcaggccagatgaaaaaagtaaaataaaaagactatataaaatgcagttgaaagagaagagataaatagatatataccaactggatgaatgaatggaaggttggatagatttcttctccaccgtaccaacctcttctctgaattctcacatgagcttactttcactgtccacatggccctaggaatgaaggaatcctggatccaaagagagccctcctaattttcaatacaaaacccagaagctcccccattaataggaaaagggaaaccatcatggcctacttttacatagctcctggtgacaactttggattttgtatgtctcagtcagcctcccttggcttggtcaatgagaaagcactcacacactctataggaaaagctcaccaaacccaaatgatgtagaacatgcagttcccagcaattgaaatgaatacagtgcttctcagtagggcatgcttgttcttgttttgttttgttgtattatatttgagctctgctccatcccttaagcagctgcctctccctctgacctcctgctgcattttttccatggcagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagagtaagtcaatttaagcaaactgcagacattgagggggctggagattgaaccatttggagttttttaaggaaacattagaaataaagaattctttcaacaacaataaaatgcaataacatagcaatattctagcttgctctcaaaattggaaaaagcgaattttccaggaaccagaataaaaagtaactatgtccggctaacaaatggcatgcaatattgctttttcatgagcaagggttgattcwatcacttatatggaagggaaccattacttagttttatcagaaagcacaaaagagcactctaaactcctcacagagtcaaaacaagacttcyaaaatgtaagccgtttattcttaattcatggcaggtacctaacgaaaatgtccatggagtgtaaaatagatgtaaagatgacaaacatttctgtaggtagatttaccttagaacgaatgtttagtgagaacatctctgcaacctcttgaaaattctgggtttgtattagaaattataatgcgggtatgatttagtttatttaaaggaaataaatattgataaagcatacatttttaaaatgagtgccgaagattggctcaggaatgtaatgggtgctataagctagatattctccatttttttcacgtctttgttctttagattttcttaattaagtggtagtttgatttcatacttgcaaactctgacccctttattgaggagccctcagatgtacacagtttactatctcttttcatgaccataaattgaggtattaagaattattctgaaatcatacctattcagattaatggatcaaaaaatgtgctgtctttggatctgaactaatggttgtctagtgttgacatttctcataatacattacacattgctagcagaatacaagcagctgaaggtgtttgtgcaaaggtatttgtacttgtcatttaagaataaaatattttgtttttaccacacttatgaaatcctgtttacttttcagagtctatacacacaggaacctttagaaagatatcttacttaaaatacaaataaacaattatgttgctcacacagaataaaaatccaataggcctcttatttttatgttcagggtacactgcattccccaagaacgggctgctgctgagtgtataaagcacagcttctggtaatgatgtggggcctgccactgtgaacctcacaagtttgtactagaaatgcataaatgaaaatcggctttgctaaccatttatctagaggtacagagtttgtttgggttgaggattaaaatagcaacataccacatacaagttagtctttttaacattttcatcacttagtatttttcctttactctagaacaaactgattcatgcgattgcaaagtagaaatagttggactttttctatctttctgcctttcacgttctttctctctcaatgtactatttcaatcttgggtgatttaatgcctactacttccattgtgcatatttacaaatcctcagaacaacctctttaacaaggaatacaatgcsacgagacagaaccttttattagtcatagaaaatgtcacattttaaattatgacaaatacaaacatgatatattcaaactaagactttcatgacatagcaaccccttagcttctagatcatttcttaggcattcatagaattttttccttatgattggatatttgccagtaatgatggcatgaagtgtgtgtctattgacagggaagaggaatgaggctataggaggagattttttagttgtttgtttgtttgtgtttgtgtttgtttttgtttgtatttttatcacgtctcttgtttgatggaaacattttgctgttygggttaaaatcattccatttaaagctatttatttctgcagctctgatttgctatagtaacaatccctactaagtcaataaactctttcatctgccctcctgtatccactccagtccaacagagaattgtagtctatatcactattgatttcctcagtgataaaaccacagagatattctgcactgtgtaattacagtattttacagtgaaagctatagtttctgtttaccagttagtttagtgtatctgggacagcattactgccaaagtcttgtaaaaaaataatattgtttggccattattttggaaaacaaaggcttctaacagtgaaagtgcaaagttcgcaagagggacaaggtcagtattaagaaaaagaatgggngtagaaaagatagccagaaagttgtaatcagcaattaggaattatcatttaatatttatttcctttgggagaattagtgtctggaatgcattaataaatagtccttcaatgatatcacaatttatctcaaaataaagctagtctactttcagtgaaccaggtaagaactacaacctctgaatctattcaaaattgtatacaaataattctgatataaatgtaggtgtactgctagataggagaaattcagagttcataatggatgttagtaggattcagagttacctagataatgtagcataatattttttcaaaagctaacttggtacttaagaggaatacaatgtgaaatatatagaaaatattactgttgatatttatttgttaatttgttcaaaacgaattcagatatatttccttgttaagcrcttaatacaaacacctttgactgaaaatatattaaaatgttggataaaatattgcaaacttagtagagacatacatgtgcatgcagaaagagagagagagaaaatacgtggtccaaaagaaagaaattagagaaatcctcaaatgccaaaaatgaagctgcaactccaagctagagaggtaacggtgtgagtggacaccaatataaccaggagcggggagctggatatggacatgggtcccggggactggaaatcagggtttcagttttggcacagagaagaagtcctggctttgtgagacctagacttggaaataagaaccctaaagaaagctgaaactcacaaatgcctgacctacccacaagaaacaactataacatttttgcccaccrgccaagggaagacatagaaaaaagtggtaggaaaagggaaatgaagacttcatttaaataaaacccatagtaaaaccataacctcaccctagctctggtatggaatctaagatacagtgctagaagcaaaacacgaaagatgtataattaagcttctaggacaccagcagagcaaacagcaagccactatctaagtttcctttcataactaagttcattagtctaagacaaaaataagccacacctgtcaataagcttacaatacaaagttcccaatcacccaagaaaattgtccactgtaagggagagtcagcaataataaatgagttagcagtctactaacatgaactcatagagcaatctgaaggaaactatagagtaaagtagatgtaaaaagacaaaccntatttttaaaaggaacataagcacaaatgaaataacagaatattgttaaaaagacagatttggagaaaaaaacaaatggaatgtctagagaggaaggcataatgattgaaatttaaaactcattggaagatgaaaaatcagatacagctttagataaagctgaagagaaaatttataaactggaatgtagatcttatgaaacttctcacaatacagggaagttttgttaatacataagtgaatatgtaaaagagagaataaaactaatggaggatagaatgagaaaatccaacatttacygaataaaagaacaaaatttaaaagattttcaggtaatcaagatagagaggatttattactcataaaccttactgagtaaactactgaaaatgaaaaacaacaattggttccttaaaataagatgagaccaattgaggagmagctgaaaataagatggagctaaatggtagacaatattaacatggaatatgggaaggtgcaaactaagttaaaaatttccattttctatatattgctcaggaaaagaatagtaatggtatttacattagacttccttgattccactgttatagctaaaatgttaagacttgagtacacacataaaaattgaatgcataaattcaaaataaaaattttaagggtaggaaattggcaaaaggaaaactagtaaattaaaacaataaatgagatggtggaaataaagctacatatatcagggatcataatgtaaatgaattwaactcacctgtaaaaggaaatccaaaattgtagaaaaaaactcagttttattctgtttatgagtcacatacttaaatcataattataggaaaagattgaaagttaagaaatggaacttacagtattgttgagtatgtaggtatgtatgtatgtatgtatgtatttatttagagacggagtcttgctctgtcgccaggctggagtgcagttgcactcggctcactgcaacctctgacttcctggttcaagtgattctcctgcctcagcctcctgagtagctgggattacaggcacacaccaccacacccagctaatttttgtatttttagtagagacagggttttaccatgttggccaggatggtctagatctcctgatctcgtcatctgccgcgtcggcttcccaaagcaggattacaggcgtgagccactgcgccgggtctgttcagtatttattttaacatgtccaattaatggcttttactatctgattgggctattctttattcaattccatttcccattatacctaagtaatatatattagagatcatttttgactcatagtttgaatatagagttttattatgggctttatagtttttagaatgcttaatttcaactgaaaaattaatcaaaagttttctaaattgtttaccagtttgatagtgtttggataagacatgttagaaatctatttctttcctcaaatttgacaccaattgaaatttttcataaaaaggctttgaaggttacttataaaactaatgaatactttaaagatataataatgctaaatgttaaacaaatgtgtagttaagtggaaacttttgtactttgctaatgggaataaaaatttttatggggaagcaatttgacaatataagtcaagagttttaaagttatcataccctttgacccaataattctacttgaatgcataagttttaagtaattagtatgaatagctaaaaatatatacagtcagccctctgtatcagtgagttgcacatctgtggattcaaccaagtgcaggtcaaaaatatttttaaaaacaataaaaaaatacaacaattaaaaataaaatgttaaaatacagtataacaatttatttaacatttaaattgtattaggtattataaccaacctagagatggtttaaagtatacatgaggatgtgcataggttacatgcaaatactatgccattttacataagggacttgagcaatctctgattttggtgtcgatggtcaggggtggttctggaatcaatcctccttggatactgaggagcagctgtatgccaactatgtctatattctttgttattgtaaaaaatgtaaaacccaaaagtctaatattaggatgatggttaagtaacacatagtacttccattaaatggaacatcatttatgatgtccgctaaaatatttatgaggttttaacatggaaaagcagaatatggatttatatatgtatttagtgataagcgtgtaaaggtatgcttagtaaaagatgaatgaaacttatgaattttctgggataatgagattacaagtattttttttctttttctatatgctttctattttttttttcttttatttatttattttttattattatactttaagttctagggcacatgttcacaacatgcaggtttgttacacatgtatacatgtgccacgttcgtgtgctgcacccattaactcgtcatttacattaggtatatctcctaatgctatccctccccactcccccaactgctcaacaggccccggtgtgtgatgtcccccttcctgtgtccaagtgttctcatcgttcaattcccacctgtgagtgagaacatgcgatgtttggttttttgtccttgcgatagtttgctgagaatgatggtttccagcttcatccatgtccctacaaaggacatgaactcatcctttttatggctgcatagtattccatggtgtataygtgccacattttcttaatccagtctatcattgttggacatttgggttggttccagttctttgctattgtgaatagtgctgcaataaacatatatgtgcatgtgtctttatagcagcatgatttataatcctttgggtatatacccagtaatgggatggttgggtcaaatggtatttctagttctagatccctgaggaatcgccacactgtcttccacaatggttgaaccagtttacagtcctaccaacactgtaaaagtgttcctatttctccacatcctctccagcacctgttgtttcctgactttttaatgatcaccattctaactggtgtgagatgatatctcattgtggttttgatttgcatttctctgatggccagtgatgatcattttttcatgtgtcttttggctgcataaatgtcttcttttgagaagtgtctgttcatatcctttgcccactcaaaaacaagaaacggggaaaggattcccgatttaacaaatggtgctgggaaaactggctagccatatgtagaaagctgaaactggatcccttccttacaccttatacaaaaattaattcaagatggattaaagactgcaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggtaacctacagaatgggagaaaatttttgcaatccactcatctgacaaagggctaatatccagaatctacaatgaactcaaacaaatttacaagaaaaaaacaaacaaccctatatgctttctattctatacattatttatgcttagtattccattatgtttataataataaatgacattttttaaaaagaactgttgaggataggccacagcatggtcttggaagcatggctctctgaatttaagaactagcaatgtcactgactttggtcacattgattcaaattagattaccaaaaaagtatttgcataaaatacttgtataaaaccctagttgtatgaaaccctagggtgcaagacttatagccagtaacacaagtattttgaagacatggggatttggaactgaattatagttttacattatttcccagttgcctatcacatacagatatatagacacatatctgtccttgcaatcataatttaaactcttatactgtgtgataacttggattcattatgtgatattgtgtaatttcatttgtgaaatataatcgtggtcttaaacaatttcagaagctctattacatttttataccactcatacatagtagttcatattgtaagtactgtgtaacatataatatatatgtattacactggataaagtctcactggcctgaaaaagtagttcctacgctggagataatcaatgccttggtgccttcaaattaagacctttacaaaattgatgttatttcaccagaatgcattactaaagagtaattagaagccatcagaatcacttaaggtgccagaaataacttggacattttgggttcataagcacatacttaattgttttcaaaactacattttaaaaagtggagttctgtggtacactaaatgacatggattgcattgaataagaaaggtaagttaaatgacgagttaattgggtgcagcacacgaacgtggcacatgtatacatatgtaactaacctgcaagttgtgcacatgtaacctaaaacttaaagtataataaaaaaaaggtaagcgatttggcgtgtttgttgctattgaaaataattgaaaatatatgtctgatctaaaaaaacttaacattaataacaaatatcagtttttacttaataatactacagaatcagtattggaagaccagttgtactgtgtacatattaaaatacttaggtttctttatatcatccctaaactgatgtgaaagcagccaccccccacattttacaatatatttttgaaataggctttacattaaatggttatgacaagagagagagacacagagaacaggacacatagaaagatacagaagaagcagaaaacacttaagaaatctcaaaaaatgctaagacaataagcatattatatttaccttttaagttgaaatacaattgtattactgagacctgataacttttaacttttataatcttttctttccttttttttttaaatgtgatggagtctcattctgttgcccaggctggagtgcagtggcgccattctggctcactgcaaccttctgcctcctgggtttaagcaattctcctgcctcagcctcctgagtagttgggattacaggcattcgccaccctacccacctaatttttgtatttttaatagagatggggtttcaccatttggccaggctggtctcgaactcctgacctcaagtgatctgcccacctcagcctcccaaagtgctgagattacaggcctgagccaccacatggggcctaacttttataatmtttataatgaatttttagtaagatctatttgtcatggatagcatataatatgaatagtttaatcactgcttacttcttccttttgaaaatagcaattcaaatactatatatatggcctagtccagaaatgcaaatttatatatatatttatcaatacagtagattggattattaagttactgcaaccattcctatagattttagtttttattctctttgtaagtttggagtttctcatagggatttttaacagttcaaatctgaacttagaattactccttgctgaagacggttcatgccacagtagacaaatttaaaattgtaatttactaacaagaactgcttggaattgtgtctgcatcagtgaacttcctgactttgggaaattaaaatgttaggcattctgcaaagttagcactttcaactcattaaaaaaattacacgtcacacagctcttctattaattctcagaagtacagaggaagtggcagagctctccatgtgtaaactgtggtgtggacacactgcataccagggcccccagaagcccaggtggatttaatgtggggaagtaatttaccttacaaatactcatttcttgactttagaatgatacgtttataaccgcctgtggtaggcatttgagaaggtgctagtcatttcccagtgaaattcttgtcaacacagcagtttgataggaaagcataattgtgagtggtagacagtgagagcttttatccatagttggaagaagttgatgtcatagctgtgtttgtgtagttcttgatatgtgtagcgtcccagctggcaaataaatattctgtacatggcctgcctgcccaacacaatgctacacagtgtccggtataataagtgtggtttgcttttgttttcctttctggtaaaacattttcctggttttgaaagcagggatgtggttagaaactttagcctacagaagcctaatgaacacctacggagcaccaaacaggttagaaaacaaatgcaaggtctttagattctaggtggaaagggacctctgaggggatcaagaaaggtgccaccaagccagcaactacagcaaagcatgggctccttcgagatcacgggggtgcaggtccagggctgcaagctcaattttcttcttgctagaaatctagcagataggttcatgtattctagaagtcagtcaccttatacatcaggactcttcatcattttactttttctatcaggtgtctttactaccatggaggggttctggtatcattgcttttggatttataatttatttttcttttctaagaagcattgacggggatagagtccattatataatataacacttatataaaacatatataatatgttttataatatagtttacataatatagtttatgtaatatattatagtttatataacacttatataaaacataatatagtttatataacacatataaaaacacttgagtagctgatctatgagtttgatattaatgaacttagtttaaatttcaggcatttatgcttcacctactgtgaatcatgagataagacatttacatcctgggaygttaattatctactattcattttcagaagggtgtggctggtcactgtaaggaacagggctatgaaccagcttagtgaggtgtggccattgtcctcagcaggctggagcagtaaattaccatggcaatttagataactgacatcagtgataagcaaatgttctttttaattgttgttgtcatgtcctaggatttatgtattcatttatttggagttccttaagccctatcaataaataaaccctcagaagagtggtaaattataataaatgaccctgggtgtctttgacagacctgacctttgacatcattagtgcagccctgatgggtttgctagataagagctgaccttaaaggataaaagaaaatctggacatgtttattttgaatggcccttgaggttttaataagaacatttgcatcagaacaaatgtaattggggtgaaaaaattgcccatgttttggcttagtgtaaagtaactggcaaaaaagaagaccaagcggccaggtcaaggagaggggattcttctaaggataggatcagaaaatgaggaacaatcttatcaagtagcctagtggacttagagtagataaatattactaaaactaaccaagacctttgtgacctaaaaatagctacttttttagaatatgtttaatgcttttataaatgacattatgtcatatgcataacttgcatcctagccacccccataagatatgaatctatcatctattgtgcttaatccccacagtatcctaaaatctatttacgggtattaaggtcatagaagcagctccatattgaaatgtaatgagtaaacctcaaaggcaagcaggacacctcctaaaactctacctatctcttttttggccaagtatctgatactaatgtaaagacarggttttaatgcccagacacctacatatagactttagagggcataaaaagtaccatatcttatatggtagtttaaagatatttcagatttcattttaattctgtttgctgtccacctaatacattgattttaggccctggcattagttgcttctgaccccagtctactgtgtcagacatgaccaagttaagaaaaaattgaattgagctcaatttaattaatactcaaaaggtagaaaaaaaaccttacaaacagaacttttgttaatcccctaacaatagttctcttttacaaaggaagaaactgaggcatataattgaaacagccctcccaacatccacagatgagtgctggarccaatgtgtgaaggcagatctgtctcatttttaagcctgttctcatgcaggatcttggatgccagaagcaagtggttgtcagcttttattgctttaaaataggcaaaggatgccctatttaatgaatggtgttgggaaaactggccatatgcagaaaactaaaactggaccccttccttacaccttatacaaaaattaactcaagatggattaaagacttaaatgtaagacataaaaccataaaaaccctagaagaaaacctaggcaataccattcaggacataggcatgggcaaagacttcatgactaaaacatcaaaagcaatggcaacaaaagccaaaattgacaaatgggatctaattaaactaaagagcttctgcacagcaaaagaaactatcatcagagtgaacaggcaacctacagaatgggagaaaatttttgcaatctatccatctgacaaagggctaatatccacaatcaacaaggaacttaaacaaatttataagaaaaaaacaaccccatcaaaaagtgggcaaacaataagaacagacatttctcaaaagaagacatttatgcagccaacaaacatgaaaaaaagctcatcatcactggtcattagagaaatgcaaatcgaaaccacaatgagataccatctcacaccagttagaatggtgatcattaaaaagtcagtaaacaggctgggcacagtggctcacacctgtaatcccagcactttgggaggctgaggcaggtggatcacctgaggtcaggagttcgagaccagcctggccaacatggtgaaatccatttctactaaaaatacaaaaaattagttggscatggtggcagacgactgtaatcccagctactcgggaggctgaggcaggagaatcgcttgaacccaggaggtgcaggttgcagtgagccaagatcgtgccactgcactccagcctgggcaatgagagtgaaactccgtctcaaaaaaaaaaaaaaaaaaaaaaaaaaaaagaggaaacaacagattctggggaggatatggagaaataggaatgcttttatactgttggtgggagtgtaaattagttcaaccattgtggaagacagtgtggtgattcctcaaggatctagaaccagaaataccatttgacccaacaatcccattactgggtgtatacacaaaggattataaatcgttctactataaagacacatgcgcacatatgtttattgcagcactgttcacaataacaaagacttggaatcaacccaaatgcccatcaatgatagactgcwtaaagaaaatgtggcacatatacaccatgaaatactatgcagccataaaaaaaggatgagttcatgttttattgcagggacatgaatgaagccggaaaccatcattctcagcaaactaactcaggaacagaaaaccaaacactgcatgttctcactcataagtgggagttgaacaatgagaacacaccaacacagggaggggaacatggaacatcggggcctgtcggggtggggggctaggggagggatagcattaggagaaaacctaatgtagatgacaggttgatgggtgcagcaaaccaccatggcatgtgtatacctatgtaacaaacctgcacattctgcacatgtatctcagaacttgaagtataattaaaaaaaatggaattttcttctgatgtgtagagctcctccaattattgatgtttattccttttttccacatggcatcatttttgagggaaatgatgtttctcctttaaatatttacttatagggttttatgccaaatgcaatgtgattatcatgcattaacaactacatcactctagcaaggctccccagtcacattagagtggaaatgctgaggtttggtacacctctttgcttgccccacacttgwaacagaagacactgtttggaaatttttttcatgtaaaggagacaacctctctatgctatttttggctttataagtgtcatgactataaatgataatatttcaaatggagagatattttacagtccaaatcagcagggttatctcatgcaatcaccaaattacaaattaagccaggtgcctaccaagccctcttctgttatttccttgtctctcctcattcgaatctactaattattgctcacatagtacttaagaaggacggtggaggtgtagcctgagggctgggatccaaccctggctctgctgtttcaccagctttataatgttagacaaatccctttaccactctatactcaaagggttaaattagggagttccaatcaatgatctattttcactccaacatcctgggggtttgcaagtttgtgagaacatagacttggttttgaggatttaaacctggctaatgatgttcagaagttatgacatttctcacatcagaatatttgcttgataattatttatatgaaagtatgtagtatggcataaaaacagtttgaattatttttttaaaaagtagtaataaaaccatgatcattttttgctatctatccatatggcttggaaagaaaaaatttgaaaaggctagaaaaataaaagtagttgctgtttattggggaaatgaagatttacatttggtttctggcattattcttgagactctcaaatataaacccaccagacaggctacatttaggtatattgttgctcagttactgggtcttggctgtgtacttagggataatttgatattacttccttcagtgtaaacaccaaggaaagctctcttgctctctttctttttttacaatacttggacatgggctctgatcttttacaatggttggacatcactaaaaagttcgggcaacctcacctctagtctaaatgatgaccttgtgcaaattagaaaaaagtcattcgttccctaagtcactttactaccagcagccaggaaatggttctatgattaatccaaatctacagtaaacacaaatatgaatgctgccacccagagctggacaatgcaaaattatacattgtcagttttattgacccaaattttagttggtagaatatcaacactttgggtaactttgcaaacatcctttctcacctttgagactctgtctcctcatatgaaaaagattgaatgagacaatctcctgagataatgttttgagcaattatgagatggtcttcaagtaaaaggagcattgcatggactgtttaagacatagcctgctcttgctccagttttcaaatattttttcttcacttaaaggttttctccatatcgaatctcctttagtctgtattcctgcaagtcaggaaaatctatgctttaaaaaataaattttctttaaaaatacaagttacagctgggtgcgatggctcacacctgtaatcccagcactttgggaagccaaggtgggaggattgcttgagcccaggagttcaaaaccagcctgggcaacatagcgagaccccatctctacaaaaaaaattttttaaatagcctgggtgtggtggtgcagatatgtggtcccagctacttgagaggctgagatgggaggattgcttgatcccaagaggtggaggctgcagtgagctatgatcacaccactgcactccagccagcatgacagagcaagaccctatctcgaaataaatatttaaaaaaaaaaaaaaacattgttttaaagtggatataggttataagcagttacccttgaaaaagcactgctcttgaaaaagcagttgctgaggccacactgtacccagggataacaagcctcatacctttccctgaacgccatgcctgttcttgccttctcagtcaaaaagaggtgattttgaaagttgttatcaagggaggtggattttgttctgggccatcctttcatggcaagattgtttctttcattgcaggacattcaatatccttggcctccactcaccaaatgccaaaaaacaaccacctaatccttatgacaaccaaaaaaaaacaccatccctaccccatttccaaacaccctcttgagaaattgcatcactcttggttgagatacctttttaccatcaatttgcactctggccttgaaaatgtgctttggaaacataccaccatatcttttgccagaagccacaaaggacaggcataagcctttttacatgaagagagtgcaagagtccttagaagagagcattgcatacggcttctctgaaaaactgggctccctgtctatgtaataactggggaaacaaattcaaacgagtttcctaagatcactcattagataataggctatgttgactctacagataaaatcccttaaggacccagcatcttagtataccttagtaacgtgcatcataattatatcaatgtcattgttggtcatttcttgattactggcaatgtaccagcaccttacaaatctcatttatcctttccacagctctagatgtaagtattcatatccccttacacagattagaaaactgatacttagaaaagtgaagtagttcggcaaagctctcccagctaagtggcagagctaggattcaagctgatgttcatgacactgaaaagcagtgtactggcccatggcctggtgcttttcttagcccaccttactttgaagtagcaggaaagttaactgaaatccctaacttttgaaccaggctgtcggtagcaaccgaaaaacaattattttgcactgtgttccgccggagatgttatttttcattattgctaggactactctcagcagggtcacctcattagctgaagaaaatgttccctgttgttccgtgagagacggatcagatggagaagcataaaaacaaactccagaaagtgattctgtgttcccctcatttaggggatggaacagtaatccccttcttctctgattcccagcctgctaagtgatgttttacttctgtagttgcagaagtgttttgaaaatgatggaaaaagttttacagggatgccttacataactttttatcagtgtttccataacagagtaaattggagtgtcaaacctttggtgagtacacttaatactggtctgttttaaattttcccatgtaggaaaataagagtttggctagattggtcctaattgcctgtgaggaataactaaagtaagtgagactttgtaaaatatttttaaaattttttaaatattaaatattttaatattttagagtgaggcgatatttaatttttttaatattttattttcattcagaacaacctcaaatgcaaacacttcatcagttatattatacacctattgacagatatctcccaagccatgtgttatagaagccatctgtaaaaccctatcaccttgctccatttgacaatccatatctatagaaaccaaagtgatttttttcaaaatgacattcgatcacaggatatgcatttcacttagaataaaatcaaaactcactgtggaggccaggtgcagtgactcgggcctgtaatcccagcattttgggaggctaaggtgggcagatagcttgagcccaggatttcgagaccagtctagccaacatggtgaaaccccgcgtctagtaaaaataccaaaattagccggacatggtggtgcacacctgtaatcccagccactcgggaggctgagacaggagaatcgcttgaacccgggaggcggaggttgcagtgagccgagatcgtgccattgcactccagcctgggtgacagagcaagactcctcatcctggcccaccaggacgtgacctggtgctgcctgtcctctgaccccacctcctccctttcctttcttgcttgctccccaccctctaaccattctgtctttctgtcaggactttcgtatttattgtcgtttctcatcaagcacttgcctcctgatcttaacttggcagattctttctttttttcaagctccaggtcaaatttcatctcaattaaaaaaaaaaaattcttccttaattccctaagttggccatcctgatatctccaaacacattatgttcttttggtttatttttaaaagaacttttttactatttgaaatgatcttattattttgtttacttgcttattttctgttaaacttcagtaaaaacaggaaagtatccccatgtctacaacagaacccagaatataataaggttcaagagtatttgctaaacggatgatgaatgaatgaatgaatgaatgaatgadttccaattctgtgcctggaatgagattgcagtttcagataaataccataaggcacaaaacatttattgagtagtttaaatctacataatatttgtgaaagttgacattcaaatcgaagttacgaagttatattctctattcttggtctgcctatcaagaacaggaattctggtgggaagcagggacaaaaaactcagaactgctttacagggagaaatttcggaccacgtgatacctagctggagataggctttccttttgcaagacgcagctcttctgcttattcaagcaggaccacgctgattcttttctttttattttttgagacagatctcgctctatcacccaggctggagtgcagtggcgcaatctctgctcactgcaatctccgcctcccagtctcaagtgatgctcccacctcagcctcctgagtagccgggatcacaggcacgcgccaccatgcctagctaattttttgtattttgggtagagatgggctttcaccatgttgcccagattgtctcgtactcatgagctcaggcgatccacctgcctcagcatcttaaagttctgggattacagatgtgagccaccatgcccggctgccaggctgattcttaccaaaagtttcaggacgagcatcatagcatttgtaaacatgccttttatactcatttccttgcctcttacctgcaaaaataagtcttttgacattcttctacttaacatcatcacttccaggaagatggcattgtgatctggtctcctctactagcagtgaacttgttttgtgttaagtctttgggttttgaaaatagagcctgtgtatgtcccagatgtccttttattgagttcacagaatacaaatggaaaaattttattaccaggcagtggtgtttaaaaatgaaaatcaaacctaatacatggactcagacaactagaataaggaatataatatttataaaactgagtaggaggttgcaatcattgctctaaaataaggcattaaaaatgaattcagagcaaacctatctgtgctacagcaaagctctctttcattaaggtagcactgcatgtttctccagaattagttcccccaaataggtaaatagcttgtaagaactgagtgttcggcaaactacggaagtgctacctgaggcacgatttagagttgcttttagtattacagctttatagacctttcattttgaaccagttaattgtgaaacttgttttcctctgttttttgcccttgagtattactaggaaggtttaattcacaggcttcttagtcatcttcattttattaatccaaatggtgctgtatcatttgattaattcatatgtagcagaatagtaaatcttggagaactgtggttaccagtataagatatactttaaaactttccataggtttttcatttcaaaaagtttgtgttgcacatattttaagtgacttttccctatcttattccacttcacattattatcattatccatattgcattattattgttagtttccaccttcagaatacactaaaaaggaagagaaataaaatgctagtgctatttctgcatttttctattgagatgaaagtttttatttttcccaatatacaccatttctctgaagccctaaaataaatacccttataacctctaggccctattgattttctaatgatttcaaataaaaagcatccagtttccattgcattgacaaactgttcagtccctaggcaaaacctatcgaactcctattaaatgaagggggcaagaaacaacagaaaatccaaaaagtagatttgagatggagcgggggagaggtggtctcagcttagctcagtaaatgggtacttaacctttgaccaatgatgacaggtcttctttagttctcttagaccaagcacaagctgttatgattaaataaaaaagaaaaaaaaactgtttagagccttactgaatatgtcctgggaattaaagcatatggcagggataaggaaaaaagattttccttatgctaatgacccctgatgtctgaaataaattagatscattagagtttatgctcaataaaagaaagactttaagcactccaaagttagtgactcgagaccagtttttgctctaaaattcaatctgcctgcttattaattcttagtgaggctccagagcagacaggagatgcaaaatcataattttatactgaatcagaattttaaaagaccacaggtttcttttccttttaattaaaccatttttcatgcttcctattttctttccctcattaatttgattttgttcccatttttgtttcatttttttttcttttcaaggtttcatttatcccatttcaactgaacagagaacccagaatgaatatggattttcttgtaagtttgatgtttggattttatgttgctgaataatcatttaacgttattgcccctagttcaagtttacctttcttcggattacagatgtgcacacaggaaataggagcctaatatattctaacatgaaaaataaattagatttttgctgctgaagagaagaaagggtcatttcaagactctgccaactttaaaatctatcagtctaccattcaaagcttgagtcccagtagctgacaaaacatatcatgaaatgtgctgatataagtaaagggcagggttcaaataccaaaacagaaagggttgaaaaaagacagatgggttgagctagaaatcatgaatgttgaataagtaactatgacctggtaaagtaaaacaataagaatttagatataatattctgaccagagttcagaatcctgcagcagtgcctcaaataaaacccaacagagaagtgaagtaagtactttgaaagcagcactcacccaatcacgagtatttgtgatatcactggttttctgaagaaaatttgctaacattgayttgattgatgggaaagtgaatattctggaaatgttgggaagaaaattatttttaaaagaaagcaaaatccttttggatacattacatttaaacacaaaatgccaaaagagatagagcaattcccaataaagaattcatttacactgctaatatgtgaaagattccatgacattagagtgtgggttgtctcatgagccactggcaaatgaaatgatgagttatttcaccatgtaaaccatgtggctgtgagcgttaggagagggccgtggttcctcacattttaggaggtcatgggacctacaaattggaaagttctctctccctgaaaaatgtacatgtatataaaattgaccataaaattctaggttgttctcgactacctgaagtaccaatttaacaacctcttttacagtgagtggagcagctttgattaattttgctgaacatgtttttgtgcatcacagaatactaaaaacagagacttaaaaatgtcaaaggggtccacaaaggtttcatttcatttgtttgttttaattatcagcttctatcaccttttccagttagatgcaagcatgttctgtgccaccaaggcaacatgcaacatttataggaattctgttccagaaaaaagacctcagttgactgacacactgtgttggtcaaatgcttatttgccttctggggtagtctgaactttctgatcactgaaccaggcctttgtcttccttagtgcacaagagagctatattttattctagtaatgagtagctcaaatgtaaatctctgacaggggaccgtgagaagctcagggttctcagagataatactgcatctgtatcaaagcctggacttagagaaggttatcagcattaacctctgtcccccagatctgggccctctgaaagcacacctttcaaatttaatatgtttgctcctagtatttgctttgcttagttacaccattcccacccacctctccattgatttaggggaaagtgagaagagtgctatggaaagtcattttatgacttggagtgatacttaggaaaatattctggttcaataaatatgcagatttaaaacatgccagatatttctaacagtgtttatgtttatgtttttaaagaactatcagtgaattcaaaaacccttccaaacttttccacctgaaatgagtaataaacttttttttcctgtgggttgggatggttttagttccagtttctttatatgcctagtaataaacagtctgttatgctgcccaattataagatagattagtgggtggatagatgcagagtgagaaaggaaaagaaatcagagacaattttccactgaaaggccacagccattttatatagcttttgaaatagatttgaaattaacctataaaaaaggcagtaaatgtctgaaaaaattatagcaatacatatgtgtactgtgggaaatttctataagcagctggttcaatgtttcactctcctctctagctgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaaggtcagttgacattccacttcacaccctgttacttatgcatgtaagcagtttcaaaatcaatgactttagagtcatctcattcagctagaatgtaagctccatgaagacagcaatttgagttaattttgttcattactgtattgatgtcatttacataacaaattagagttaacaagataaatcctctttttttcttttctgacagattgctctgtcactttttaacttctaatcgaaaagagtaccctgattggttgactgatttcttgagtctctttttttaacttcctttgacaagatatcttgtattgctatgaatagaatgatttaccaatgaacccaaatccagtatagaccagggaaaccatagctaatcgtcacctagtgaggctcgttgttcaatccaatctgttgaaatagccaaataccttgggcataatgagtagacatcaaagcaaattatagaatgagcttgaccacttacttacagccaataataaaagagctggtagttatctgattgccctgttttcagtagagcctgtctatctatctccgatattagctgagctgctttactttcggctcagaaagtgtgagggggagtctgactaatgtaggttggcctgaatggagaatgccaatgggattattttctctttctgactcagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcrctgggaggtcaccttattgttcccaattcaggtaattcctagaggtttaaattgcaaagaggcagcttgaaacatatttttccataccaaaatcttttttgttcgtgggatgttttcattaggcctgaaatgttaaatgtgacctatccagcccaaatctactttcaatgtaaacagaacattacttcagacaaatcagcaaaaccatttctcttcctccaactaattctgaaaacacttcctctagaaattctatactcacaactttctgctgaggtgtaatttagaaccatcattgacctcctttttactagaacttcagaaggcaacatcaagccacaagtcctaatgttgtcattatactttaaaaggacgaattaattattaaatatatcatttgattaagttccaatttactacatgaagcaataatacagaaaacaaattttttgatcatcagaggtatcataatagacatcaaatcttcatttattaacctaacttgatcacacagtctttcacctcacagtattgatagtgtacactgtactcactcctacctctgatatttgtatccagaatcaccagattcatcaggtgtgcttttgtactattacttggtttcagtttattatgtagtttctctgcatctagacaataagcctcataaaggtctttcatggtgaatgaaggttaatgcctgatactgttggattaaaaatcgatattcattaatcaatattagtaatgagcttggaaccatgggtcataaaagggttaatggcttcctctctaaatctatctaattcttttgggcaaggctgtgagtattttgtaaatacagtaatacctaaaatgtaaatacctaaagtgttgtcacattgaaaaaacataatatgtgtatactcaaggaatatacagaccaaagagtcttcaggcctgaatatgaaattttatttgattcttcctgtcattcactctttcatttcaatgccttggcaacttttaccctaaacctttaaaagtatattttaacaaaatcaaaacatttaataaaatatttttttcttcacagtttacatagctgagatcatgtattatataatgttttccacccttttctcattaatcctcatgctattgcatgctctttaaaatcatgattttaaatatctttataacagtccattattgaatgaatcaaaacatactttaaggttcttccattgtttaaacattacaattgttctcaaaatagttcttttccctctgaaatgtattggattctgccttttcttcccatttctacctaccactttttcatatgtgcattattataaaggcctcttaagtggaagggagtgagctagcatgttttaaattcttcctatgtattaggcaatggtgatcaacatatgatattttatttaatggacaaacaatagttacctattactttatattcataatgctgtttcatccctataacaaagattaaggtatgttttatgttttcaatgaaaaaaataaaagcactgaggcttggtagcctcatgtgtgatcttcctgctgtgtcctccacaaatcattctgtacattgacagtccacttcctacaacaccagggctctcacattactctccttctcaagaggtctgtggctcaacatcttcaaccagttacatgaaggcctactacctcttaactctccattcttttttcttgagactttccagtgtggtcaggcaagttttcatattgccccacgctcatttggcatattccatttcctcgctaattaaattatgaattactcaaagacaggaagactatcttttcctttttgaaattcacaacagtgtcaaacactgtactcacaaggatgcttcataaatttgtatggagctgaaggaagctggattttaggggaatcaaatgatggagccaaacatctttggagtgctgtccacactgaatcactctttgtgatgatgagcagtggtgtgggccccagaccatcaccatgggcatcacctggcaactggttgaactaaaaaatctaccccacaccccatatctctgaatcagaaactcggggtagggaccagtaatctgtggtttaacaagctttccaggtggttctgacctgagctcaaatttgcaagccactgccacagcagacacagttagcttagaacacagcccaatctaatagttctgccaaagggcaccgattagcaactaactagaaacgctttgacctgctgtgactaaactaggagttagtgttcactttctagagttatgtataataaaaggtcttcaccaattcttataccattgtggaattacattgatgctaaccggatatttaaaaaatacatgttgtttttttttttatgttgaagttggcatttccctgactttgaatcttgtggggattttaaaaaaaaatggaaatgatgcatcattacagctgtttgaaattttgagcagttgttggttttccccttgtcttgcaaggaaaacaacagtggaaccatctgtctgttcctcaaataaaacaagagtttaaaaagttacatcattcctttaagtaattgcataagagttcagagggagccgtggtaaggaggccnatgaggaaggaaaatggagcaactcggaatatttacatgtctttagagaaaatgaagcaggcttatggctgcgcggtsacaaaatctcctcattcccttttacgtgctgcaaaagtcttaaatgactgcttttctcttttgctattcaggagtcagcttgctgattcccgctggggccattccccaagggagagtctacgaaatgtatgtgactgtacacaggaaagaaactatgaggtaaatatgctttttctggtgcactgactttaccaatgtctaacttggaggagaattgtacaayagacacaataaacccaacatatttttgtctcaagtgccttgcttctggcatacattckttttcccttgacctacaaaaggtcaggttttacttctctttgtctttgaggctccagacgcttttgcagatcttgaatatgggtagaaggctagagatcttttcccaagtgracacgttgccatatttcctggaaaaatgtccagaaatgtgatccctagattgtccagagagacaagtgggtagacacagagacgtcgacttcatggcatctggctcaggaatccagcctgttcccattacagagtcaaaggtcacaaaggattggacaactcctccaatccctaccgctcccactcagcctagcccttaattctgacccacgattcttccttttgtgactgtcttctagcttaagtattactaatttccttcttatgtttaacacttataaattccacattaggctgttcagaatgggtctaggattgattaaaactagattgaattaaaaggttttgtttagaatgtttcataatcataaagaagaagttattttaagtaaaaataacaagaggcattgagaagtcctaaattcaattttcagtttggcctctaacaaatcgtattgggtatttcttgattagtttccatgtaaaatgcgtgtgttaaatagtgctttagaagcctgattaatgcttctgaagtacaccaagatcttaaaatgaaagatgttgttaaaatggagatcctcatcatgtaattatcattgtttttcccaaggggaagagcatcggctcctcagccctgagctctgaatataaagcatgagtgacaatgcagaactaggttatcattataacacattataccttttcttttcccagctctcatcctcagaaaaacgtccatttttagccttgttcttcactagccataaagcttttgtattatgctctcaggtggagatactggcatttataattggtgtgacccagaacatttttttcctcgggtggtgtacttccacctacataaatactagcctgtctaagaaaataatacaattcttgagcattattcatgccttaaatttgagcaacagaaaaatcactaaaaggcttgtatttacccacatcaaatattcatttttttcattcccaatgcaaagcaacattcacaggccctcaaagctcccttmttttgcatcaggagaaaagaagatcagcaaactccaagatctctttattttattttatttttctttctctcttccagagtcaaggttagcattaagtacatctatccatcaaggcctttgtcagcgtggacattttgtttaaatagaaataagtattggcttgtgctttatggtgagaaacagtaagatgcctgagctctcctattttccatcagattatcattatctgcagctgaagatcaagccttaaggggctgctgcaggcacgggctgaagctgaaagaggtgtgcactcacgtgcctgctctccccatactttccttggcagccgaaccaggataattgtacattttagatgaaagaaagagaaaacagaaaattgataaagctagacacttttctgctgttagggttctctgcctttgactataatgaaacggaaactataaatcactccttgctatgcctaccatctgaagttaggtgcagagggaattactctgttgaatttggtgtgcataaaagaagttctgtttataaaaatgaagctaggaaaacctcaagatctcaaaagaaaatatgcactacagaccatgaaccaagaaacaaacacaggaggataacagtttcagataaatgagaagtcttctcttcactagttttctgttatgwaccagatgcatttttattgtaaaacacaatggcaagaatgtgctttaggatatagtcataaaacaaagcatccctgcccttcatccagcaaactcttaatttcatttacttctcactacgttctgcaagctgtgatgagctccactttaaagatgaagaaactgaggcacaggggaattgggttccaaagccaaggtttcagttagtaccttagcaaggcagaattcagactcaggcttttctgatcacaaagcactttctgcttcctaatgtgccatcctcctccattgcaccaatgcacaaaccaaacctctgcctatgtattacggtgcatttttggatacactttctattgctcactaaagatcctttctatccacacatgatacaagacagaacttctttggaagaagactctgtgaggacatcaggagctgtgatgttactatgcattcgtaggaaaattctgagcatttttctccattttccttctctctgattncttttattgcatcccaaactgggtatgtttccagctggatggtatccagctggtcatctgcggatgtgaattgtctgaagggaggcgtgaacttaattacatgtggcatagtgaatgtgacaagaggggtcttatcattgctgaatatgctctaagcgaaagtgcaggctggcagctgaacagcctgaatgagccacagagatgggacaagcggtctctgaccaaagagggtgcagagctgcaaggctgtgctcaggatttctacctctcctgctttacagatctctggaaaggcggcgacgcctttgttttcctggtggatacaatttccacaattaatgctgctaacatgggcctttttgccttgtttctagtagcagtttgcacaaatgaacccgacctagactgaaattttgttctttattgattcttgttggaaaacaattggaattgaagatatgaaagttgattttcccttttctctgcattctgtactcacctagcagttttatcaaagggtgaagaaatcaatttagaaattgcaaatacaaaggtaaatagaacaccctttctgtaaaccgcagggagccatggaaagtttctgagcagctgagtgacgcaggaatagcagcgctttttaaagattgatccggtgacagtgcatggaatgcatcggtggagggaacagaaggactcgcccagaaggcttggtgcctgggtgggccctggcagtaatgcaggtgtgaggagagaggaggaggaggaaccgggccggagggtgagccaggtcccagtctgagagaatggagagggtatggagagaatctatttcagaagagaaagtatttcacagctggctagaagtgttgcaaaggaggggcagaacacacagaatagattcaagaatcaagcctggggcactgtgacaattgtgagaaaggtgagaagcagcagtggctccaggggagaggacagattccagtttggatgcgttcagtgtgagtggggatgtggattcctgctagggacgtggaagtgaagtcacggcaaggaaggaacctccagccgagaaaatgcagaagcagaaagaactggggaaagaactttaagaaatactcctgtgaaggtttgggtgtgatgagagaaactagatagaacatgtaaggataaggcaaatgaagagtttgcatctagcacagtacttaacatattactgtgttaggagtagtggctcctcaatgaatatttcctaatgaaagtacgaaggtttgtaagggtagacagacaaaccgcggtataaataggatctcaaaaatcaaaggtaaaaagggctccaagatggagcctcaacacgaggtgtcattaaagtaaaaatgtaaagaaagaggaagaacaacaaaaagattattagatttgtcaactgtggggcattagtggtgttcagaacttttttttttaattggtggaatccccttagcaatggtttaagatgtgagatagtagtgtggcaactgacactatcatatacatctattaaatataaataataaagcaatgtgtgaggataaaggtccaaaattccctatgtaggtaattgtatagagatagatttgcttatcatgttattttttggaattttgtaaaatagtagttgacattattctgtctcaaggaaacacagtgatctttctccttttagtagagtcctttctcattcatgagcctcaagttcctcagtttgaaggaagagccataaaaaggctaacagtgggagttagtgagtccaggtatattgaaatcttatcctcatactgttcttgacaatgttcatttattgaaatcctacttagaragaaatgcttcaagatagtttacgaaaacacttctcaataagagaaataaatttaaataagtggataaaaaaggtaagaaaatggggaaaataaagttataaaagataagataaagtaggcgagcggttagaatataaaatagttggtgtaattcccagcacatttgctagtaccaggtcgtgaatttactatttctaagcctttcaagaagggaatgtgttaagttacaagatccgcatgtccatgaggaaaaaaatatgctcagaagaaacccaattatttttcctttggttcctcataaagaagacattttgctaatgcagtgaacagcatccttaaagaaaaacagcaatgagtttcaagggctgcttctatcagtgtccctcaatggaggtagataagcataatgcttatcagttctggcttaatccagggatagattttggcctgtctagggaaatggtggcacgcccttcggagtggctttcataaatattatttttgcacaattgagcttttgatagcaagtgagttagatattccctgtcaggtacctagagtgcaaatatttcaagttgccagttatgtgtgaaggcctgtgctttaaaaggcagctgagcctagggtgggattatcatcctgagggaccagataaaagacatgtccactactagaaggcatctcctgttcccacagaggtggatggagacagattctttccttgagcctgctctaggaaacagacaagaatagtttcgcaaggacttaaacccactctaagcaacccaaaatacagcatcgtgtgaaagaaattaaatgatttgtgtttgaaacctacctagctttgcatccttaggcaagtgtgttaatatctgtagatttcagtttcctcttctggaaaagaggtaatagacatacactgccatacaggtgtaccatgagcagcaaatgcaatggcttatgtgaaagttttgtaaattatgcactcttgattagaagttctcctcactgataatgacaagcaaaggatgagaaaatatttctgacaggaaactgaaatttctctctgtgggctttgtcctagaggactcagcacccatccagcatttactggaatattatccttgttggactttggaaaacatttaaaattttaatcattgttctttgctgaaatttctacttaaytgatgcttctgaagctaatttttgctctatgttcatttccatatcatctgcaattaatatttacagactgcttgaattgcttagaaaacacatgagacatagagaagtccttctctgcaaaaacaagaatctgagatatttttattttctgctattttcttctatgtgatttaatagcttcctttgtataaaggaaatgtgttacacactctgaccttagttttcacatagttaaatcttatcctgcgtaactccttacatatatgctcagatatttgcaatttcaatgctatttatgtcatcttgaaagcctataagagaatcttatcattatttcttctttgtttttcattccctgttaagaattccacttcaccacttccctattcattacattcttgcacctcactgggttaataaattcttttgacacctactgcccctccttcctccctccttcccttgctatccctcctccaagaatggtgcccatcaatattgcatgccaggggtgtacttggagagtacaggtctgacagctccccagcccagcagggagccttctcccttctgttccaagtcagtgatgagaaggacccctcctccttcctgcctcaagcaccggctgctaacaccagactgagagatagatgtctccaatccccaactatattgcaaagaccacttgaaatacattccactctagtctccttccttaaaagtttaatgttcacttctcaaggtacacttgtaactagaaggtaagagttctgctcagaaaaatgcaatcattggttttttccccctccaggagaggaaaaaatagaattaagcaataataaagtcactccttaaggcagatagtatagtattaactatgacacggtgaaagcagaacttgacttgtgttctaagagaatgaatttcagactggaagaaggacaaattgggttaagagaaaatgaaaaccaaggtggtaatggggatagtaatgaggtctcaagttgctcccaataaccttatagttccaaatttaagtacattcccaagtacctaaataactttagctataatggaggaaagggtattgttatttaaagagaacggaaatgctattaaaagactaaaagtaggtaaaatttgtgttggttttctaaataggaagaaagaaaagccataggttggtgagatcctggtgcaatttcagaataagtgaggaagcactgatagccaagagttattaaggggaacatataccaaattttaattgtgttcttagaattaatagtcaactgtggaagctctaagatacaaacttacttgtgagctaccaagttagctgctacagttttatgcgtgctgataaaacacacaagtcttgtggatcaaagacaacagacagcttattacccacagcgatagcattatacagagtaccatcatgtttgtgccaattttgtgagccccattttagaaatggtgatgcaaaaatgttcagatgaagtctacacactcaatggttgcattccagaaaaggatctatgagcttagggaacctgagtcttttataatgaggagtagacaggcctgccatttgctccagaagtagacattgtctttatctttcaaggtaattgctatacaaacatccaygcataaacatgagaaatccatggataattgtcttccaacaatattaacaataataacaactgctaccattcattgagtgttcaacgagggtacccatagataaaagctaacttctggaatatgtaataaataatacgtaaaccatagacaaaaactagagaaaaatccatttcaagtgaccattgmaattataaaggaatttgatgtgtcccttgtcatatatatgtgaattccatcaaaagatgtgaaccaaacaatgtccrttttaatgggtttatatttggtggaactaaatagctcaaagtattgatatcagactggaaagaggttccaaatggtgtccttgaaaaggtctctgcccttgccctgttcttgtgttgcaaagttatcaatggttagaatgagaacabawatggcaagcatatcagatttagggaggagaaaagaccggaagagatagccaatgtttggagggaagatagagcatgaagaaatagatgacccaaaatttaccttgaaactattaagttcaaatgaaaagctaaatgtaaatttctgtacataggtttaaaagccatcattacaatcatggaaccagacttagcctaagagcctttcatgttgggaatacttagagtggttagtttaacaaatttcttaacttccttggagcttcactgcttcattttataaaggaaatgcttaaccatactatytctatcttcccatgtaactggagcctgctaaataatatttgtaagtaattccttgattgggaataatcaacagcaacaattttgtgaggcatgaatacaaacacagatggcaaatcaaagaaaatactctctcatactatttgagtgttgagttcaaggtgccaccactttaacgaggacctggaaaacaatgacaagcatccatatgaaaatgaagatagaaacccgaggagagatctggaaaccatgctattccagctgagggtggaaacattgaggttgtttggtctgtaataaagaagactgtagagacatcataatgatctccaaatatatgaaacagtgtagcatcaaaagcaaatcaaggatacatacagagaaatttcaggaagtcaggttgtgctcattctaagtaagaatattttgtaaatttgagtttatagtaaacgaggtgaccttttagcagtaatggaacaattctggatgtgtctatagcactaactatacgtcagccatgttttagaggggttctggctggatggaaggtgctgccgaatgacttccaagggcccttctaaaattctgtgagtccatgatttcaaaagctatgctcttctgattgagtgagtagtttgactgttgtcgttgagagggcatttattttcatctcagcactaactagcacttagttgtgagacttggggcaatccactcaatacctttggaactatatcttcacaaatttactgntaggctaggttaatttatccatttgcttgttgattacagtcctgttagggaaaagattaaaggcaatttttatatataagaataaagaatctgcatattttaggttctttctgcccagattctctgagcatgaactatacaagagatctcattttaagttgctgtataaatacagttctatattatttctagtcatatttgaamgaatgaatctgctgtactagcctaaattattcctgaaagtcatttggactaagtttagttctagagtgtcctcattctgaaatgattttttaaaactatttttcaagtcaggtcctgaaaccacaaaagtatttaaaaccctgtgagaccagtggcaagaattatcagaaaatctgcttatgtaacttcatagggactctgttcattctcattccatcttgaaagtgtctgtacataaatttggaggaagctaccatagaaagaccagtgtcggagggaaggggatcaaagagatgctggcaagtttattgttatcataaagacttccagtcctgcaagatcaaggtcttggtatagagagcatttaattctgtatcacctatttcctctccccaaccccccagaaaaaaaaaaaaaaaaagaattccaggagaaaactacttgacctgtttgccttcagaacccaagtgcatagttcatgaatacaatggaaatgtcactgaagccattctctgctctcctcctaggccacccatggatgactctcagacacttttgacccctgtggtgagctgtgggcccccaggagctctgctcacccgcccmgtcgtcctcactatgcatcactgcgcagaccccaataccgaggactggaaaatactgctcaagaaccaggcagcacagggacagtgggaggtgagctgctgtcgggataaagatgctatgcaagaataatccatgcagataagcaggagcaattatgggaggccttttatttataaagcaaaacatgagtggaattttagctcaccctcaaaatgagagagaaacaggcaggcagactagttcctgagtgttatatcttctgaytgacaggcacacagaaaatgatggtcactcattagataactcataggaaaggtgcacataagagttgtagacatgttccttttggaatatagattatatatatgtctatgtatatatattgtgtatatgtgtgtatatataatatatacatatatatgtatatggggtggctcatgcctgtaatcccagcactttgggaggccaatgcaggcggatcatgaggtcaggagtttgagaccagcctggccaacatggagaaatcctgtctctactaaaaatagaaaaattagccgggcgcagtggcatgtgcctataatcccaggtactcgggaggctgaggcaggagaaccgcttgaacccgggaggcggaggttgcagtgagctgagatcgcaccactgcactccagcttgggcaacagagtaagattccatctcaaaaaaaaaaaaaaagtatatgtatatatacrtatataatttgcagstcagaaacattgcaactggatcagaaaatgttaggcacttacttgcagacatgtacctgggatacagttcttgtgaacttaaccttggaaaacagaaagggtgtgtctccaaagctccactagaaggaagaaaatctgcagcattctggctgtcygcagctgctgtcatcagaacttcttaaggacaatgctttaaacaagcctagttctttatattagaaccctccacttagcacctntatttcagtaatatgtttatccaaaaatactcaataattttaaaactatactatacatttatacttgtataaaatgtaaaacatataaaataggaagttataatatgcaaagtatatattatatgctttgtgattacttatgataattttttaggaaaaaattcttagaaaaaatacacatgaagattccagctcctaatattttaagaaaatatagtattagatgtagangagtaccagagtatccctgggattcactgggatttccttcctatgggcatgttctactcttgaccatatcaggggatcactgcttgccgaagcgtacataataaataaataaatacactttatgttgagttaggaccagatttaaccagatctaactttcattctntttaagctttaaatgatgtatctgaaaaacatcccgtcttaatccgaagtgatcctaaattattngcatgattctcttcctattaccctatccatttctgggtttgagtagttacaataacaacgacattaacaataaactgagcagatgagggaagtagaagaggacagtcctcatgaaagcccccttgtacttgtgagtgactgggacgtgggyatcgttactctttggccatgtcttctaggaagctttctgyaccatgtcaccactaggggataccrgaggctttcctttgtcctggagaaagcagctgctttccaggtgtcctttgggactggaataaacctggaggttctgagcttctctcttttcctttttaggggcttcctctgggggcataggttcagtagaagaaattatttcactgatgctattaaaacacagctcttattatagctcagatcatgttgcaaggcctaataaataataacctaggtggcaacctttcacatctttgtgtagcccyctgaactaaatgtataactaagtgttcattcactgtttcagcaaatggttgtgggacacacaccctgagccaggcccactggaatacagtgggaagcaaagtcgacatgattcctgcccctgcagagagactgactgactcttgtctctgacagtgcagagactgactcatgctcacgcgtggatttctcctgcctgagattttcttttaaattcgagttaattaaaagttggaagatttcacattaaaatctgaacttccagcctgtcttggaacatgtgaggctttgtccatacttggcctgcattcctgcatagcaaccgtaggccgaagcccagcagaggctgagctctttagacaggcatgcactctggttcgccacagtctccatcattcctccttgtctgtggccctgcctacttcacatgcctctgttacctggttgccccaggatgcattcggaatcccaacccttggtttttgcatcccatacatggtctttcagctgatatattctgtggcctgaaccatatagatgaatcaaaacttggttgaattagtaactattttttaaaataaaaatcatcacttccatttatttttatttcttgctaaatgttttcagtgtctgaaagagtagactgtttaatgacacataaaaacccatctctttagactgaaaatttcactgacttgtctccttcaatttagcttccagctttactgccagctgctgcctttagaatttccctgagctccttcttgtgagctcacacaccatcccagcccaccctgccctcatcccagctccctgacaccaagtaccatgtccttggcccctggtcatctaggacttgggacagctgcctgcttggccaatcctctgctcagccatcagtcatcagatgacgactcaggaacaactgctcacatgatctaggttgagtgttttccgtttaaacctttttgcagcaaaatcctgctttcacatacacacacacacacaatatgaaatcctaaatatataaaacatgttaaaaagttgtggctgggcgtggtggctcacacctgtaatcccagcgctttgggaggccaaggcaagtgggtcgcttcagctcaggagtttgaggccagcctggcaacatagtgaaaccccatctctatcaaaaaaaattagccaggtgtggttgcacacacctgtggtcccagctacttgggaggctgaggttgggggatcacttgggcctaggggacggaggttgcagtgggctgagatcttgccactgaactccagcctgggcagtagagtgagacycctgtttcaattaataaattaaataaataaataaataaaagaagtatactgacccaacaacaacaaaaaaagtaacagagaaatgtatcttacgtgtcatggaatttgtcaggtcttgcttttcttagaatctgacggccaagattacttagaaaaagcagtgtatttctttaggaagaaactgtcaggtgagttttgaaagaacatagtagaattgcatattaatatattattgcccagttccttaatttatctaattcttttcacacgtacagatttttagggaaaatgtagattcttagaagatcaaaaaatgcaaactgaaagacatctaaataaatattctcagtgtaaagacaatggtagaaagagacagaatgatgaactcaagtagacagattataaactctgagagagaaaaaagaccaagtaaaggataggtcctgctctactcaccattcaccaccatccctggtggccggcatgcgtcctgggtgacttagccatggcccttccctcttgtcccccaggatgtggtggtggtcggggaggaaaacttcaccaccccctgctacattcagctggatgcagaggcctgccacatcctcacagagaacctcagcacctacgccctggtaggacattccaccaccaaagcggctgynaagcgcctcaagctggccatctttgggcccctgtgctgctcctcgctggagtacagcatccgagtctactgtctggatgacacccaggatgccctgaaggtaagtgcctcccacctagcctgccctcttcacctccacctggaagccaaggttttgcacggctgtgcacacttggagatgtggctgtgtgtgtgcacccaagtgtgtggacacgtgtttggcccaaaaggatgcacttaaaaaagatagacatttctctgaggccatgctgatatatgagctgtttacactgattcctcccaagggctactttgtttaccttccttgatttcttttaatgaaaaatttagaagaatttrgcaacgagacccgtggatggtaaataatctgcttccatgtttatctcagctgcgttcttcctataaaaggaattggcataattgctcacactgtatgttcctctggtgtgctgcttcatttatatgctttcctattctttttatgagggctgtgayggagcgggttagcatttgacaacaggctgctgctttgcagaataaatgagcttaattcctggtgtgattattgccattcattttatcccattcgaagctttaagggatatagtaagtgcctttgaagaacttatgatatagaaggaggaataaaagaagtatgccaaggttgaggaggtaagtcagagggtgagaaatgccacartggctgacatgcaaagtgctatatgggagctcaggagacggaggcatcattactttgaggaaatctgaaaaggagctaatatttgatgattggccctaatggaggattgggttttgaccagcaatagtagagggaaaaatacaagatttctaggtggagggaacagcgtgaataaacacagaagcaaacaataaataaagaccctcggccgggtgtggtggctcacgcctgtaatccyagcactttgggaggctaaggcgggtggatcacgaggtcaggagatcaagaccatcctggctaacacggtgaaaccccgtctctactaaaaatacaaaaaaattagccgggcatgatggcaggcatctgtagtcccagctactcaggaggctgaggcaggagaatggcgtgaactggggaggcagaggttgcagtgagccgaaatcgcctcactgcattccagcctaggcgacagagtgaaactctgtctgaaaaaaaaaaaagaagactctctgcaggcatattatttctggtaagcctagaataatagataggaattttgtctagatggacctttacggccagagagaggagctgagattcagttcttgagttaatggagattggagaggtttaaacagaaaaaagrcatgattgaaaatacatattagaaatatcagcctgacttcagtgaaaaggtgagtcaaagtatgcaggaacgtgtgatggagctgaatgatgacaggggagtgagatggagagaacaagcctaaaaagtcctgttcaagtggcctttcgagaatcccatgacgagcgctcaatggatggggcggaaggtcaagttcctgcctctgagtcatagaagcaaactcaggggtcaggatgccttggggtgtagagattgtgcctgtcttagacagtttgggcagctctgacaaagtaccacggactgggtggcataaacaacaaacttatttctcacagttccaacccagacttccagtgtggaggctgaaaatctgagatcaagatgccagcatgggtgggctctgatgaggaactgctgacattttgctgtgtcctcacgtggtggagagctggggagagagctctctgggatctctcttacaaggctactaatcccattcctaagggcaccacctttatgacctaatcacctcccaaaggcctcacctcctaatactatcacactgggggttaggattacaacgtatgaatttggggggggcacagatatcactccataacagtgactgtgccttttcttttggaatactgaattagaggtataaaagatgcccaaggcacggttagaaatacggatatggttctctgaacagagagcagattttgaaacagagattcagaaaccaactacgttatgttgataattgttatccacagtggtcaggaagaatatcaagagagagtagagggagaagataatcataaaaataatcaagatgactgagagcttctatatttttggcaaaattctaaatattttatattaactcatttaatcttcattttatctataaggcaccattaactccactttatagatgtatcatccaaggcacagaaagtttaagtaagttgccctaggtcacacagctgttaagtggagaaagcaggcttcatgcccaggcaactggctgcagcctggctgctctgcccctaagcaaagttgcttgaagacctataccctagagcctggggaccagggaaagccctggctttgcaaggaaggaggaagggcagccagcaaaggagctaaagaaggataagcagccagattaggaatagaaatggaagaaaaatgaatcaaggaagccaaggaaagaaagtttttctgaatatcaggktatttccatctggagcttccgttcagagagtagtacttggttatgaacactgagcgttccaggataagtccactgggaagcaggctccaggggaaaagactgtagagggcacgagtggaaacaggaaggtgagctagaagcctgttgccatcatctgttcaccatggtagatttgaccagcatggtcttggggaagggatgagacctcttgggtcagcgcatataattttgatagtcaagcctgtaagattttctgatgtcgaataaaagttgtgaacacacagctctaatgtaaagcttaaggttatttcttttatattccttgcaaatgtgatacatccaaagcactgtcaggataggaatcatgctgggtttgaattagggaaaatggtatctgtaggggagccatggggtctgattaaggcaaatcttttcaacagttccaagaaaatcgttgcaaaagcgtaccatagaagacctacatcatatttgaagtgtttgatttacatattttatattcacacacatagttctctcctcagccaccttgttttcccaataaacacacacaaatacatgcaaaaatagaatattttataaaaataattctgattattataattagtgaacccaagacgcaaatggtcaatagtgagaaagagtgatgaacaggtttaagcagcaaaaacaactcaagagcagtttgtatcatggtcaatgctttctaaatagacatttataaattctcagcatctggggatctagcacttagcctgaaacaaacatgaataatggatgaggctttcttgcacctcatggccttttaataatgcagaaataccaaaatcctagttataggcaaatggcctctccaacataccgaagagacaattatttcagtcacgccatctcttcctcacacccacgcttgaattggaaatttggggctgattarctcaaaaagccctttattactaaaactctgccttcttggcgccctgctaatgttcccaacatactctctcccatctcgctacttctctaacyactgttgcccagaaatacttcctcttgcaacacacctcctgaaggcctccttctccttcaggcctgcccccatcctgactcacgctcatgctcttccaaaatcaggaattctcagcgcacagaggaagcaggtggaagcttttataaaaacccactccagggcctcactcccacaggttctgatctaattggtctaggtattggggcattttattttcttaatactccctgggttattctattgtgccaccaaagttaagagctattatcctaaacactttcccaaatctttttggaactttaattctactaagaacaaactttcctacaacctcacgtcattccctttcccattgctccacctgctctcattaactgccagtggatcttcctggtaacacctcacaangcctccagcgaagactgtacccctaacaaaccccaaggccaagaggaaatgtgccagtacttctcataccccatgaccctttctggggcatctcttcactgcccaggctggatggttctactnctactcatgcccacttcagttcctttgcacagagctctgtggatcctgccctaccagtacttgccttgtggtctgtctttccatccattttattcccatcattccctcaaattcagtgtcatgacttaaatcacagtctctctgcccaaacttattctagtagcattcacatcatcttacattatctattcactggcatagatgtgctctggatttcatcttcattagcaattgctccactgccaagatctccacctgtcagactccccctttctgactacaaccatctgaccttccatctctctctcccacaagatgcgtggaagctaccctttgttcttaaggagaggctccctcactgggcacggtgactcacgcctgtaatcccagcactttgggaggccaaggcgggtggatcacctgaggtcaggagttcaagaccagcctggccaacatggtgaaaccccgtctctactgaaaatgtaaaaattagctgggcgtggtggtgtgcccctgtaaatcccagctactgaggaggctgaggtgggagagttgcttgaacctgggaggcggaggctgcagtgagcagagatcgcaccacggcactccagcctgggtggcagagcgagaccccatctcttaaaaaaaaaaaaaaaaaaaaaaagggagaggctccctcaacctgctgcagtttcccagtccaaaaaccctcccctggtcttacccgtatgggcagcaaactcgcttccacactgaactctctcgtcattatgagctgctgcagccttttctaatttataaccaaggataccctccactgaataagcccactacttctacttccaggttgatgagttgctatgaaaaatcatacatttctgattgggtctattatactctcaagatacctgttctaagggatgccttccctgcttctccgtaatccttttatttagctcttcttgacttacccgattcccacggcagttcttccatgtatcttctgctctcaggaagtccctggctgttttaaagcccrcatcttgcctagcagtgacctaaccactcaatgaaagctcccccagctgcggtcctctacyctccaaaccttttacttcagcctcttctcacttcatctgactctgatgaaaaggatctctgcttccttgtttgtgctttaatccaattcctgaccacctccatcttcagcatagcaaatgatgcctgaggctgcatttaccagcatttgatattttcgtatagtaactgctatgtgctggggattctttacaaattgcagaaaaatccacagaaatgctggactagggcagagatagaagcccagtggagtacttattctcagggaatgagtccaggagagctattgcaaaaagactgccccaatgtctggagctgtgtatttcaagaatgtgaattatcactttttattattattatatgtggttatattatccatgtggatagataatacatttatttatataagtatatatcctatagatatataattacatatataatatataaatattatatattacataaatataatataaaaatatatattatatattacataaatataatatataaatatatattatatattacataaatataatatataaatawtatatattacataaatataatatataaatattatatattacataaatataatatataaatattatatattacataaatataatatataaatattatatattacataaatataatatataaatatattatatattacataaatataatatataatatatattatatattacataaatataatatataatatatattatatattacataaatataatatataatatatattatatattacataaatataatatataaatatatattatatattacataaatataatatatatttgtacatttatttatattatccatatggatggataacacactcagtcttaagcaactgtgatgcattttttcttctccctactcacctctttgagcttggcagcttttgtaacaattttccagggttttgttaagccttggggcaaaaatggtcacctgaaayttaaaagctgtgtttagcaatttgaaagcactgatacagaattagcatgttggcagtgactaccagagcaaaagtcaaggctgatgggcaacagtggaattattttatacctttcaggagggctttttcctgtgcatgtgcttgaaggaccactgggagcaatgctctagttgtgttcacataaaaggataaagatgctaagaattgtgagaatagtttggaatcaattcaaatagagaggtcaagtctattgaaaaggttgagtttggtatatcagagcttttctttttcccccgtcttcaggtgattaatgaaaaaggtgttttcctttcattatttgcaawgacttaaatcctagtataaatagaccagaaattaaccaagagcaaggttatatttggagtaagtttaaaaacacctaggagaaacatacgtctatgtggaaataagtcatttctgtcccagtatccaaagggtacaatacmtgacagtctctttttggaataaagggttttatactaaactctgagattcagaacctaaaaaaggagttattttcatacattatgggcagtgtatgatatttattgaatttctgacaaatgtatttgtgatataaatcaaataatgtgtattaacataacctggcttttttttttttgatggactcattgggcatggagaagaccttccttggataaatttcatgtgccctaatcccaactgtaatagagtaactctgtgaaagcttgtattatgtgaaaagagaagagaagaatgaaagaaacactggaaggtgaagagagagaaaggaggttggcggaagtctagttgagaattgtgtgatgctcacgttcttgggccacagtcatggacagtcagacgtggcttgttacagggagaaggtagttatatttttatcctgctacctgtcaccttcctcactgatgtcctcctggcatttcctcggcaagctgtgaccttaccgaactctgaactcctcacgcttgcttcttctaggtcttctaaggctgatcttccctggaattatcctagtatccatacctactcttatagttcccacaaacaacctcaaaaatagccttacctgtatactttcaggatcctggcctctggagttaaactaatatattcacatgtgcaacatgtgaattagagaccaacaacaaaacgtgtgttaaaggttcctagtgcatcattgctgctgtgtgtatgggagggagcgtggtacagcagcaaagctcgagtcaggctggctgccgtgactggctgtgccacttatcagcctggtggccctggtcactgaatttgacctcttaggacagtaatttggtctgcatcaaggactctttgaagttctaaggacatcaaagttattaaatctcctggcacaaaatagacaccagacactgtttgccatgcgtatgtgggcatttagacttcagtggcattttgaagataatggcttaaggaagatattaaatctaactggaatctaactgtggggtgagtttcaggtttggtagcggtctggttgattagacatttagtcacagggatatttttggtgcctctaaatttaccccatttttatcatcttctgatgaaatctggccctgggtctatcacctatcttagaaatgacttgccatgttgaacttactttttgaaagagagagaaaacagaaagaaaacagaagttgtggtatgcagaataacacccctgcccccacccaaggatgtttacaggttaatattcaaaacctgtgagtattttaccctacatggcaaaacagtctttgcagatatgattgtgtgatttcaggagattatccgggaccatctgggtgagtccagtctaattacatggttttgaaggtggagaactttttccagctatggtcagaaagggatatgactgcagaaaaaggctcagagaaatctgtcattgttggatttgaagacagcggaaggggaccgtgagccaaagaatgtgagaaacctctggaaggtggagaagacccagtacagattctcctctcggggctctggagaggagggcagccccactgacacaccttgattttaactcaacgagaactgtgttactcccaccctccagaactgtgagataatcagtttgtgttattttttaagtcactatgttagtggtgatttcttatggcaacagtagaaaactaatatagaagtttaaaaataatgtgttaacaggagaaaagaaacacaagatgacttcaaaagtcctagaaaaacckacaaagtcctgttcctaatacatagatgtgagagagaactgttgtcctaagagcacgcccagaggtagacaagtgacacgctgcttgcctgagcaccacccgttggcatttggctttaaaagtgtcacaaactgccctgactgtgcaggctggaagtggcagctcagaccaagcatccgtggccacagcagctgtgggaacagcaggcagagccctagaaacgaagcaacttgacggggagatgtttgcagatgggcaccagagtccagccttgttattattagggaagaagtaaggcagacaaactcagggggagagcagagcaccctggcgtgaacacaggaagggaaaggagcaaagccaggccgggcgccagggatggcgacccgagcaggtgggagaggccgggctgacagtcagatgttctccactgcctggctcagcagtctgaggcctgcaagccggagaggaggggacagagcatggggggctgacagcagcgtcgccgaaaagctggcagagaacaggagagaagggcggccgctctttttggcctctgcttcggtggagtgcaggcccccacagctgtgacagagacagcagtgacagccaccatcgcaaaggcacagatttctcagccccaaatgacaagggcaggttttcgacacatgataatgaacagaagaaaggcaggttccatgaaatctgatggcagatgtgattttttttaaacaccagccagcacagtcattgagggctggccttttgaagtttcatatgagtggcatgctgcacatttgctggtctgttctttgtgtctgtgtcccagaatcaaggtgaaggtggggcaccgctgcagtacaactcagcctcctgtgccggctccagcacggagagcggttctatctccaggagccagaaagccgaaccaaagcaaaaaacagccagagtgccaggctggccactgcttcgcttcctgccttctgtgctgtcctctccatgtagcgatctcagcgactttccctcagtagctacctccacctgctcatgcttctgctgctgatgcctggcctcgtggcagcagtaaatccagccaatgcatggttctgtgtttctctcaaacatgaagactgcctggagaaataacatccagaaacaatataaagaaagaagctagcagagtgaaacacatcctggatttcatcgccttccagccttcccttcaagagagatttcagtgggttatatgagacttaactttaatcatttctttcatcctttctttagcctgtatggtttctaaaaagggaaagaaaagaaagacagaaaagtagttggagagagaacaagagagaggcagagagggagagaaagaagctatggatcatataatccacaaatagcataactgccccttgaaaaactggaaggcataacacatgccttgaggaagaaggtggtgcaattttggggcactggagtgagagaggggcaagttgttatgcagggcaagggtgagcagaggaagaggtgagcagagaagtagggtgagcaggggaggaagtgagcaggggaggagggtgaacagaggaggtgagcaggggaagaggtgagcagaagaggtgagcaggagaggagggtgagcaggggagaaggtgagcagggaaggaggtgagaaggtgaggaggtgagcaggggaagaggtaagcagaagaggcgaccaggagaggaagatgagcaggggaggaggtgagcaggggaggagaggtgagaaggggaagaggtgagaaggggaggaggtgaacagggaaggagatgagaaggggaggaggtgaacaggggaggaggtgagaaggggggaggaggtgggcagaagaggtgagcaggagaggaggatgagcaagggaggagtgagcaggggagaaggtgagcaggggaggaggtgagcaggggaggaggtgagaaggggaggaggtgagaagaggtgggcagaagaggtgagcaggaaaggagggtgaacaggggaggagggtgagcagaggagggcgagcaaaagaggtgagtagaggaggatatgagaaagggaggaggtgagcaggggaagaaggtgagcagaagaggtgagcatgggaggaggatgagcaggggaggaggggaggaagtgagcaggggaggaaggtgagcaaaggaggaggtgagcaggggaagagggtgagcagaggaagtgagcagaggaggaaggtgaacagaagaggtgagcaggagaggaggattagcaggggggaggggaggaggtgagcaggggaggaaggtgagcagaagaggtgagcaggggaggaggtgggcagggggaagggtgaacagaggaggggagaaagggaggagggtgagtggggaggaggtgagcatgggaggaggctgagcagaggagaaaggtgagcagaagaggtgagcaggggagaaggtgagaagggaggaaggtgggcagaagaggtgagcaggggaggagggtaagcagaggaggatgtgagaaagggaggaggtgagcagggaaggagggtaagcaggggaggaggtgattggggaggagagtgaacagaggaggcggcgaacagaggagcaggtgagcatgggagcaggagaggagtgcgagcagggaaggagggagagcaggggagaaaggtgaatagaggaggagggtgagcacaaagtggggttggtggggagggtgagcagagggtgtaggcaacaaagccagggtccggagcactagcccaccagatccgctgtgggaccctagcacctcacaatttttggcacaaaatcaccactgtgcagggctctgtaacccagcttcagcctggaccctgggggcagacttgtcatactctaatagatatacttcaaagcatccaagtatatgccactctgttgcctgggggctcccagtgagcaatagctgtyagcctgatacttaatggaaatttgcccaygcatggaaggaacaggcagagagacaacaagagaagcagatgaggcagatgaaatctaacccggacataatgcagagtgggaaactcgggggctggacagaccagagtggaggagtggcttggctcgcagatgtatcctccctcctgcctctctgtcaagccttaacgaggggagatcctctcatctaagagcctgggagcattctgggtagaggccagaggtgcctcctttgtgcacacaagcctttaaaacagcctggatttattgtggctcttaagtggcccaggctaatggcttggcatggataatgtcttggtttaattggttattgtgaaagctgcttgtttctactgtggaatctcttgtcctgcctttggagcaatccctcacaggctccctgaatcaatatagccctcactctgggccggccagtctgctttggaggcagcgcccgcagtggggaaagaggccctcccacaggattgctcagatccctggcggacgctgggctctgaggcaggtggcctgcttctggtgactgatggttcgcgtgtgtagatgtgcatgggctacagacacatttattgatgacctactcttgagggtgtctttgcaaggaaaagttagaggggtgcagatagaactgtacaaggggggctgggcgcagtggctcatgcctgtaatcccagcactttgggaagctgaagtgggaagtttacttgagtgcaagagttcaaggagcaacaaggcaagactttgtcccgacaaaaaaaaaawttttttattctactttaagttctcgggtacatgtgcacaatgtgcaggtttgttacatatgtatacatgtgccatgttggtgygctgcacccattaactcctcatttacattaggtatatctcctaatgctatccctcccgcctccccccaccccacaacagtccccggtgtgtgatgttccccttcctgtgtccctgtgttctcattgttcaattcccacctatgagtgagaacatgtggtgtttggttttttgttcttgtgatagtttactgagaatgatggtttccagcttcatccatgtccctacaaaggacatgaactcattcttttttatggctgcatagtatttcgtgtgtatatgtgccacattttctttattcagtctatcattgatgggcatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggctgaactagtttacagttccaccaacagtgtaaaagtgttcctatttctccacatcctctccagcacctgttgtttcctgactttttaaagatcaccattctaactggtgtgagatgatatctcattgtggttttgatttgcatttctctgatggccagtgatggtgagcattttttcatgtgtctgttgactgcataaatgtcttcttttgagaagtgtctgttcatatccttcgcccactttttgatggggttgtttgtttctttctcgtaaatttgtttgagttcattgtagattctggatattagccctttgtcagatgagtagattgcaaaaattttctcccattctgtaggttgcctgttcactcagatggtagtttcttttgctgtgcagaagctctttagtttaattagatcccattgtcaattttggcttctgttgccattgctttaaaagtagccaggtgcagtggcatgagcctgtagtcccagctacttgggaggctgaggtgggaggactgcctgagcacagaggtcgaggctgcagtgagctatgatcacgccactgcactccagcctgtgctacagagcaagaaagaaggtgtctaaaaatattttgaataaaagaactgtgaaaggaagtcagaaactgtctcccttctcacagaagcaaaacaagctcatcaaagcaacaggtggattcacctagagccaaactaggccactgaggtgggggaactcccagtaggaaggacaacttctgcaaaggaacttgacgttcaggtttctgagaacaaagaggccagatgatccgcatccttactatagcatttctttccagggtcacgatatttctcttaagtcttcctaaatcttctgacattaaatatattttgttcatattctattttaaggtgtgtgaaatatcctaacctttgtgattcaagagcagcctgtytggaagtggttttagacctgagcacactgtgttgtggttacatgtttacaggtcaccccccaacccccatgaaccattagcccattagcagtttaaagcagtgacagggacttacttgtctgtgtgctccagacctgacatggttcctggcagcctaacgtgtctcactgatgttgaatgaatgttcccagggagaggaagcagaggaaaacattgaactgtaaagccatgtcttattgagttgtatatttgttatttttctgtcctcttacatatctgtatcatataaataaccaaaatgagatcatgtgcgaagaattcagaaaatcaagcagtgtgaaatacaagttgcagcatatttttaagtggaatctgctggagtaaatctcaaattgtaacacttaaaatggtaacacaagacaaagcctgattagcctttcgggcaggcttgcttcttctatcatctgacacaaaactctatttgagattcgccgtatgtgacgagtcagctcctgttcctgtgtggttttagattatactcgtttcccaggagttgctggatgatcgactgagatctctttaactcacaccatggtttttgtcctctccttttttctgttatgctttcctatgtcatgaacgtctttagtgcaacgataccagttgccactttgcgggaaggggtgttaagtgtggtaaggttactgaatccttcactgctgggctgaattcttccccaggtactagtgaaaggacaagctgtctgagccagcagtctccaatatggagtttacacaccccaggcccagtgaaccactgggaccaaaaaaaatacagtattagtacttagctttatgctaagacagattaatacaggatcttatgtatttttaaattttatgtatattttataatgcaatatattaacatactgataatagagatatgtaatttataaatatgcatgctcaatgttttgactggtagactattctggcaaacatgtttatagcctctgctctaagcatgggtgtgtcctgatgggcagtttgtctttccccagggyttatgtcccattggaagggagaaaaaagtcaggttccttccagccctgtgctgcagctttgtgtcactcctgggtgatggagaaatggcgagcttaagtctatggaaggagtgtgttctgtggccccactgtctttaaaatggcacttggtactttctatccaaaaaagggctcctycaagccagtctaggctttttccccactagngagaattcttcaccatgacttttsaaatcattgctgaagaaacaaaaaactgagcctgattcttgggctgactcccatgaagactctgcactcaaaatgccgtgttagatttcctgacttcaaggtcatggccaataggcagtttgggtttttttcaatgtcctgcctgccaagaaaactgataatgctcttcatatcctctggcagtctatgttgattgtaggaatggggtgtggattatacattgttgggtacaattacctccrggaatacaatgcatcttcttttagacatcccagggagataatttcgacataatgaagatctatagtaatcagataattactatcgattgctctttagacgtcttgatgaggtaattagggcatatggaaagaaagaagctggaactgattgattggcatgactgtaatctcaaagatttctaattatgtttcttttcttctaatggcttataaacaaacatcattttagctttagaatttgtcaggtgccaggttcactgggaacatcagctttctctattatgctaactagacaccaaacatgatcaacataagctcattatgccttcctgctgaagcagaagaaactgcaattaaccctcacttttcttcttcttctccacttccacatggctctattcttgtcgtggagtggggtgtcatggagtggggtgtgccacgttctgtgaggagcgtgtgtgactcaaggctggatgggtctgtatggcctacgggagaccctcggagcctgctgagctcaggcacagcagactagggggacaatgacacaacatatgtgtcaaggtgtctggctgactgtggctgggggctggctgactgctcgggctcctgtcacaagccatagctactcatcagccagcaacattaagtagcaggtcaatactctcaggcagctggaccacacacttgtctacgtcagtgtgctattgcctcatctcttccattagatactaactagaggacgccctgtctgaaaccacattccacattatcctaatatttttttacaccttataggaccttcgagcagcttgcatggttcagaatagttgcctcaccaaaagatgacagatattaagaaccactaacgcagcatcttgaaatgagctgtttgcatgtaatcaatgatcgtggtagccaccacacttactgctctacaagtgcatgggttagaattcgttcaacaaatgcaaggtggatgcatttttctgaatatgaggcaatctggttcccatgcctgaaatcctccactgcgacccacctgtgcttggtaccctggtgggtacccaatccatgcatgttacagtctgaatgaacacctgtgttcttgaattccctgctttttattgaaatagcaccaaagaaaaaattatattttgctttttttctaaaatccatatattcctggacccttattttaaaatgggtcacaaatttcctgtgtatttgtaccattaaaacttttaaggcatgagaggagtaacgtgcatagggatggttcagacagcagaggagacccaagatagtttgttcattgataactaatggtttgctgctgtttggataattacagctgcagttggaaatgcttcattaactcccattaactagcctgagaaatggaagtatatatagaatctgtctttatgttgttatctgtatagtataagaaaattatgtagcaaattttttcatcagccacaattctcgagaaacaaaaatattcttttgaaaatgtaattggagtaactgtttagttcaatatttggtgtttaaaaaccttcctaatctgtatcggaatattttcctttaatagaatatataattagcatattctaatttttttaataattgggaattatgcataaatcattttaagcaaactttttatatttttatttctgtacttgaagtaactataagagattgaactaaatgtctaaaacaggttctaattttttatttgttgtttggttttatcaagtccaaggaatgagtatctcttctagttatttgtccctttttgtaaaagttaattgaaaatctactttcttatcaatcagtttgtctacatttctacctattttttctttaatttatggctctctggttttgagttctgatgttattcccccatatttgataaatactccactcatcagtcggtaaagggcaaactgtatgaaattgctcctcaacagtgtgatgtagactgccaaaacatagtttgttattagggtctggtcccatacaaaatgggaggggctttagttagtttagttagagggtctcgaggctgcaaaagtgggtgttcaaggtgttgcacaagttccgcctgccattcaggaggcagtaaagaaacttattcaatgagagagctgacagaagtgatccaaatcaataacgtgctttgggtttggggcatgtcattataggaaattttacatcttgagagacagaygggaggacagctcctagaagaacctaaggctcttcattttaaaggcagcacccacaacctgcgcctgtcaattcacgatatcgcccattccctctggaagagcaaattgctggctaaatatcaggtaaggttcccaagccgaacaaaaggtctggagacatctctaagaaagaggtctaaaattatatagacataggaaatccccttccttgaaattaatcatatgtcattacttgtttctccaaaatagtttggggttatttaggatttttgagaaacacagacatatttgagggaatgctttttaaaaattcttcctttaaataaatgtactatcattgttttatttttaataaatgaaaggcttccaaatccatcatttcaattaattttcatactaaatgttcacatcaatgggtaaaaacagcttgaaatgcattcacagaaacaaacagaaggacatttttattccatgggacacaaattaggcttcagccttcctaggccagtacccttacattgaaaaattagagggagccctactttggagaactgaaatagcatgtaaaagtaaaacccaatcaggatattattaaacaagagacaagaaaatactggtcccaagtgtcatttgtatatacctgggggaaaatcacatgaccctcaaggaattttcccctccttcatccgtcagcctgagctcttgagaaaaccactttggcgggattgcaagcctcatatgccatcctaggaggggcagacatatttagagagctgtgaatccatgttgatatttatgcaaattcaacccaaaccccagcattgcctctgaactggtagctatttcctgatgtaagccaatgaacatactggaagactgatgggaagacattctggctccattctcactctcattggtctagttcctacacataaattatgggaaacaagcctactggtttgttaacaatcatgagctttgacggaggttgcatgccagactctctatgcacagctcagtccttgatggagacagaaggcttctgacttactcagtatacctctttctttgctttcttctttcctctgtgttgcagttgtcataaaatactataaatctccctgttttaggagtaatttcttttatacaattataagaaaatactattttaatgataatgataatatgatattagttaaagctaagcctggccgaatgcttaccatctgctggacactctcttcatacattggtttagctcatttaaccccagcagacctacgaatgagaagctctttgtttactcttttgcagataggaaaactgagcaatggaaagattaagtaatttgccccaggttatcaagtaagcgaaataaggggttcttatttgtactggatttggctccgaagccactgctttttacagccatgctctcccattttttatgtggcaaccttttctttctttcctttattgaaaacagattctaggataggctctgtaaggtggtctagacttttaggaaattaaagcctgttcgatgcttggtgccaagaacttttctgtggcagctaattgagtctgaagtttccaactgtagtgggttttggcttcccctgtcctgggcagaggaggatgtaaagcatgaaagggagccacatcagtgcagtatcctttagactttctttgcttttctccagaatgtcacgacagggattctattaatgagcaatggctggtgtgtgcaagttttattttgggaattgtataaactcttttttttttttaatcatttacaatggttcctgttgttgtaaattagagacatgtggcagactggttaggtacatggattctggaggctgactccttaggttcaaatctcagccctgctacttacttgctgtgtgatttggggtaagttattgaacctctctggccctcaagtttttcatgtgataagggtccaggatgtacttaaacatagggctgttgtgaggattaaatgaggccacaggtgtgatactcagagtacctggcagcagaccatctgagagttatttttggtattagtccttcaattgtggttaacactttcatatcctttaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggtaagtggctcctgtctgtctgaaatcaggggagagtgcgacactcaggaagacagagtgtgtgggctaaaagggtatctcaacatagtccatatgggaagtcctcaaaagctttctatmgatcctatttgttaatagaataatatttgtaatgagcaatggaagctagctgcagaaaaaaawatatatatattaagggatcctttttgaaaaacaagtcttaatttttatgacatgaattttaagaattatgttctaacttgtaaaaacagatctgaatttcaagtaaaggtttaatttaargagcgtgcacatggagtaacttctccccatgcatcccttagcgtgccatgttcccccatcctccatctgtctctcctccctttctgcttctttctcagcaactctcctccctttcccctaatcacctgctgctgggtggagtggaagaaaggagaggggcttctctgctccctttttcttcttctccattcaaaggaagaaaggagaaatctcttgatctcctttctctctatcattctctaaatataaagagagatacactttcctccgggatgggggaaatatgccacaaatagaagtagaatctccatatttcccccctgtggccatcagctttgccttcctttgctgtgatcttcacacacttcagttggctatttccctgtgtccatattacagaaataatagtgatcactgctatctaaaacttctccttaaggaaagaggaagtgcccatgaccttccttatctgttaccttggatccaaagccttgaaaattgataacccttcacaccagaggaacaaagggaagagaagaagccaaaagggcagaaggcagcctctttggggcctcatggagctaagccctgtgctgcgtgctaagccacaaagcacaagattgtcatatgtgaaaatgacagcgggccagtatatgatttaaaatactacctctccctcgttgtgtcatgcacagtgacgaatgcaatgtcagcatgttcagcttgtcttgcttcacatgtcatatttaaagaccatcttccttagcaaaccgagtggggagaaaagcacatcagcttccgctacactccatccttctttctttcccacagcctgccgaggtgcggtcatcatttcctcctgtagtttcatgagacttttgactcataaacaactttagtcacagcccccggtgacattcataaggaatgatctcggtgtcagggtgccatggcaaccgccaggccttcggatgcgcagccctatctcccaggcacacagcaccacccctgctggctcgggagggtgttttcactttccaggcccagcaggtctgcaaagttcaataaccacccagctccagtgacaacaaaggctgcggaattttggaggggggtgagggggtctggtcctttgatgcttgctttctgttccacatgaacattggctgcgtgttaaaaaggtggatcagatgcagccacaaatgaaagagagctgctctgtgctctcccgcgccagggctgccacctcccttcagaaaaaggacagttttgcatagtgtgatcacaatttaagggcttttgctttcttatggcaacacagaggaaagattacttcttttgcaacacggtgtcagtctgctcaaagagaccagccttcagtcatgtcagaggcatctgcccttgtgtgacagacaagcatatttaactgagggcggggaagaagtgaggggagtcaagatgactttgggggattaaggggcactctgcggcttttccttctgggtcactgaatcccactgttgtggttagcatttgaatgcgggtgctgggtgcgcagaggagggagtgtggatgggtgtactgatgttggagaggaagcctctgcgctgaagaacaatggactctgtagagttatgggacccagatcctcaacaaaaccttcaagaaagggtacaagatgattgacaaaccataaacaagtagagaaaaggctccatttgtggtttctttcttctgaacagggctccttcctagggtcacagggcaagatggcaatgaggctggggttcccgttccaatgtcctatctcccaggaatgagctggcttgccagaaatgtgctgcccctccctccagccacccaccaccggacgcactcaccagtcgtcatttataaagctacacagcccttggcctgtcctgtcagacagaggacctgttgcccaccccagagaccaggctgtgcgtgacatgtactctgattatttcaagggccagccagttgtctctgggtgatttagccagggattccttaactagagacaaaggctttaattaatttcacagagatgaagtttaagaaggaaaatgtctggaagactaactaactgtattgacacaaatgaatgtcaaaatgtaaaagatgataaaagattttgtttgttggtttcatagacaagtgcagagagagtaaccaggaagctactcattatctccaaaagaaaagaaaacatggtgcagaggacagakgataaatttacagttttttcacatcttctattttgtttcagttacaggcagacatccatcatgggaaattcccaagtaggctgttccatggagatagatagggccaattacttaatcctttcttgcctcagtttccccattgtaaattggtatagaatattatcttgggccagtgtgggaattaaatgggagaatgtttgttagtaagtaagtgttctaaacagaacttggcccagagcacatgcttaatctatgttcaccatttttactggtgccactgatgccataaggataacagggcttttgagtcaactttgctacttcaatccgtgggggggggtctgtcatcaattgaggtttcagattttctttctatcatcaatcaaaataaacacaaaaataaaactcagatcctatataaataaatgaaaactaaatataaacaaaaattagctcccagagaaaagaaggtagcatgtatccccaagttggtttatcacattgctttacttgaaagctctgaaccctgaaaaaaggtgcagttttagggggcagtatttattagtcagtcatctttttcttttttttttttttttttttgagaaggagtcttgctctgtggcccaggctggagtgcagtggcacgacttcagctcactgcaacctccgcctcctgggttcaaacaattctcctgcctcagcctcctgagtagctgggatcacaggcatatgccaccacacccagctgatttttgtattgttagtagagacagggtttcaccacgttggctaggctggtctcgaactcctgagctcaggtcatccacccacctcagcctcccaaagtgctgggattataggcgtgagccaccacgcccgttctcatctactttactttaataatagatttataggtaataaaagcaattataattaagttttatatttgctagatcttataacctcttaagttgtggtgcacagcacttctgtatacacaaataatatttatttaaaataaatgtacaaagtaatatcactctgctacagccatttcatctgtttacatcttctgctttccataacctgctcaaaatgaccattgggaaaatctagtttttctaagcgactttaggaaaagtccaaatatcagaatagaaagttgtttcaggactgtggagtcctgaatatgtgtgtcatcacccatagcagctgtttgactaatgttgaaaaatcatatgtttacataagggaatcataacatcaaagaccaatggtactgatattataaatgattattgaaataagcattctgtgagagtaaactctacttttacctggaagtaaaggaagaactaatagcaactaaaattactagatgaaatgtaaatgtataaacgtattttactttaactttcaaggctgttgtcagccatttgataagagaaagaaacaaagaaatgatgccctattgagcttgtttcatctacacagaaataaataggctgagtgagtagccagggatagagagctcaggacttcaatgcccacatgaaatgctgaggagagttctttatccacaagaaaatggggacaacatgaatatgtgagcacgccttcccaagatccatgcctatctatcttcaactggcctctcatttcaggatttaacttccacatttagttggaaggcagctcaacaccctagtctatgggtgggcttctatcagaggttggcttcatcttctttctgtactaaggacaaatattttctctcatttcaacaaacaaacattaattgagtagcttcttgtgtgtggggcacagtgttatcatagaggtctgaggatgattgattgattgatatactctcaccaaaaagaaatgtgagaaataaaaggcagtaacctacaaatacagccaatgtgcacagagcagagtgtgaggagcacagaagagctgggaggcaccgaggagacctccaggcctgacgcctagggtatgctcgcccaggggggccccagggcacaggacttttggaccaggctttgaggactttgcctgacagagatcaaagaaaagaaagagcagaataactattagaggtgcatccttagaaatggcataagaactagtgagtggtgctcagactctaaggagcctatgagtcaggtcaagtcacggtaaggacggggcaacctgagattagattgtgaagtggtggaagcacaggtgaacagccctactccatgtccgactgcattctgcacttcacatggtcaccttgcagcctcataccagccaaccaggaaggtcatataaagatccctcactgggccaggtatggtggctcacacctgtaatcccatgactttgggaggctgagctaggaggatcacttgagcctaggagtttgagaccaatctggacaacacagtgagaccccatcatctcttaaaaaaaaaaaaaaggcaaattagcccagtgtgatggtgcacaccgatagtctcagctatttgggagactgaggtgggaggatcgcttgagcccaagaattcaaggctgcagcaagctatgatcacaccatggcactccagcctgggtgacagagaagtgtcaaatgcccctcctaccacatgaagaccttgtctctaaatacatatatatatgtatttgaggacaaataccatgatcacagccaacagcactgtgcataccatggcaaaagatttcaaatgccctccacacccctggattgaccctgttccatgggattgcataagcctagaagtgagcacttgctgctgatcgcagaatgtggaacatactgctaatcaacactggcacacaggcagttgcaacctcaccgcctgcagtgccagtgcattcacggctggggaggccactgaagcggtgcagggcagcatatggggggcgctctgggtgatgatggtggtgttgagcccctgagctgagcactcagcaggaaccaaacacttcatgatggctgaaactgggtgtggccagttagttcatcctctggcaactagtgaggaacaccaacaagttacgtgctttaaaaagagagagacagccgaataggaacagctccagtctacagctcccagcgtgagcgacgcataagatgggtgatttctgcatttccatctgaggtrccgggttcatctcactagggagtgccagacagtgggcgcaggtcagtgggtgcgcgcaccgtgcgtgagccgaaggagggcraggcattgcctcactcgggaagtgcaaggggtcagggagttccctttcctagtcaaagaaaggggtgacagacggcacctggaaaatcgggtcactcccccccaagtactgcgcttttcccacgggcttaaaaaacggcacaccaggagattatatcccgcacctggctcggagggtcctacgcccacagagtctcgctgattgctagcacagcagtctgagatcaaactgcaaggcggcagcgaggctgggggaggggcccccgccattgcccagacttgcttaggtaaacaaagcagccaggaagctcgaactgggtggagcccaccacagctcaaggaggcctgcctgcctctgcaggctccacctctgggggcagggcacagacaaacaaaaagacagcagtaacctctgcagacttaaatgtccctgtcagacagctttgaagagagcagtggttctcccagcacgcagctggagatctgagaacgggcagactgcctcctcaagtgggtccctgacccctacccctgagcagcctaactgggaggcaccccccagcaggggcagactgacacctcacacggccaggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaatggaacaaagctggacagggaatgaccttgacgagctgagagaggaaggcttcagatgatcaaattactccgagctaygggaggaaattcaaaccaaaggcaaagaagttgaaaactttgaaaaaaatttagaagaatgtataactagaataaccaatacagagaagtgcttaaaggagctgatggagctgaaaaccaaggctcaagaactacgtgaagaatgcagaagcctcaggagccaatgcgatcaactggaagaaagggtatcagcgatggaagatgaagtgaatgaaatgaagcgagaaggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccagtctagcaaggcaggccaacactcagattcaggaaatacagagaatgccacaaagatactcctcaagaagagaaagtccaagacacataattgtcagattcaccaaagttgaaatgaaggaaaaaatgttaagggcagccagagagaaaggtcgggttacccacaaagggaagcccatcagactaacacctgatctctcagcagaaactctacaagccagaagggagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaatcatgccaaaatgtaaagaccattgagactaggaagaaactgcatcaactaacgagcaaaataaccagctaacatcataatgacaggctcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagacctaccaagcaaatagaaaacaaaaaaaggcaggggttgcaatcctagtctctgataaaacagactttaaaccaacaaagatcaaaaaagacaaagaaggccattacataatggtaaagggatcaattcaacaagaagagttaactatcctaaatatatatgcacccaatacaggagcacccagattcataaagcaagtcctgagtgacctacaaagagacttagactcccacacattaataatgggagattttaacaccccactgtcaacatcagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaatgaacagaaattataacaaactatctctcagaccacagtgcaatcaaactagaactcaggattaagaatctcactcaaaaccgctcaactacatagaaactgaacaacctgctcctgaatgactactgggtaaataacaaaatgaaggcagaaataaagatgttctttgaaaccaacgagaacaaagacacaacataccagaatctctgggacccattcaaagcagtgtgtagagggaaatttatagcactttaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagtagctggtttttttaaaggatccataaaattgatagactgctagcaagactaataaagaaaaaaagagagaagaatcaaatagacgcaataaaaaatgataaaggggatatcaccaatgatcccacagaaatacaaactaccagcagagaatactacaaacacctctatgcaaataaactagaaaatctagaagaaatggataaattcctcaacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggagctgctaccattccttctgaaactattccaatcaatagaaaaagagggaatcctccctaactgattttatgaggctagcatcatcctgataccaaaggctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctgaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcarttaggaaaagaggaagtcaaattgtccctgtttgcagatgacatgattgtatatctagaaaaccccatcgtctcagtccaaaatctccttaagctgataagcaacttcagcaaagtctcaggatacaaaatcaatgtacaaaaatcacaagcattcttatacaccaataacagacaaacagagggccaaatcatgagtgaactcccattcacaattgcttcaaagagaataaaatacttaggaatccaacttacgagggacatgaaggacctcttcaaggagaactacaaaccactgctcaaggaaataaaagaggatacaaacaaatggaacaacattccatgctcatgggtaggaagaatcaatatcgtgaaaatggccatactgcccaaggtaatctatagattcaatgccatccccatcaagctaccaatgactttcttcacagaattggaaaaaactactttcaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataacgccgcatatctacaactatctgatctttgactaacctgagaaaaacaagcaatggggaaatgattccctatttaataaatggtgctgaggaaactgcctaaccatatgtagaaagctgaaactggatctcttccttacaccttatacaaaaatcaattcaagatggattaaagacctaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctcattaaaataaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacgacaggtgctagagaggatgtggagaaacaggaacacttttacactgttggtgggactgtaaactagttcaaccattgtggaagtcagtgtggcgactcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaacaatgatagactggattaagaaaatgtggcacatatacaccatggaatactatgcagccatgaaaaaggatgagttcatgtcctttgtagggacatgggtgaaattggaaatcatcattctcagtaaactatcacaagaacaaaaaaccaaacactgcatattctcactcacgggggaattgaacaatgagaacacatggacacaggaaggggaacatcacactctggggactgttgtggggtagggggaggtgggaggggggagggatagcattgggagatatacctaatgctagatgatgagttagtgggtgcagcgcaccagcatggcacgtgtatacatatgtaactaacctgcacattgtgcacatgtaccctaaaacttaaagtataataataataaataaataaaaaagaaaaaaaaaatagagagagatggcatttatagtagattaagtagattttcttttattgctttaatagttcccaggcaccatttgcttttgcttttccaaccagcacaagtgatcagaaaatgattagaatttctcctgcagatgaaattcagattttgcatttgtgytgttttatgagctgagactatcttaagagccaatttatggttttctctactaaaattagatttttaaaaaataaggatatacagcaattggaggatgccattaacaacttgccctaaggcaataatatactgtgtttaccattttcttttttaagaaattagccttaagttgatatcatttagaggagagctatgttccagttcattcaacaaaagcagaactgagacatcttctgtggagtttagcagaactactggagcatttgcccaggactttctcctcaaggtcaggctgtttccagaagccttgaatctcagatctattcattcccaaagcactgcccttttgaacattttcctctcctgaaatttaaacctttaggagctctgatattccctctcttctctctcagcctggagaatcccattagtaaagctgttatcgaatcacaccagagctttccatccagcccagtcctcaccaaagactcacaaatctgaggctatgcaaagttagctcaaaatgtatgtacctctatctctgagccaggttacatctagtgatgcacaactttcaggctaagaagaagccattcttcctaagaagaataacagcattcattcttttcttatcactcaaagcaaggcattatgttgattggttcaatagagattgcttttgtcytcagaaataatgctgtgttgttcctgtccctgaactacaggaacctactggcatcgatttgccgctgctggatcctgcgaacaccatcaccacggtcacggggcccagtrctttcagcatccctctccctatccggcagaagctctgtagcagcctggatgccccccagacgagaggccatgactggaggatgctggcccataagctgaacctggacaggtgggtatggtctggccccaagactagcttctttctgttagtgccctccaggacygataactattagacgtagggttagcttcatttttttttccatccacacatctatttaatttttcattttgcaaatatgcattaagctctgtccttgtaccttgcactacgggcttgcaaagagtgctaagagacattctgagcttatctggcattggtaagtatcaagttttgtgatgcactttgccaagctgatgggctaaattccccaaatcatatagccattcactaccgtagttattgctcctcctctgcagttgagcaggacctaatgtttgattaataattagcatgccaacacagcactgatattaagttataaagagacctctggagcgtctactttgtggagtgtcaccgtcactaccaaacataacatgtggcatgacctgtcaaagatcatccaagcctggactagaaagaaaacataagtctcttgatttcctgtttagaatatgacccatagacatcttgtctcttaaattatctcactcagagctgaggttcacaaagttaaacatcacatcccctgtctggggctgatctaattaagcatgggctagttatttaggatggctcactgtcagccacaatgggaccaggaaacttaaagacaagtagagagacagaaaggtttagctgaggaaaaatagatatgtaagtcacactgttgagcacattttctctttcccaattacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccrtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcwgataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaaccagttctcattgtgggtctgtcactgtcttgttgcgccaccttgagaaagtcatttaaccacacgacctcagtgtcctcactagaaagtgaaagggtgggattagatcatctccaagttctgaaatgctcaacttccaccgtgatgcctccagtctcattcatcagtctgaagaccacaatggactctgacctggatcatcatttaaaaatcatcagctggtcttttgcccaggctatgttacgcctttcaagtagttctgacaaggaagatgattattctaaccagcattatgatgttgtttgtttggcctgagtcgctctgcatcattgcattatgctgttcactgagagatgacatccctttattatcattttcttagcctctcttgggatgcccctgcccccagccttcctgactggttgcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactgaagaacaagcagacatgtgtatgaatcggaacctttagaacatgactgtggtttacttttaggctggaggcacacaagttgctgaacagacttgaattatacatgtgcttccatctttccatgtttccgctcctattttggtagcatcttgagattccttgatgcctccgccatcctcatccctgaggaactgctgataccttgctatggaacctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttgtggaatcatctatggaaatcaagaactagaatctgaactgaatggtcaaagaaacttctatgcctagtgaaaactagaggggagcaactatgtagctatgaacatgaatcaattccataactgttactaaaaacttattttgactaaaaagtcaccaacacagaactattgaacacaaacaggaattgtttgtcttactgaagtcactgagaacccttggggttcacttcagatgcttttttggttcaacttcccaccaccagaaaagggaaaagtgattgatttcgtgtgtgaggtactcatctgtcagaacccttaatgtttcctattaagtgaatgacaacttccatacatacactatttataccaaataattttcactacaaattctgatttccttctcctttggagtaaagtaatagctgttagattgctttcaaacttagaaggtccagatataacagttcatttcataggaagccacttcatcaaccattctatgtgatacatcctgcttctttctacaccgctggagaggcagtttggctggtttcatttggatagaaaaaactatcatttgtgcatgctgccatctagtggtgtacaacacaatctaacctgagtttaatattcactagaatgtgtttgacgaagggaatgaaaacctgtagagttcaaggacctttatgacaaacagatgtagggaaattttcacttcaaatttataattttcttattctcacttttttttcatttgcatcacccatctcaatattaggtcactgtgagcccagtacatcaactcattcatacacaacatatcttcagttgcttcttgtaacagaactatgtaaaatctatataaaacagtctttgaagagttgtcatttttaacacttatggttttcattggggtttgtatactttaaatctccttttagttccttaatatttatctttggaaatgtaagaagtatctgcttagaaagaaataagtcttatatatgcgaatggaatactatgtctagggaagagaaaattggggttgttaatcaaagggaagaaagcagcttcttttctgctgaatttgggaatccaaaggcagaggtttcatcctgtttttattttcttcttatcacactctttcaagtttccttaatgtatctggaaggaatagaagttggattcagaattgataactggcatggtgatgacaaacctgtgtaacaccaaggttctcacagctaacagctgtttcacaaacggcatcttccaaatgaacagtcacctctgctatgcagaaaacccccatcctgctgtgagcaagttaggctcttcaagaactggacaacttttgggtgaggtgttcaatatcaaactgcataatcattagccattttcatatatactattttatagatttaagtctctcaactatcaaaaagtagagcgatttttaggagaaaaaagtcgtggggactgagttcaggacaccctgaaactatgcgaccagtaatttttttaaggtattttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaatccacgtatgcagaagggagttaataaggtgatcaccatctccccagaattcaaaggtctttgcctctataaggtctgcccctatggggccaggaaaatataaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcataagtcatggttcctaggttttcctgtcacctcattgtattcatctgtggtaggatattaacgggctcattcaaccaaatgtaatgtgtgcctcagacctatttagcatggttggggggcatcagcaggacaaaccaacaggtactccgcaagtgtactggcacagcaagcccaccaattattagcagctcttcatcagcctgctgtctactcagacgcttgcctactgaagggacctgtccagagatcttctggaatcccaggttgggaatctctgcagaatgtcgtgacagttgtggcccaactagcttctgagtagaaacaaggaagctaccctgagatatagtcagctgcccacctgccatagtatttgctactgaatgccagccttttaacataccatttcagatttgtccttcaacaaaaatataaattgcaagtcataccatttaagggtcttttacaaatatgtctaaattgtgtgtcatttttaagttccaaaggtctactggactaagtactatcagaccagctgtagaacctgatggcgctgatccggggtggaataaccctcagtactggtgtgtagaagatgaattgtaggcaggttttgctgatcagcagcctaaggattgatgggctctcttttggcctctgatcctgagcactatggaggcagcatcagagaatggggacctgagctacataggttctcaatgttaaaacaactctgttcggagtgacatataagagcaagaaatctacagctggtgtaaaatacctttgccttttctatcccgaaagtaacaaatggcatctgtacatgtaggggtaaaaactcagatgtctactcctccaggccatggacaagaaaaagtacagcagtcagaacagtggaacaagtgatttgcattctcttcttcacgctttcctagatctgccattggtagcgcagccctcgccctccagacataatgcatcgagcccagttgcagggaacatcactgtgtgtgtgtgatgtcatggtgttatatgtgttgagtttaatgttgagctgaagcaagttggtgaccttcctctttgctctttgtaaagaagacaccaatgtttgtcagagaaaaatccccagcagtcgtgttgaagaggcagtgtcatccacctactgtcccctttggaacagttcaactgcagaaaggtcggattgaggttttgtgctttgtcgtttttcttttttaaacaaaacatgacaaccttggcttttccgatatggaacacttttgttgttgtggagttccctcttgctgtatcttctatgcaattccttttctaaaaaaaccccccggcagaggcagagtgccctccggatatctgtccggcgccttgctgagtggtggaggtgagggataccagctccgggtgtgcctcttttctctccytggctgccaatcctgattttccctgcagtccccttggtttgtaaattgcctgcatttattctgtcagccaacatgtacaaaatgtaagaaagaatttttaaacaggtaataaattatatttataagcaacaaagtgctgcctccttcacttaataacaaggttctcttgcgtgttcagagctgccacgtgtttcttcggtgggacagaaaggctttgggtcctgcgtggatggtgatcacaacctcctgcaggcacaggatgaggttttagcatggtgctactaaaaaatcagctgcacactggaatcaccagagaggccttaagaactaacgccagggtcacacctccagagattctgatggaagtggtctgggggtagcctgngtcttgggtgttaaaagctcccgggtggtactaatgagcggttaagggtgagaaccaatgtcttagaacttctgcagaattctctggggcgggagcttctaaatagagtgtcaagccctgcccccagagatctgattttaaatgaagcttgcaaacaactatactaataggtaggaaatgaaaggtaagcaactaccagcagaggagttcagcttggtacaggactgctw

SEQ ID NO: 10618 - DNA, 56319 bp, Homo sapiens
  misc_feature (1)...(56319): n = A,T,C or G, or insertion/deletion polymorphism (see Tables 1-2)
ggatcacttgaggtcaggagttcgagaccagcctagccaacatggtgaaaccccatctctactaaaaatacaaaatattagccaggcgtgatggcacacatctgtgattccagctactcaggaggctaaggcaaaagaatcgcctgagctcgggaggcagaggttgcagtgagccgagatcatgccactgaactccaatctggctgacagagtgagactctgtctcaaaaaaaagaaacaacaaaaaaaaggtagtataattattaaagtcccatataactttgagaaaggacatttgtccagtttatcatcaaagaaagggaaggttttagaggtcagagtttggggcaaaaaacatgtttaaaatgaaagcaaactccatgcactttggctatcgaagaatagggcttgaggagaagaacttaaaaagtaaagatcaatattcccccacccagcattaataattttgacatatcatagtgagggactttttgtaaatctattctttcatatattttacatgaaaagctccatttgttgtcatggctttcttaaatatgaataaaaaagagatgggaaatttgcttattgtgcagtatcaatagcctatcttcactaaggtatatttaggaggacatacaataataagaatagttgcattgtatggcagtgtgaaatagactagtaatatatgaatgacattctcattgtaaaagaaataagctgcttgaatgtgtacggaataaaccaggaactaacttgcctaaatagccttctaaacggttgagattctttttagtccatttctatgtatttcatatacacacaatgcatatgtactgtctctagtgtaagctctctctagcataaatcgtgtcaccccataatcagtgttctgtaactcatgttttcatgttgaatcgtgtacctaaaaagtcacatttcttaatccttcctttatgttttctggagattgcatcttattttagtagctcttcctcatgcccatttgacaatttcatttgattttaaaactgagggcctgtgttcatccatgaacactttagaaaagcaatcatttagaaaatggttgattgcctgctggcctggagatgagctaaagagagtgactggcttggtcagaggtctgagccatcacctgtttggcctcccataggtgttcctttgagcttcaactctctttggcccctcccacttcctgccccaaagttgtcttcactgctggttctcactctttctgcttcccaggggacaacagtggtgcccaggtaagaggaaggggcccagggtggggtgtagggagcactaagaatatttgtctttttagtatgtgacagggtcagggactgggcagtgcctaaatgtgaaggtacaggcaattgaaatgagaaataactgttaatttttttactaattcagttcagtggagtcaaaagaaaactggttttggtgctttggaaaattgttcaagcatcaattaatagtcaaaactggtcaattatctaaatctaccttatcttccaaatcacaggatatagaacaaaaaaaaattgcctaaaaggtgtggttaattttttttaatagaccttatttttagagctcacagtaaaattgagtaggaggtatgcagttaatttttgaacattcagggcctaattctctagttggtgtattagccaaattcattttcttctttttgctttctattgtattttccccctcactgatttttggccctttctgtagcacctgaagatggacaggggagagaaaagaagtgggattcctttgaaaaacattttttttaatttaatttttagtttaaaattttttttgagacaaagtctcgctctgttgcccaggctggagtgcagtggtgaaatctcagctcactgcaacctccgccccccaggttcaagcaattctcctgcctcagcctcccaagtagctgggattacaggtgtgtgccaccacgcccaactaattttttgtatttttagtagagatgaggttttgccatgttggtcaggctggtctcaaactcctgacctcaagttatccacctgcctcggcctcccaaactgctgggattataggtgtgaaccaccatgcccggccatttttttttgtgagaccaggtttcactcttgttgcccaggccggagtgcaatggtgcaatcctggctcactgcaacctctgcctcctgggttcaagtgattctcctgcctcagcctcccaagtatttgggattagaggtatgcacaccatgcctggctaattttttgtatttagtagagacagggtttcactatgttggtcaggctggtctcgaactcatgacttcaggtgatccacccacctcagcctcccaaagtgctgagattacaggcctgagccaccatgcccagcccatttttttgctttttgtttttgtttttttcaattacaatggagtcacatcttacaggaggggttaggctcttaaggaagaccatgaggtcaaagtgcagtgaaaattactcttgaaaattttttaatgagccataagacctgggatacaccaagtttttgtcgttttttgtttgtttggggctatttcttttcttccagcattgaaacagacataagtttcttcaagtgagcactggttgaaataattgattggcacttaggggcaggaagataagcacctttaaccactagactcatattctgtgtggggagatcaggaccagttacataatttgccaggtccagtgcaaaatgaaaatgcaaggccccctttcaaaaagcacagtattaagaatctcaacacaacagcagcaatgtattaaaccaagcacagggctcttccaagggtggggccttgtgcaactgcccagactgcacgaacatgaagccagccgtgggaaagaagcttggaacataatgagaagctcagaaactcagataaacacagtaagagaagcctcacaactcccatagagagaaataggggacaagatcactggaagtatttaaattattctcttgtgttcctcatattctgtcctagatgagtcccgtatagctaaatttgcattacattaaatcagtacaatatgcaactccactagaaaagttataaggctgagaggttgcaaatccaactgtaattacatttttagatttttgtcaatgatttattataatttaaaactcagatttcagatgtgtaaaaagaaaatgagtatttctatttcttcatcgaacaaaaattttgatctgcccttagtcttttgccaagagtgatagaccacatttagtctaccgtgtaatttacagggagaaaaaaaaactgtattactgtgagttctctaagtggttcaaaaaggtaagttagaaaaactaggtgtaataatatgtcttcttcaaataaaatgctaattattttacttctaaagaggttgccttttcagattttgttgttttttttttttcctcagaaagccataaacataacctgagcagggaagattttgtgttatgactgtctgagccctctgagcaacaatgtgatacaaggctcatttttgagggaactgccttatattttacagcactccattttttcaaagtgttgtttttgttttgttttgttttgagatggagtctcgctctgtcgcccaggccggagtaaagtggcgtgatctcggctcactgcaacctccacctcccaggttcaagcgattctcctgcctcagcttccagagtagctgggattacaggtgcgtgccaccacgcccagctaatttttttgtatttttagtagagacggggtttcaccgtgttagccaggatggtctcgatctcctgaccttgtgatccacctgcctcggcctcccaaagtgcttggattacaggcatgagccaccgtgcctggcccaaagtgcttttatacacaagtcaggccaagggcagttggtcaggtaattcacagaagggttttcagatagcaagttatttaacattaaagtaacagaagatagtatttccagcatcttttcttatctcagcttggttctctgatgttacagttgaacttgctttgacaaaagctgctttcctggtggctttgagagctacatatctgaactttaaaagaagtgtcatgcctaggatcaggcagctggtcactccagtataaaggacaactaccctgactcatggtcacctgctccaacttatgtcatagctcaaaacaatacttaaatccttacaaagctaacaaaggaagtaatgttgccatgtgtcattgtcacagaattaccagaagtttgggggatttgggtgttcatctttctattgtggagtttttagggtggtgatggcagttgtgtggtggttgtcatttggcaggaattgaaattggaggcttctgtcattctgattacttatccaacgaatgacacaaataagagcatgtttgtagggaagaactcaggtggggacagcaccttctattyaatctcttaacctgtattattaggttgtatattttaggagaagagaggaaagtggcaaaaggaggcacagatacaaatttatacagatcaccagctaagtttggccacagtggtttgccaaagaatttcaataactaatacttagagtgcttactgtgcaccctgctaagcacttcacatgctttatttcactttatcctcaaaataacccaaggaaatagctatcattgttatccccagagaccaagatctcatggatagtgaatgtcagagccaggactggaaccatagaggagtctgtgttgtaaccactgaacaactgactttctaccctgctttaaaatgttgcctgttgtttgttgttgttgtttttgaacggtggtggccaatctgcctccacaatccagacataatttcggcactaaacagaaatactttagtctatacaaacttcatgtaagtagttcctgcatgaaactatttcccaagtaatacagcaccgatttacacctggcagaaggcatagttttgatgtgaacagttgggggaagcttgtttctctacaccctcaagcacgcccacagcaggagctgagcagcaggccagacggcacagagccctcctgggactggttatttacattaaccaaggtggaaacttctcccggagataggtgctgccaagaaccctagaggaagtaagacgctttatcttttgcacgcacgccaagtcttcagagggcctggatgggtgtgactccaaggagctaatcgtcccgtgcaggtgcaaatctagacccgtgtttatgtggaggtgtagacgcaactggagatgacccggttagtggctgacgtgcgtgggaaagcccaccagcagcgttgttggttgggttgtctctgtaagtgtggacagtgtgttggtgggcacccagttccgattgccccgtctagacaggggtgtgcgggcactcaatgttccacgcgcggccgggagctcgcagtgtggtccacgccagtgcgcctggaagcccaggggatctgtccggcactccactggaggcttggcccgcggcttcgcccacctccccagagccccgctcagcccccgctccccccgctcagcccccgctcagcccccgctcagcccccgctcagcccccgctcagcccccgctcagcccccgctcagcccccgctcagcccccgctcccccactcggccccgcccccagtgccctggcaggccccgcccccaacgccgggcgctcccgtcggctcggcggcctcagttccgtaaacacttctcaccccgcccccggcagcccggaccgcaccactcgccgcgcgggggaaccgtgccctctcgcatccgaaacaccctcccatccgagctgttctcggcctctctggttcaaactgacgaagactgtttctctaataggttcagtctgtgagcgctcggctttcggagactgaagggccctggatccccttgccccgtcgcgccgtcgtccccccgctatccggttttgtgatggccgcgccgtggctgcctccctagagtccctcagsgccctttaaataccgcgttgggggggacrctggggctgggggggtttgttgggctggtgagttttcgaggtgactgtgctgtgctcggtgaggggacgcccagagagccctgacccggggtcactccgtcgccgttctcctcttgtctacgtgctggacccggtgcgtatccatcacgggggaggcgttgccggctcggaggtgaccggccaggtccaacggaggggacaccgctgcagcccgaaggctcccctgccctatctcggaactccatcctgggaaggcggggtcaggggccatcaagctcggctcctagttcatgtcttcccactccgcgtccccttgtttgacctcgaactgccgtcccgcgtgggagcggggagcggggcaccgagtggccgccccgcgtgtcggggtggacacggacttcgggcctcggaggccgcttcgccgctgtttaaatcctgctggacaggtaccagcggcatcccgccatcaggggcccagggcacccccttcccccacactcctcggccgggctggagtagggaactgagccagggtagaggcagggcgggcccggcagcgtgtgtttgggatttgttgccgtggtttccccggcactcagctctgcctccgccgtcccctcccccaagggtttgttttgacaggaaacctggtgctgctggaggggaggggcggccagaggacgtgggtgaggtcgtgcagactgctgctgcgtccccttgccgggacctttggttaaggggaagaggtggagaaaagccgattgggcctgggctcgaacgctgaaccctcaggtgttgcttgtgcttcccaaagctgctactgtaggtggcaccactgggggtaatagcaatgatttgaggtggcatatggatgaacatagttacttgttttcgttactattaagaaaatctgttccattaagtaagcagtttcacaatgatagagtttccttttaaaataaatatatttaaatgcaaaaatctagtcaagatagagacgcggttactaaattatagtaaaggtaaggagggagacgtagaaatagtcatgaagagtggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacaggtattaaaacaaaacagaccagcaagtgtgggaggagtgctttcaaatgtgaaaagtgccaggaatccttctccctgatgctgtaatgccacgtgtaacgtgaacatctgctttgtggacagtgactggcttgttggcttttatctagctctttgttggttctaacttgatgaagaccagtattgtctagatgaatggtatgggcccctatccctctgctctatggtttttgctttgctgtggatgaataactttagtgctgctatttaagactgattctaaagcagcattttgcagaagatggaaatttttcacatcatctgcnatttttttctttagagcccagacttagtcctctgactcccttccctttactacacatatgtgaaggcttgtccttgcagctgacctcgatctagtgttgaaggatggtacacactagaagtttcttgaaatttcttttttgcgtgagctaaccttaactggatgggttcaattcctcaaggccctgctgggtaatctgaatatttcactccaaaatgtttatgactgtaagcagttaacctttttgctaatacgtggggtctaactagggattttgcggtgcataaagaatggctccctcctagaggattttctgtcactgtagcggggtggtgaagaattgttttgggtgacgtactccttcagtgatgcccttcacagaatagcacttgagcagccataccaggataagatcagcttgctaccacatgtgcaagtgtccacagggtgatgggtagatggatttggcagagtgggagtggaaagaatgagcagcacaccaaattttctccagccaaactggagtggtagagagcatgggttttagggatccgcttcctggatttgagttgtgcctctacactgctgtgaacccttgggcaagtaacgcaacctctctgggcctcaggatcttattataaaatggggataatactgatacattagctaacaaggttataataaggattcaaggagataaaatatataaagaacttatcatagaacagttattgagtgcttattactacctcaataataagcactcaattactgttagctgtaattgttgttatttgctacacgtgagtttctttaacctcctggaactgtgggtctttgctagtttgaatttttggtgccttgcaaatgcactgaagtaggcactgggaattggagaggagagtcatcgcttccaccagcagcttaaaatctagtgggagacagatatgcacacaagtgtagtactgtaagtgactgcgtaatgggaatatgagtaatgtgagtgaggcagaaaagaaggaaaactcaaggtgtcttatgaataggagtgtggcgtaattagttcatgcagctgtactcactgagctcctgctctagccctagcggtgttctaagctctagctggctcattagatgcagtgagtgtagcaatcagggaaggttacctcgtagttggtgacattaaatttcaaatctgaatgacaatagggagccaaccacaaggagatcagggagaggaacatttcaggggcagagaacagcaggtatgagtgccccgaaataggaagtttggcatgtctgaggaacgcaaagaagatcatgaagggttagtgggagaacactgcagaataaggtgggcagagttaagatcacagagggttgtaaaccatggcccagtgacttaggaaaagggaacccacctagggatgaactcttaaaaaggattatctattttgccttttctggagggctctggcctatttcctgttttattctttaggcactgttcaagaaggacatcaggacaagtttgactgtctaraagagttcttgtaatagagtggtatttaagctatcacagcagtgggcacaatcagaatttcaaaactgcaagaggttggactgttctgaatttgaatcttgaagtttcagttcagcctgtcatcttctcttttaaccttctatttggaaatactttcaaacttacagataaagtcgtgagaatagtataaggaataccatgttgtctacctttttctcagattcacctattaacattttgctctatgtgctttattattttttctctcttgcatttgaatcatttgagaaaaagttgtatatgtcatggccctttattcctaaatacaaaaccacagtacatttcaacttcagtatatttaacattggataacagacagtagattcaaatattgttaacagtgctattgattgactgatactgtcctttacagcatttttgcttcagtataggatccactctaggatcacctattgcactcagttatcaagtgtttttttttcatttggaacatattctcaacctttctttgttttttatgacattacattttcggaacttgtaacttcttttaataagaataaaataatagttgacatccgtcaggcacttactaggagcttaagtacttgacagatactatttcagttaatcttcacaacacttctacaaggtggatactattattgtcccattttacaaatggcnagttctctgtttctagtcagtaaataatcaagaggagccgggatcaagaacccagtccacctagctccagaggcaatgttcttatggcttcagtgacatgtattatcatcagtgtatctttgcarttctgaaccagtgcagaactatttgcagatagagttgctgcagaaaggaaatcaggaagtaaagctgcacacgagctgaggaatcacaagcaaattaaaaaccaatctcctctctatctgtagtgaaatacagcactagccccttcaagtccttgtacccattcacacctcttaaatgtcagtagtcttactaccattcatttattcaacaataaatatttgaataaatatttgaatgcttgctgcattccagtgatggtctcagaagaaatgacattatatttattatcacaaagtgatggaataatacaatcaaaaatgtgaatatgacagtacttttctttgaatagtgacctgctatcgtgttggaggctttgcttggagtcatcttcagtcttttctgttgactttacctttgaccagtgattaaatcctccaggtatgatgagatgtgatgtttctgaaaagttgtttgatttacttgtgagttgcagtggcaaaggttaggtagatctaagtttgcataaggagtattacctttcttaaagatacagcctggtttcattatcatcagtctaaaggataatccaaaatagtttttaaagcaatctaaatatcctcagtgccttttgaatcaagtaggtttgtccccaggtgacttacttggaaactcaagaccgagaaaggtaagagcaggtatgaaggaacttgcggaagaccattcacacagtgatgggccattcgcttttggtttttgtctgtcaaacaagtgccaagagttctgttctatgttaactaccagccttgtttgtctgttgaagaatrtggtgttatcctgacataaaactgttcttccctccagagtgtttaattcctgaggcaatgatattaacaaaaaaaagcaaataatagaaaacatttgtatactgtttactgtgtcaatgactgttccaaacacgctgcatgtattgggtacctgaaatctcacaccaaccctatgaattaggtattcttagtaagcctatatgaggaaacagacaaatttttaatagagtaataatgggcattttggcttcaaatacaggtttctgtttggatacactaaggcccagttgtaatgtggaggcttctacccactaaacaagagtttctaaacattttgaagcttttaaattttccattgcagcccctgtgccaggaactctacctccagtgaattgctggaagaaagtgtagtttcacattgttaagcatgactgccataagcacatttaatttctcagaacttctagtgatgcctcatggaactctgggtttggagcatcatatattccttgctgagagaaaccttatgactggcccaacctctcagaaaaatgtgcataaagtcacacggcacattaatgatgaacccaggccacaaaccctggactcctgactcccaattattttartctttgcacttttctgccttgttaaacacagttaagaaacctaccaagtgtgctatccagctaaagtagaaaaatgaaatggacagttaaaactattaagctagttcataaatyctcatggctggaagctcttattcamtttcacttggaaaaacagccagagctcatttgagggcaaccgwagtagagaaraattaagagcagagcatgcatagcacagcggttacattacaggggaataactgggggaaaaatgacttaaagtggaaacaaactttaagatattcaaataagagcatgacaaggacctgagaatcttgaggtttaaatctaataagataggcttaagcagtagattctctgctctaaggcttgggctttggcagtaccagsctggttaacgtgtcatgatatcaggttgcaaatgttctggttgaagctgtaccaaatgagattcagggattctgatttagctgacactgaatgaatacttgtcatatacttggcgctggtcatggacaagacacaaactctgctttattaaggagattcagaagtagccatgggaagaaaggaacaaggaactaatgtacaaggaactaagcgctgtcatggagatacaggagacgcgctgcagacataccaagaggagtgctattcactttggctagaagcaaggcttcctggagaaggtagcatttgcaagaaatgccatcagtgggacatcaaatgttggcaaagagaggaagcaaactagaggggagggtgaacattccatttaggatttggggtttggtggcagtgaaaggtttgaagtagccccttttcttctgtcttctctcgccttcccctgagcagattggagtttaagctcaggtagaatttagtcttcatgagttagaggaggctgtttcaccactgaggatgcaagggctcaagaatcttatagccagtgttcatggctttgggattctgggataaggtgagtgtctccactccactccttgcccttcagcctgcacaagtggactctagtggttttctgcttgcaaaagtggtgggctcagcaaggatacatttytgtggcaggattgaagacggttgtttaggtgaggcaaggcgcaaatgaccttagacctttcacccttattagatccctctcagactcatccttgtccccatcaccatccaaggaattaaaaaaattactctttttctctcaacaaaggctagtgccccttctcccgctctgctaatcctgagcctgcctctcctttcttgtgttttctcaacaatgccttattcccccttttcccatctagtagcattcagtacacagttttaggtagctggacttgagaaccacaagaatagggcattgtctttgtttggttactttccccggtgctcagtgctcaagtaggcacttgttgaatattaatggaatcattgaagaaactgcaggcattttcagacatactatacatagttgtggtttcccattctggccgctttaaaagcactgcatccctcattgcatgggctggtttagstttaaaaggattcagtgaactcttcctctcattattgtccatccaggatttgaggtgcctttctccttgagcccgggtttccccttcagtgtcaggtgataccatattcacatcaaggtcagctccctcacgggcctggctggtgctcctgggaccaaggcctggtcatcctgtgtgcctgtgatctgctttctgggtagtgtccaaacctgacggcccttccctggaaggattctcatgtcccagaaacactggacatagacaccaagggactggttttatcatgtagtaaatccccttatccctctgagtctgttcccccacttgtgagtcaggatcctacatgcttgtgcactcatagggttgtgatgggtactttgtaaattgtcaaatcctaaccatatatcaggtcttaatcttcatatcacagcagttcatgtggaaatggagggggaagaagctaaagacttgccagccagaggtttcatgcggtcttcccctttccccaggaggttcacagaaagcgtaaagaggctgatttcacagctattttatctgaaacaaagcaataggagcaataatagcagctaacatttgagtactgtgccaagctctttaagatgaattctattcaatcttctggcaacccaatgagaggttagtctttcagtccagtttcactatgaggtaggtagttaagtgaccttcccaaggtctcatggcaaaaggcagaacagaacgagagatctgacccaagtcccacactcccgccttctcatgtttcagcaacccaggaggagagagcatgtgtcctgcatctttttaaaaaggacctgccattacttagagcttcacatttatagtgggtgtgtcctgagtaagctcacacctatggctgtggaatcccttttcagaaaggcaatctcgatgacctagtgatctggcctagtccggccaaggtgctgggggaaggatgaggtcatctgggggcctttccaacacagtgacacttgtggggacagttgtctacactggaagaagcattggtggtgcctgtggaagtaccacagaacattgaygcagggtctgtttgtctgtgcaggtgctacctttttacccacacttaagtgacgcaaaatgcccttcaatggcgagaagcagtgtgtgggagaggaccagccaagcgattctgattcttyccggttttccgaaagcatggcttcgctcagtgactatgaatgctccaggcagagctttncaagtgactcctccagcaaatccagctctcctgcttgtgagccgatgggggagcaggggttgtgggtggcaggggtacttctagatatgtgttggatttgaaaactcagaaacgcctgagagcaacagacttcccctcctttctagatgcaccagaatagcactgcagaggcactgcagctttccgggacacattctcagaaatagccactaaagtttacaacctgctgatttttattttgatcactgcttccgatctgtttcggtctgatgataagtcaggacttcaaccccatctgtcttttctcccaaacagcagaaagccattccttgagattacttcttagatctccactgaaggataaattcaaattggtcttttctgattattcctgatttacattgaaggaaactggccttcattgaaaggtcaggaaggaagtgaaataatctaaagggtttcatgttgatttcaaaaaaatattgtgcaaatcaccccaggaaggtacccacaaggagaattactacattaggggtgtgagaaagagttaaaagagaggccacagcaaaaggagatatctttttcccgtttttgcatgtagaaactagagatgggtaaagcagatgtgtttgcctttttttttttaattggcactttatttagtaaatataacagctttaactggcaaagcaaatgcaggaaaaagcaactaatgtttaatatgctgaactgtccacttcttacaaattgcttcatttgtattttaaatttttacattctcattttttaaaacttagaagatacataagaatagagaaaagaaaacattgcctatgatatcactcaaagacgacagctggcagtgctttgccgtatctttatccttcacatagacatatgtgtgtatatgtgtgtggactcttcttgcttagtattataactaaaacatttactcatgattacatgtttttgaaacattggttttatgaatacttattactttaccaagtgaatgtacggtaaaattaaccattgattaatcactggacatttagtttccatttttttttttttttttttgctgttataaatagtgctttatgaacatcttactgcatgaagcctttctggaaagacttttggatatcactggattattggaccaaagtatatagacatttttaaggagaatcttgagtcagacctggcaaaagaaattaacagcagccaccccaggtttctgtgccttttctcactctttatactgtatgtggtgttgttgcatctgacaccagggtacctaggcatcctgaagaagggttttaccaattctgtgtatcacctttctcttcttcctcctctttccctgatcctcctcctcatcttctcctaaaaattaggtagccaggcgcagtggctcacacctgtaatcccagcactttgagaggctgaggcaggcaaatcacctgaggtcaggagttcaagaccacctggccaacatggtgaaaccccatctctactaaaaatacaaaaattagctgagcatggtggcatgcacctgtagtcccagctacttgggaggctgaggcaggagaatcgcttgaacctgggaggtggaggttgtagtgagtcaagattgcaccactgcactccagcctgggagacagagcaagactctgtcttgggaaaaaaaaataaattaggtagtaaagtattacctgtcactgctgttgtttgacacatgattttaattaaaagaagctaagatttccaacagtgatttttaaaagacatgatttattagaatagtttcttagtataatctttagaaataactcagattcttcatttactatttcctactgagaagtaaaatatctggcttctcagatttattctattttacttttaattatgtaaatttattgagttcttactatcttcttctttacttaaattatctcattcggtcacctcaggccaaccctgtgaggaggaaggctatgcctcagtgaaatccaatgataaataccaattggcaaaactcagagtgaacctaagtgtttatactatactgcctatacatttaaaaattacagtttttggctgggtgcggtggcttacacctgtaatcccagcactttggccaaggcaggcagatcatctgaggtcaggagttcgagaccagcctggccaacatggcgaaacaccgtctctaataaaaatacaaaaattagcctggtatggtgacatgtgcctgtaatccagctactcgagaggctgaggcaggagaatctcttgaccccaggaggtggaggttgcagtgagctgagattgcaccactgcactccagcctgrcaacagagtgagactccatctcaaaaaaataaataaataaataaataaataaataaataaataaatattacrgttttaaaaatcagttatttcatattgagtttacttaatgagacttctgaattacagaataaaaataattttatcaatttcctatataatacatataataagtgcagatttcaatgggcactaaaaatgaggtaatttaattttttttttttttttttttgagacgagtctcaccctgtcgtccaggctggagtgcagtggcacgatcttggctcactgcaagctcctcctcctgggttcacgccattctcctgcctcagccttccgagtagctgggactacaggtgcccgccaccatgcccggctaatttttttgtatttttagtagagacggggtttcaccgtgttaaccaggatggtcttgatctcctgacctcatgatctacctgcctcggcctcccaaagtgttgggattacaggcgtgagccactgcgcctggcctggtaatttaatttttaaaagtaacttataatgggcctatattaataagttggtctcataaatatttgagacaatgttatcaaatatggtaactgaagctattgaaggagttcttaaatttttgaagcctttattaactgagggaattcacctattttaatatatagtctcctgacctataaaactctgaagtatatacattctgataaattaaaccttatctgcatcaggaggcttcgttggatgacaacttttcttctgcaacattaactggcttttgtttttctttcagcaacaagccctccaagggttgtaacatttgatgaagtgatggctacagcaaggaacttatcaaacttgactcttgctcatgagattkctgtaaatgagaactttcaattgaaacaagaggctctcccagaaaagaggtaacckgggggcatttgttgtatataaactgctgaagattctgtgtgtgtgtgtgtgtgtgtgtgtgtgtgtgtgtgtgtgtgagagagagagagagagagacagagagagagatagacacatatttacactgattcctggaagttcttgtataatatcctcaggggtaaacatttagttctctaacaaggtcttatacttgttttaaaaaaattctcgctgggtgtgatagctcacacctgtaaccccatcactttgggaggtggaggcgggaggattccttgaagccaggagtttgagactggcctgggcagcaaagcaagaccccatctctgtaaaaaataaaaataaaaatattatccagcatggtggcatgagcctgtaattacaggtaccggggaggctgagtcaagaagatcatttgagcccaggagttcagggactgcagtgagctctcatcatgccactacactccagcctgggtgacagagcaagaccctgtctcaaaaaaaaaaaaaaaaaaattcctgtttgtgaccagcccggccaacgtggtgaaacctcacctctactaaaaacacaaaaattagccggccatggtggtggggcgcgtgtaatcccagctacttgggaggctgaggcaggagaattgcgtgaacccaggaggtggaggtttcagtgagccgagatcgcaccactgcactacagcctgcgcaacagagtactccgtctcaaaaaacaaaaacaaaaacaaacaaamaaaaaaattcccctaggatacatattacccataatctttagaactcagtttatatgtcacttcctgagggaagctttttctgacattggtgaaccccctagactacaattaatccctttgctacagacacctgtagcccttgctgcctcctttttgttaagaggtcttataattttatgtttgatgtccatcttccccacttgattgaaatgcactatttatggaggagctatgtctgtattgtttgttgctgtatccctattgtctagcatagtgcctgacatacagtacaggctcaagacatatttgcacattgatttatggaaaactgatactcaggttctgaagaataaataaatgcacctgaactgtcaaagtgctaaaagcaggcaatccagaaatgtctggaggtaggaatcacagctgcaagaggcacttcctggttaacctcgccctccgacctctagttggagccacccctttggatcctacttcagcctttctggagtcagtggctcacaggtttcctgagacaaagagaagaggcttgagactattattacagatcagtcgtctttagaagcaaagttggttcgtggattgaattttcaaccttacagtaccaattataaatcctgaggcattctatcagttaagacaacttagaatatttgatcccattcagaactttttcatttgttttaaagcaggaaaagtaaaggaagtcaatgtaataactnttcttctttaaaatgtggatcatagtcctcttggggatgttgttcatttaatattaacattttttaagcttgccatgtatcgtgggtgtatctgtttggtttcctttggtaactgcattttgccatgacccttgataccagctctactgctacagccctaggctaggccaccgtcatctgtggcctggaccctttcagtcctaactggttgccgtgtctcctttcttagcccccaacagttcatcttccatatccmgtagccttaatgatgtttttaaagaatgagctatattagatgatttctttgccaaaaactcttcaatggttttcacttactcagagaccaaaaatctaagcattttcctatggcctggatggccccactcccctgaccccrtctcagtgctgtccctcctgcttgctgtgcttcagccacactggcttccttccttacctcagggttcaccaatctggatcttgtctcataaactttgttcctctgacttcttctttttgaatgttcttttcccagaccttcacatggctctttgctctccccttctgagtctgaacacaaaggtcactgacttaaagaggctttttcccaccatccagtgaaatcagcaccctctctgtaactgtgtaccacattgtcttattctttctcataggtctgaaattgtcgtattcatttttaatgtattttttgcctttttgtccctgctaacatataagctttttgaggtcagagactttcttttcactgtagtattcccagttcctaaaacagggccctacacatattggatgtttaataaacatttattgactaatacaaatgaattttttgagatggagtcttgttttaaagttaaaatttgtattttttatgaggtaaagcaaaagacagggcatatctgtactttaaattcaaaagtggcgagtacaggccatagtgaaggcattttaggctcagacagactgtggggtttgaatcctggctttgctgagaccatacctgaacctcacacttcccaagaataagaagggggctacactactcacttcaaatgcatactcactagcataaaagtgccttgcacataaatactttgatactatggaaaatattaatctctcttcccttcagtttctgccatggctagaaaatgtgagcaagggaaacaaagtacagagttaggacacattgcctttgtttaaagataaagtcttagccgggcgcagtggctcacacctgtaatcccagcactttgggaggctgaggngagcagatcacctgaggtcaggagtttaagaccagcctgcccgacrtggtgaaaccctgtctctactaaaagtacaaaaattagctgggtgtggcrgtgcargcctgtaatcccagctacttgggaggctgaggcatgagaatcacttgaacctgggaggcggaggccgcagtaagctgagactgcgccactgcactgcagcctgggcgacagagtgagactctgtctcagaaaaaaagagatatacttatcaaattatgaattcattcaccatgcatgcatttgttaagcagtcactatatatcaggcactgtactaggcacaatggtaagtacctacctggaggacttatggcctctgcttaggaaaggtatatagctctgtggggaaagagcctcgtcagtaattacagtggagggacatgtggttttctaaaaactattgctaaatggtagagaagttaggtaggaatgtgtattttaacgtgcacctattttaagggattgacataaggggtgaagcaaggtggccaattattctattgtgagctcttcctaggaaggcttctatttcaccagtttggtctggctaactttaaatgggacacctaagtctgaagttggcaggcattcaaatgcatgtgcccttggggccaatctgttctattccatgccatgaaatttcagctggtgaggaagagcaactttgccatctcatcccaaaaatgtagaacaagtctaaagatctatatagaagggtagctacataaattatgaaatctctttaggacagaatttcatgaagttattgaaagcattttcaaggtctaggggaaacaagacagaatgttaaatgaaaagtatatattttgtatatatgctcttagctatgttaaaataatgcattcaacaagaaaaatattaaaagattaatggattaaggacaattattctgtgttttttttacattttataagatttctacaatgaggatgtttcttttataatcaggaaaaagttatgcttattttaaaaaacaattcattttattgccatagtttggctggtcgagtgaagcacattgttcaccaggccttctgggacgtcttggattcagaactaaatgctgaccctcctgagtttgaacatgccatcaaactgtttgaagaaatcagagaggcaagttgctttgttgtctgtgtcagttagcgtcttactccaggtgggctgctataacagactggcatagcctgggtggcttataaacaatagaaatttacttctcacagtactggaggctgggaagtccaaaatcaaagcaccaccagattcggcatctggtgagggctcactccctgattcatagatggtgccttcttgctgtgtcttcacgtggcagaaaaggcagagaagctctttagggtctttttgttgttttgttttgagacggagtctcgctctgttgcctaggctggagtgcggtggcacaatctcggctcactgcaacctctgcctcccgggttcaagtaattctcctgcctcagcctcccaagtatctgggactacaggctcatgccaccatgcctggctaattttttgtattttattttattttattttwttatttttattttttttgagacggagtctcactctgtcgcccaggccggactgcggactgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccytgttagccaggatggtctcgatctcctgacctcatgattcgcccaccttggcctcccagagtgctgggattacaggcgtgagccaccgcgcccagcctagggtctcttttataacagtacagttccattcatgtggacctcacccttatgacttaatcacctcccaaaggccccaccttctaataccattccattggggattgggtttcaacatatgaatttggggacagaggaaaacacaaatattgaaactatagcagttttttccccccaaagattgttttatgttctttagtattggccactctttttcaaaaaaggatcaagttcactggcagagtttccccctgcacctcctggagtagrgtgaaggctggaaaaatagtgccatggacacagcttagggtgatgctaaagcgcagagactctggtttagtgacgggttctctctttaagtctctctttcctgagtacttacagggtagtcataagaactaaatgaggtgacagttgtaatgttagctaacatttacaagggcttgctctattccaagcactagattgttcatttcttcttatcagaacactgtacagtagttgctcctgttattcttatttattaaaaatccaagttttctgactcatccagggtcacacaactttgtggggtagagagggacttgaactgagccatactggctcagagcgcaagctcttaagcatgtactgtatggataagcacagtgtcctctgtaactgaataatcaataaataggctgcttgtatataataaatattctatatgtaaaatatacttaatcgaccccatgggatattttcatctatccttttttaaagagttcttttggagccatgatctgcaccttgttctttcttccctgaacttttacctgtagacgttttgaaatgcagcagatcctcgcatcatattgatttgttcaacactttttctttataatgttgatgagaaaaaagatagattccagctgggcgcggcggctcatgcctgtaatcccagaactttgggaggcccaggtgggcggatcacaaggtcgggggatagagaccatcctggccaacatggtgaccccatctgtaactaaaaatacaaaaattagctggatgtggtggtgcacccctgtaatcccagctactcaggaggctggggcaggagaatckcttgaacctgggaggcggagattgcagtgagccaagatcacaccactgcactccggcctggtgacagagcgagactccatctcaaaaaaaaaagaaaagaaaagaaagaaaaaagatagattcctagctggggctgccatctgtgtggagtttgtatgatctcctcatgtctgcatagcttttctttgggtactctggtttcctcccacatcccaaagatgtgcatgttaagttcattgacaagtctaaatggtctcagtctgagtgagtgtgggtatgtgagtgagtgcatcctgcagtggaatggcatcctgtccagggctggttcctgccttgtgccctgagctgccatggtaggctcctgccacttgcaaccctgaactagagtaagcaagctggaaaacgaatgaatacaaattattgtaacataaaaattcataaagtcttcgatagtcatacagatgcacaacaataaacaatgtgccgtgaaagtgctcagtgagcctgccataattattatttatttttgaactgtgtggtggtaggaggtgttccttaagaatttttgtttgcaaacatttcttccccaytttaacctaccaccatggcagctgtcactcactgattcaccaaaaattgggtcaatcattatcttgtttttattaatttttcttgtatgtatagctcacatttatctcagtgtttaatattagaagtgtttggggtctttatttagaagtttggtgattttttttgtgaccagaaatatgccatagaaacttaaccgttgtttatatcaattagcctatcttaaaattggtttcattatatatcatttcacttaaagttgcaatttccaggaacctgtcagcaatattaagtaaggacttactgtgctttcagtaatcttgcttccttgctagctgtttttattctgacaggagcaggagtttcccatggtgggggccctttaattcagaagatagaccttgctatttagggttgagacactggaatgctcctctgatccacccatgcagtcagtgccaacttctgtggcatctgaggcactaaaatgtgggcaaagagcttggtcatctagacactgaggtgaaaagtgacagcttttattcacatcatgatgctgttaatttttatttctttccctgtagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgaggttagcacttttgctgtttgcatttcctagagtatctttgagttcattcagaagggaagttgggcatcagggaacacagaataacaactagtaccccaaataaattactgaccctagaagaaaaccatataagcagagaccatgtcaattatttactgtatgcagagagttttcacatagaatgatctgacaaggttgttagttggcacatagtgggccctgaagatgcaatgatgaaaaagacagatataatccctgactccagggagtctaatgggcagagagatcttgaacaattaattacaattgtgataagtggaaggggaagtagagggtcttaatagagcctccgacaagggacctaatttagtcaaggcttctttattagttagggtcactagctgctataacacataaaccctaaattctcagtggtttatccagtaaaagtttgtttctcatgtcacagtccaattcaggggtccttgatcagacaaccctccacgtgtcatccagggacccagcctcctcctgtgcttggctctacccttgctcaggtccttasagtcctctccattcagctggcaaatgggaaagagaccatggggaagacatatgcaatatatagccacctcagcccagaagtgacacattctctttgaccatgactagtcacatgatcccacctagattgaaaggggagttgagaaaggtagttacagcctggaaatacttttcacagccacaaatttgcactgcagggagggagattgggcctttagtggtcagccagccacatcttctggagcttctctaaggaagtggggtgcatattatgtcacgaggatctcatctggctacatagacgataacttccttgtgatccaagagggaagaagagtctgcaacactttttgccattgaagcagagttttcttttttgtgtatggtggccayattgagaattgagttttatgtaaatgttttggaaaggtaggagaaagactggtctgcatgtagtgggtaatttactttgcaatcttgggcaggttaatagactctcaaagtgacactctctgtcaaatgggtgttaagtatccttagagtcgtgctcggctctggcagattgtgattcctcagttataggatccttgcttctagttgtcgtattaccctagtaagatctcaaatctgtgatgttcatcatggtcatttgttgagcgcccactgggtgccactgccccctgcactttacnattgttatctcattgactgttcacaacatctctacaaggttgaggttgtcctctttcacagatgaggaaactgaggctcagagagactgatttacttgtgtatatgcccacaaatctggccagttgcaaagctgggtttgggcatgaggctgcctaactctaaaaggaagtgttttttcctcagtgcctcactgccttgtcctttctttttttaatttttcttattccctaaggaatagaggccatataccctgtgtcctggctctttaaaatttcaggggttttcaaatgaaaattccttcttgaatttttcttatatcattaagattgtttatgcttcaagtaattactcttgagatctgtggaaggacacatttgcagtacacgtgtatgagcttctatgaaacatgaccctaccaaatggcaattggaactttaaaaccattttggggatgtttattgttttcagcctggaacatagatmattgttagtgaatttcagcttcacttcttaatcatctctctattttaattctaaaatttttagacaaatattccatgtcctggacctcatgcaaatggacatggccaattttacaattatgagtctcagaccgcaccttcaacgccagttggtggaatatgagagaaccaagttccaggaaattttggaagaaactccaagtgagtataatataatgtgtatttatattgaaattaggttaaaatgatgattttaaatgttaaaatttaaattaaattaaattaaattaaattawataataaataaaatttaatttaatttaaattaattaaaatttaaaatgttaaaggttaaaatgaaaattaggtgatgttttcatttttgacttcatatatagtatcactaaagaattttggcctttctattaaacatttttttaccttccaaaattgacatcacaaacttacagttgtttattctgtccaggaactgtgctaagcactattcgtttcttcattcattcaagatatatttattgagtgcctcctgtgtttcagacactgcttaggtgcagtggatactgcagcgaacagaatggaatacagttgccgtccccaaggagctgacattctagtaggcatgacaaataaataaacatatattgtcaggtgtattattaagtgctatgaagaaaaataggataaagggacagtaatgggtcagaagtgaggacagcattgttttttagatgtgatggactgggaaggtctctgtaagtaacatttgagtaaagtttgcaaagaaatgaggaaggggcatgtaaagatggggaaaagaacgttctagcctgagggactgcaggtacaaaggcactgaagcagaaactgcttatgagtttgacaaacacagggcagacattgtgacgggagtagagttggtaaggggagagtggtaagagatgaggctgaaaaggagataaaggcaggtcacatagagcattgttagtaaatgagaggagtttggatttcattccatgtgcggtggaaactcatcagagagttttaatcaggggagcaacatctgattttcatttttgaagaatattcttgttcctggctacagaataggtcatgtgggaacaaagagggaaacagaggtaccaattaggtggnattacagttgctcaggcaagaaatgatggtggcttgttccagatggtaatggtggaaggagtgagaagagaccagattctggatacattttgaaagtggagtaatcagatttgctgaagattggataagggagaaaagagttgagggtgactctaaggtttttggcctcgtacaaccgggtgaatggtcatacagtttgagtgaaactggtgagaccaggagaaagaaggttgggagatgacatggaatcaagagttcagtttggtgatgtaaacttttgagatttcatttgacatcaatgtggagatgtnaggtaggcatttagatatgaattaygagtttacaggaataatggaaactgtatatgtatttgggaatcatcagtatatgtatgatatataaagccatggaactgggtactagttaacacttagaaaatccttatcacactctaagtactttacctgtacaaactaatttaatccttgcaacaactatatgaagttaccccccattttatgggtgcggaaactgaggcactgtgaggttaagtcactggcctatgtaacacacttaaaagtataggagctcacctaggaaggcagcttggctccatagtccatgttcctgtccattatattacactgggtgagactacctagggggagtgagtgtggactctgaaagaaactgacgtggggcactccagcagctagaagctgaagttgagatgaggaggagggtctaacaatggagactatgagggagtagccagagaggtagtgtgacagtcaggagaggcgggtgtcctgtaagatacgtgaagaaggtatttggagaaggaaggcatgtttggatttgacaagcattgctaagtggtcaagaaagacacaggccaacttgaccattggatttgactgtttgatgatggtcagtaaccttgatgagagtggtttcagtggatttgtgtgcattaaagccagactgggcagggcacagtggctcacacctgtaatcctagcactttgggaggccgaggcaggcacatcacctgagatcaggagttcaagaccagcctggccaacatgctgaaaccccttctctactaaaatctaaaaattagccgggatgatggcaggtgcctgtaatcccagctgctcgggaggttgagatgggagaatcgcttgaacccaggagatggtggttgcagtgagccaaggtcgcatcattgcactccagcctggggggctgagcaagactccgtctcggaaaaaaaaaaaaaaaaaaaaaacccacacacaccagactggagggggatcaaggaaaaataggattagaagaaatcttagctcatcaaatcttcacaattaccagttacccagtgaagtaggtactgttattccctttatcttacaggcaaggaaactgagatgccagaggttgcacagctgcaagaggctggctaactgctcattggcaaactcttgacaccagcctctggggtttaattaaccactatttaaggctgagttaggtggtttctgccgagataatcaacacaatggccttatataaaaaagacaaaacaggcgccacatttaaaggggccctggcaggcaggagcacatccaggggagagcacattgatcatggaggccacctgaggaaccgtcgaggaagctgggcatgttctgcttggtaacaaggagactcaggtgggccatggccccatccaccctccctgttgacagcaactcagagactggtgaaattctgtagggcagactaggattcatgagagggaggaagcagacagctggttttgaccttcctgatagttggagctgttttaactttggaatgggcctattatagcagtagtcagtgctagctaacattttgtatgagcacttactacatgctaagtccttactgtaccactttagtagtctatncaagcatcacactagccctatgaggttggtactgttatcaccccctaatacaactgaggaaagtgaggttaaggtacttagtctagatgactactagtaaggggtagagcctgggtaacccagatgtgtctctgactcaaagcgtgtgcatttagatactgtgcaaccctgcctctcttcaaacaagatatcaactgtgggggatattgcagagggatctctcacatcatctggcagattatttagtcatctggatagccagttatctagtcagataacttttaagttttgttctataacaaaaactctatgactccaagggctatgttgttttagcttcaaaggggagggagtaaagtgaagtagaaccctacatcgaacctggatctgaaacctcaactgtggcaactgtccacagcagcatttctctgagacttagtggttgctttcatttgtgtacctgtgtatgtaagcacatgtacaaatgcacccatatctttmatcaagatagcttggaatcttgagcaaattctctaatagggtgaattatgattttcttcatctcaaattatttgcctattttttttctgttttttttctttccttcttttttttcccccctgtttgtctttaagagacagagtctcactctattgcccaggctggggtgcagtggcatgatgataacttactctagcctccaattcttggactcaagggattctcctgtctcagcttcccaagtagctaggactacaggcatgtgccaccacgcctggctaatttttaaaacattttttgtagagacgggggtctgtgttgctcaggctggtctctaactactggcttcttcctgcctctcaacttgctgggattacaggcatgagccactgcacctggcttgcttctctttttaaaacccaggcttagtgacctgtaatccatttgcaacttttctattgacttggatattttcagagatttaagaatagagcaaacccagctttgcatataggtcattattgcttagcaagagaaatcaagagtcccagaagcagagtgtatgtcagctgttaattatgtccccaagtcactctgccaaaagtcagcccctgtgccctaatatcaaaataagagcctcaaaatgttggatttctgtgtacacatgattatataagaattattagaaaattaatacagagaagtactctagatttctgaattggctccaggaaaatattttattttgcctaagaggagattttatataattgcctattttaaatatagccaggagaaccttaggaatgattatctgtactaagtaagtagcaacaagataaccacattagatccaacatgtaaattatctgtgaaaatagcaagagattatccctgggtgggggccataagtaatttttaagatacccagaaagaaaggctttatttagacaatacgtcatatctgatcaaatgttttcatgaactttatttcatgttattctttaaaaaaattctgtgggacataaatatcactttcagaatatttgaaactctattgtgattgccttcacctgtcacatgaggggttcaagaaatatttatggaatattttaaagaagagcaaactgatgctcagtgatgacctccttagactcagaatcattcagctaagtaaacagtggaggctgggcgccatggcttacgcctgtaatcccagcactttgggaggccaaggcgggcagatcatgagttcaggagatcgagaccatcctggccaacatggtgaaaccctgtctctactaaaaatacaaaaattagccgggtgtggtggcgcgtgcctgtgatcctagctacttaggagactgaggcaggagaatggcttgaacctgggaggcggaggctgcagtgagccgagattgcgcctctgcactccagcctgggcgacagagcaagtgtctgtctcaaaaacaaaacaaaacaaaacaaaaaacagtggagctaggactggaaaccaggtctcccaaatccaagtccagattaaaccaagctgctactttttcagccttctttgaatttttcagttttgtgttatattacctgagttgtaytgcaaggaacagaaaccaactctagctgacttagccaaagggaagtgaatggaaggatggaggaagtttgcagaatcaaaggaaaagccaaaatgtcagaaatcagaagaatgtcacaaatctggataggaaaaaccaagggatagcaaggctccattgtcacgatggttgatgtgggctgtaaacgtaggccatccctgaacactctcaccactcagatcccgggaaggagtcggctctgntgggcacgtgactctgctcggccagcccctggtcgggaagatggggcctctgaattgagactcacaaaagaaaacatggaaccagaggaaatggtttctcagagaaagccagcaccaaaagaagggaaagtgagatgttgccaggcaaaaaaaaaagatgtcatggataaggaaactacatttttccaactgaaaattggggtagaagcacgtgtaataccattgcttgttctggtgtctgtctctcccttactagactaggaacttctcgagtgcagggactgtgcttatttacctttaaatccccagtacttggtacaatacctgggactgagtaggtgcccagtggttttcgtcaaataaacgaatgagtggaaaaattcttaatcctgtccccaggaaaagccgaggttgcaggtgcctcatgaggctgaccttgcttttggaaccagagagagcagtcaccgtgccagcctgtgagrgtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttyctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcagacagccccagtagagaattactgcctccaaactttcagcctcctggaatagccttggcatgtcaaatttcatttagttcatgatgtaagagacattttattcaaagttagaagaactacttagagcaaaagtaaataaaaactatttgtcatctaagtccgtggttctcaacgtggttctcttaggggtgatttttgccactgcccccgccccacaacatttggccatgtctggagacacttgtatgtcccatcctggcagggcagggcgggaggctgaggaagggcatctagtaggtagagcttaggtatgctgctaaacattttatagtgaacagggcagccctcaacaacgaagaattatccagtccaaaatgtcaatagtgccgaggttgagacaccctaaataaagaattggaatgaatccatttcgtgatgacccaaggaaccatcttatgctccaggaaaatttgggcttcaataagcaaggaagtctggtggccgttgagcacttgggggttgttttgtgtttggaatcagtctgatttcagctagtcatggctgctggtgggtgcctccttcttcttgccttctttccattgtctagagggagccatttccacttgcagaagcgagcccttgcagaggcatcttttgaagcaactctgtgtgagttgtttgtcatagaaactgctagcaagggaactctgctaataataactattaggcacctagtaacctatattntagtaatatttaagtgccatatgcttaaaaatgaaatgaattcaagtataaaacctcatttccagtgatacatattttttatccagaagaattgaacttgataaacttgtctaaagtggaaggacaatctaactggacattgtytttaaggtcatagtctttaaggtcaaattaagtatgagactcaagttcagtgatttcttccttcctcactgcttccttctccctttcccatcttgacttctggaatagcccttgccaaataccagggatcatactgcataaactagattttcagtgtctgcatgttttccagataacatctcctttaaagcattggcttttctttaaggagatctgctgagattctgctccctcaagctagcacgctaactggtatctacaraaagaaaagaaaagaaaagaaaaaagccaagttcccaaaaaagctcattttaaccaccccactgcttagcctactcactctttttattccacgggtgatcactttgtctgaggcaactttgttaataaggcagctgttgtgtatcaggcagagaacctgactgggccctctagagacaataatccccgtctttaaaggttgtttacagagtttacagttgctaacacttaggggacatttcctttgtgccagaaacggttctaagtgttttgcatgtactagtttgttgaatctttaccacagcttcaggaagaatattatccccaattcacagacagaggaaactgaggagacattaggtaacctgcccaagacatacagctaatgagtggtaaaggccagaccgaagttgagactgcctggctcagaggccacggctcccaactactgcaccagccacttgctctgcatgggggagcytagcacaagttcttagtcacatgttgattgctttgatattaggttgcactaaattgagattcattcatctgcaatgcaaatttgactccccagtcaagctgcttcttcattctctgtcttgctttctaaactgttgcagcagtctgttgctgatcagtctctttgcactgcaacttatgtttatgttcttgtcaaatctgtttcaaggaataaatgtaaaagacttgcctgcctaattatactgggctctgtttgacagataatcagttttagaaatggacactgtcagtggtaagctggatgtggtcggtacagacttgggagccatttgctatactttaaggaattttgtgagctagtaaacacagccattactaaaaattaaattatataaatttacaattaaatacattatattaaaaacaaaggtaaaactctgggaaatcattaggcagtttcttattaaacgcagttacaacctagcaattgcaatactgagtctttatccccaagaattgtaaacttacattcacacagaaacctatacataaatattcgtagcagccttatttgtataaccccaaactgaaacaaccaaaatggctttcaacaggtaagtagataaacagactgtggtatatccatacaatagaataccactcagtaataaaaaggaatgaactattgatacatacaacttggatggatgcttagaaaacaaagccaatctcaaagggttattttgctggtctgctcaggctaccataacaaagtaccacagactgggtagcttaatattagtttatttttcacagttctcaaggctgaaagtccaaaatgaaggtgccagctgatttggttcctgatgagggctttcttcctggcactgcagacatgcctatttctcagtgtgtgcagatggaaagaaaaagaggaagctcttttttttgtctcctcttttaagggtatcaaccctcatgacctcatctaaccctaattacctcccaaagtctccatctccaaatgtcatcacagtggaagttagggcttcatgatagaaatttgggtggcaggtggacacaaacagtccataacagctacatattgtatgattctatttacataacattcttgaagtgacatagttttggtgatcagtggttaccagaatttagggttgaggtgagagtgtgactactgggaggtaacgtgaggagatattttatggtgatggaatagttgagtatcctgatggttacagggatccacatatgtaacacaatttcttagaactatacacacacaaaggatgcatgcaaaaactggtaaaatcagtataagttagtggtattgtacccatgtcagtttcctgattttgacaatatactatagttatttaagatgctgtccttgggggcagctgggtgaagggtatacagtaactgtctgtactattttcacaacttcttaagtcttttattttgaaatagttaaagctatttcaaaatttaaaagttatttttaaagccctaaaaaacaatgaactgtgatacataagtcggtgtggataaatgtcagaaacactatgctaggtactttatgattccatttatatgaatttctagaaggcaaactgattcatgcagttaggagttaaaagtagttgagtgaggtgcacattgactggaaagggagacgagagaactttcttgggtaatggatatggtttatatcttgttttaggtggtagttgcacaggtatatagaatagccaaaactcaccaaactgaacacttaagagctgaacattttattgtatgaatttattatgtctgtaaatataaacatatttatatatgtgaaaaaaacaaaataattataaaaagtaaaggtaaacaaatactaaaaacgcttcacttccaaattatcttactattgtctatagtcttgacattaaagaatctcaagactgtacatataacaggtataaagtacctgttatatctggatgatggaaacactatgtagcagtgttctgtactgggcatctctgctcaacttcatatttaatgactctcctcccacttgctcgttctacaaatgaggaaatcaaaagctcaggagagaagtgagggctatagatacagatttaggagccttatggggtatgggcggaaatagaaaccacaggaatgagtaagatggtctagtgagattgaagagtaccaaatcagtggggattgggtagagtgcttggaagtatcaacatttaatgaacaggcagaggaacatcttcctgtaattgaagggagatgcacctgtcttctcaacccaagtatgagatgcagaagcacagctaggggaaaccaggaaaaagtggtgtcagaaaagccagggaaagagtttctggagggctgtactaagagatgtctgtattacagagatgtttaaaaaaggtaggaaggacatgtttgttggatttgacaaccaggtggtggccttagaaaggttatgggaaggatttatttcagaacctctctagcctatattctgtatcttggtagatggcacaggcattcattcagatgtccaaggtgcaaatctgggagtcatcctagaatactcctttcctattctctacatgtaagtggtcaccaagacctgtgggtactccccctaaatatttctcactttttccctctttacccctcacttccactgcccttatccattcactctcttgtttgaaccactgcaataatttactctccctccactaattcagtctttctttccaagcaatttttctgacatacatatctgatcatacaggttccatgttgaaaataatattattcagccgggcgcagtggctcacgcctgtaatcccaacacttttgggggccaaggtgggtggatcatgaggtcaggagattgagaccatcctggccaacatggtgaaaccccatctctactaaaaatacaaaaattatctgggtgtggtggtgcacgcctgtagtcccagctactcaggaggctgaggcaggagaatcgcttgaacatgggaggtggaggttgcagtgagctgagattgccccactgcactccagcctgggtgacagagtgagaccccgtcttaaaaaaaaagaaaagaaagaaaataatattattcaaaactccccattcccatcgctggtgtttgtaacctggggactrtcaatctggtaagagagaatgacaattgtttgtggacatgtgcacgtgattgtgcacattcactttgggaaaggcatatctccaattagttattaaaagtggtccaagacccaaaaatgtgtaataattatactctattttctcttcagattgtataaatctttcaccttttaccaaaaatgtgtgaaaattaatgccttttctctaaataccttctctgcacaaactcaaggctggcttctaaccacccatccaatgccatttgctacaaccctcttacccctagttctttatggaccagcaatacagatttgtttgtggcatccagaatgtgacatctagaatgtgccatatgctgtcttttccagagcacttacagagctcttcctcttagattctttcctggacagcctctttcccacaattactagcattcattgtactctgttataattgttagtttacaggtctgcctttccatctggactgtaaactccttgcagggcatggctgtgtcttctcattcatgcccagcacccaacacagcatctgtcaagtggaatacaccagtgaagggatcaatcagctgtagaacaaatatgtggccttttcactcttaggtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagaggtgagtggttttgttcttcacccaaatttcccagtatttttattcttaagttctaactttgaatcatctggtctgtgtttcatgtggtttaatgactttacaaaaatcagataaaaatgggaatttggaaatgacattgcctgttttgtattttcatgctattgagctaccctttctatttttatattttaaataaatatgttagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagtaagttccaaatttttgcatctgctccctcttgtattaaggytctgcatgtgtctcagagaacaagaatgaccttggacatctggatgtgagattcaggactgtgctttagagaagcttatcttacacctttttctagaatttcctttaatatctctgaaggcttagatgtcctctcataggaagggagaggtgttttccatgacaagtgccagggtgagtgtagtatttccacttacaatgaatgtgtacaacagcttttctttgacagtgctttggaaaaaaacaaatgaaacacagaaatctgccaagcttgatgtttagaattgcgcaattttttttttttttttttttttttgagacagaatctcgctctgtcaccaggctggagtgcagtggcgcaatctcagctcactgcaacctccgcctcccgggttcaagcaattcttctgcctcagcctcccaagtagctgggactacaggcatgcgccgccacgcccagctaatttttgtatttttagtagagaccgggtttcaccatgttggccaggatggtctcgatctcttgacctcatgactcacccatctcggcctccctagaattgtgctattgaagagggctttcctccagttgttctgacttcatcatttttctgcagtgaaatgtttactgacttcacaaatccaccttgctacgaagtcttcagaagtgctgacaattctgcccttcagagatgtgacacagtccagtgaagattttggtttttgctaaatttatctccagtattacaccttcatgaatgctagaatcccatttagattttgcatttacatcatccaataggaattcctatctaagtcagaaaattcttagtcttggtgaatggccagatggttctatgggtctcttatggatcagcttctgctggttcccctttcaggtgtcttcagaggcatgtcctctttattcctgtaattgaagggaaatgcacctgtcttctcatcctcccacctattattcagagagcatataaattacttgatgaaatcctagactattaagagccaaaaggagcccatgtagttacagaatccaacttctcattttgaactgaagcttacagatagaatagaatttgccttgggctgcaaacagaaaagggcagaccaaggactgagccctgatctgacctttctcctgattctgatgctcattaatattccaggaccaagacctataatgaaaggaaacctctgattttgcagttggtcttatcttatgatttccctgcatgggtagtcattactttccagaaacttttatttattaagcctttagggaatacccagtgctgctgaaatgttattataaagtatacagaaagtggttactaagaagacaggctttcgggtcagatggaccagggtttaaatcccagctctgctactgacttattatgaacacttgaatatgttctcaaattactatgagcctgacttcctcacttgtaagaagggaataataattgtattaatatctaccttggagttgtgagaacttaagatgattcaggtacagatgtgtggcacgtaatatgtactcaatgaatgctagctattaataactagtcattaaatcatcctctttataaytgtatctggttgtttatctggttgtttcattgtttaaatttttttcctgtgttaggaaatcaatacaatcaattctcaattatcctcattacggatggggcaatagcattcatagtattaaaaaaagggatagtactaaataatagaccaagatgtcatttatattgggtttgatgatgcatcttgaaaactagaaggagtttttccctcttcattgtgagtagaaggcatggcttatgctaagacaactttttttgaagagctgaaagaggatttattgattaattgatttttgctttttttccctttttcaacttttattttaggtgtaggggcacatgtacaggttttttacgtgggtaaattgagggtcactggggtttggtgtaccagtgatttcatcacccaggtagtgagcatagttagtttttcaaccctcaccctcctccagacctccacctttaagtgtaggagccagtatctgttgttcccctttatgtccatgtttactcagtgtttagttcccacttataagcragaacatgtggtatttggttttctgtttctgaattaatttgcttaggataatggtctccagttttacccatgttgctgcaaagaacatgatcttattctttttacagctgtatagtattccatggtgtacatataccatattttctttatccagtccaccattgatggtcatctaggttgattccatgtctttgctgttgtgaatagtgctgcagtgaatatatgagtacntgtgtctttttgatagagtgatttctattcctttgggaataaacccagtaatgggattgctcagttgaatggtagttctgttttaagttattttagaaatctccaaactgctttccacagtggctgaactaatttacattcccaccagcagtgtataagtgctctcttttctctacaaccttgccagaatctgttattttctgactttttaataatagccattcaggctgggcacggtggctcacacctgtaatcccagcattctaggaggccgaggcagccagatcacttgaggtcaggagttcaagactagtctgcccaagatggcgaaaccccgtctctacaaaaaatacaaaaaataattagccgagcatggtggcgcatgcctgtagtcccagctactcaggaagctaaggcaggagaatcacttgaacctgggaggcagaggttgcagtgagccgagattgtgccactgcactccagcctgggtgacggagtgagactccgtctcaaaagaaaagaaaagaaaaaaatagccattcagactggtatgagatggtatctctctgtggttttgatttgcatttctctaatgattagtgatgttgagcatttcttcagatgcttgttggctacatgtatgtcttcttttgagaagtatctgttcatgtcctttgcccattttttaatgaggtcgttttttgcttgtcgagtgtttaagttccttgtagattctagatattagacctttgttgaatgcatagtttgcaaatattttctcccattctataggctgtttactctgtggataatttcttttgctgtgcataagctctttagtttaattaggtcccacttgtctatttttgcttttgttgcatttgcttttgggtaattcatcacgaaatgtttgccaaggcctatgtccataatggtgtttcctgggtcttcctttagggtttttaaaggtcttatagttaagtctttaatccatcttgagttgatttttgtatctggtgaaaggaaggagtccagtatcaattttctgcatatggctagccagtttccctttagcctaagaactcactgattaaaagcaagaaaaatctagggcagtacattgtagtggataaaaagtcggaaggtaaaaattttattacaatsagtctatccttgggttacagaattccaacgtcaggtccagtgtgggcttataacaaattccagtcaaggcagaatgccaagaacttatttcttattgctgttaatgatgataaacatgataacctatttttctcttttccttcttccatgtgcctgataatctgctaagagctaaatattagacacatagaagttcagtggtagagccaggatttgaacccagctccacataacaccatagcttatgttccaactcgctccgttatactgcttcctatcattgagcccttctctcatcctttaattcccattttgcagagttatcttaaggaccttttctggatagtgagataaaattttcagtcatctttccctaatagtgtggacccaacaaatgccttttctaattacctatttttccttacctactaaataactcactctttaattacctttacaactttctggactctatatattggagattatttatcagttacttgaataatgtgaaggagcttattatcnttggtcatgatcagccaaaagttctaggtatttgacctctgaatatcttcatttgttgtttttgattggtgttatagatttactgctcaggcatagatgaattgagtctacttcatttatcaagtgcattttttaaaatgtgtgaatgaatccactcagaccaacaagtttaagaagtaaattggtgttttctgtccctttctgatagccctgcaatataaatggggttgcaggtgcatttttggggaccacattttctgcttatgcttttctatttaaacactgctacacaatttaatgattttaagcatttagaagtctgctacatcagaaggttggtggttgggaggagttactattttatragttcattctaatagaggttattattgtctgtataagagaaatttggtagacatctaaaacaagtctgtatattaaaaataataacttgatgaacaaaaactttccctggtggaatttcattttatgtttcataggacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattggtgagtccttttattgatttctgcttcaattccaatttgctttaacttgctgattttgactaacattaagtcagtcaaattttgatcttaaacacattacccacttttggaggataaatattgaaaatatcaagaaatattaatgttttcaaaggcctaggactcattgctgcttctgtgtgtcatggagttgggggatgtttcagggcctattatctattcagccaatagattttatgacaagaataacagagtgctggagtaatgttaaaatcctagatcaatgcagtaattcaaaccagctggcagtatgttcacagatagtagatatgagttctgctgtgagcagctctgaaggaacttggtcaggcttaaagagacaaagactaaaaatgtgtggatccgggagacatagtgtgtaggcttctttttgtaatggtcagccaggaaattgactgtctcaaagtcaagctgtgttggtgagttgggaaaatggataatgtatcagttaggactttttctgctacctgtgacaagaatctaaacttctaaactagcttaaacaaaatgatcatttattttctcatctaactgaaaagaccaggggtaggactggcttctggtacagcctaatgagagttccagctgtcactggcactagttttcccgcctccagctctcaacactaccttctcctgggccagctgccttcacaggcagacttttctcatgacagcaggatggctttagctccagcctacaaccttccatatttaagtccagtgaaaaacaaggaatctgcctccctgttggctcaaacagtgaccccatcattgagtctcagtggctccagttagcctgactatggttcatgtcccattcttgaattggtcatggtggcctgaggggaagaaagttaagcctgagacatgtattcacctcctggagccaaggaagagtcagttttctctgtaacacctgatgagagtagggaggagatggttacccccaaataaaatcagagtattgtggccataaggaaggggagaagctgccgtgtggtacaaagcagttgtctactacagaggttgaaggatgaaaaccaaaagtagaagagtgtagaattagaatgtactaacctgctaggactaatctgcaaattttcaaagtacaacattgacggccttaagaatacaaatacattttattattgatttgaggctttcaaatggtgktgttcatccttatccctggggacatggaatgctggggatccaagcttcaactttgcccccagaaaggaacagtgttggtgtatacgacattgtgggctgctggagaggctgctcctaagaggggacagttgataacaataacagattatgaccactgtcacctgtggccaagcccttatctatataccttcacatgctgacatgcatctgtcctcagagcatgttgtccccagctgaacaggtaaaacctgagagatggtgttctaggaggaagagggatagagtagggactgagacactgcccagcagtctctgcagcatactgccagatccccagtagtgtgcaggcctcatgaggacagcgtgcaggtttgttcactgctatattcttgtgcaatgctgcacgtgcacatatatttaataaatatttgtgaaatgggtaaatgcataggagacttggagaggttaaataactttcactcaaagtcccataacaagctgggggcagagtctgtcttccccagcctgtctgactccagagctcatgttcctaactgctctgactggcacgtcagtcagagctggagcgctgttgcttgctggcagagtggccagagtgtcagagtgtactctgtgacttttctttggataagggaaatgcttgcagtatcagaaggaagagggaagctgagggctaggagattcctcttaaaatctggtaaagcaacttttgtccacccagctttccccagtccaactttcctgtccttttgcaaattgaaagcatttttaatctcattcaaagtactgttgccctagcaacttaagtgactcacttgaacgtctcttcttcgactctggaagccaaggacacgcctttggcagggactccgtgtggctgctcctaactttacaaacactccggtcactttagcctttgcctaaaaacagactcatctgcaaaagaggcaaaagaggcagaaccacttgctgacataataaggattttgaaagggtttcatttttaaaccttcttatgggaaagcgtttggatcatatctgtgatgatatagacctgggcctctgaaggtcaggcaactagtctaaagggaaagtagtacacagttaactctaaatgtatgcctgcagaggagttagaataaattaaacagagagattcctggaacctgagaagggcttgatcagtgttggccatggttttcctctgctaagggtacccacagtatgctttcttttgttctcagttgatgcgctatttatttactgaagggattataatccccaattcccattacaattcttaaccttttgaaaagatattagaaagggatttttctgtcgaatacatactaagtaaaaattatggattacctgctgtgtaaattatttgcatgcctacgtctactttttttttttttgagatggagtcttgctctgtcgcccagtctggagtgcagtggtgtgatcttggctcactgcaacctctgcctcctgggttcaagaagaatacttctgccccagcctccctagtagctgggactacaggtgcggaccaccaagcccagctattttttttgtattcttagtagagacggggttccaccatattggccaggctggtctcaaactcctgacctcgtgatccgcccaccttggcctcccaaagtgctgggattacaggcctaagccactgtgcctggcctgccatctacacttttaacaagtaatttcagttgcacaggtgatacaataatttctccttgtagaaaaattacagacaaaggccaggcacggtggctcatgcctgtcatcccagcactttgggaggccaaagcaggaggatggcttgaggccaggagtttgagactctcctgggcaacagatggagaccctgtctatatataaaaaaagaaaaaaaatacagataaggcttaagtcacctttgtttgccttcttcagtccccattttcccctggctgccacggttttcagttcgttatttatctttatagactcttttcagtccattctcacttaagttcagtcagcatttacaatgtgtctgtcacatgacagaccaagaatataaagataaaaaagatataaacctcacgctcagagagtccactgtccaagaagggagagagacaccttctcaactggcaatcatatgtcacgatagtctggtaacagatgctaaggaaagtcacagaaaggaggtaacttttggcacgacattgaaggatgcctctgattctgggcagagatgagatgaaatgagatgagattgaagggcattctagtaaaaggaaagaattctaagacatagacattggaaacaagttctaggtcagacctagctggaatgtatgatttttgtgagcattctttggtgataagaattttagtagtatcatagttgtctatattcaatgtggcatattttccttagtaaaccttcttattggtgaggtttctgttcccaaagccagagaaagcccttggagcagcctgagctatagcaggtcttttctgtccagtattattaatagttgtcctatactattgcagcctgatttccatatgcatttctatgcttttgtgtagtcgtctcaaagtcaaatacattgaggcagtgatgcaggaagggcagggaaggtggcacaatggtgtgctggttgggatgtcccttcctcagtgtctcctgattcttggccatgtgtgaagtaccctgtaacttatttagtattaattaattatgtttgagatggagtctccctctgttgcccaggctggagtgtggtggcatgatcacagctcactgaagcctcatgagctcaggcagtcctctcaactcagcctcctaagtagctgggactacaggcacacaccatcatgcctggctaatttttaaattttttttgtagagatgaagtttcactatattgcccaggctggtctcgaactcctaggctcaatcagtctcccacctcggcctcccaaagtgctgggattacaggtgtgagccactacgcctggcaccatgtaatttattgttcaaccagggtacttttgagagtctctttttaaaattatgccaggacaacaggtgtaaattttgactgtcctggggaaacctagatgtgtggtcccccttgccatgtggtaatttgggcccccaagtttgccagatctctagatttttcaagagaaagcagaaatatggatttctatgtgaaatctcctgattttaaatggcttctgtttttaaaaaagacactgcatgggccagactggcaatgccagtttacaaactcagctttagtgtatgtaattataatcatgaacatttaggattaacttttgtagaagattccccccaaatagggctctgcctttttttttttatcagtcagctattgctgcataacaaaataccacaaaactcctgagcttaaaaaaaataagcatttattattactcaccagtctgtgaggcgaccggstggctcttttggtcttgctgaactcactaatgtatttgtggttcagctgtgactcaggatggaagctttgctgatcctggctggactttctcaggtgtttgaatgctggttggctatgggttggtctaggatggcctcagatggaacagctgggtttccctctccttggtctctcatcctccagcaagyccaggcctattctcatggyggtagtaggtagacggtggacatgaacaagagtggcctcttgaggccaaggcatgaaactggtactctggcatttccaccgcattctgtattggccaaagtaagtcacagggccagcccagatggaaaggatgggaaaaacacactccagctttgataggaggaactgcaaagctaccttggaaaggggatgggtgcagggaggggtaaagaattgggaacattattgcagtcaacctactacaattacttgttcttgtttttaaaaattatgtactttaataatggacagataaaagtatctttttttccccttcagataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaaggtagatgcttcacctcctactaactaaagaagaactgacattggacgagagattggaaatccagtactttggtatccagtccacttccattgatggcattagagatccagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacayatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgtatttgaaatgtacaattacattttattaatgtgttaatagaaactttcaaagtaagtcctcaaattccacaaatgtaccaaatcacactttataataccaatggtcagtatttatttagaattttaatgtattaagtacattttcatgctatatacaaacttcagataaaacctcccttgtttgtttagtgaaaatagaagcaactcccttctcaaattattctagaagtttgtttcttcttacaatttagtctgctctccaagaaaaacaatttttgcacaaatctcttagtgaatgtccttgcagttctcaggccattgataaggtttatataagagtttaatatttttatgtgaggcagggctcatttggtttacttgtaagaagaagaaagggagtcaatgataaaatgagatcccattctccatgaagttcatatctgaaaaagaaacagttaaactttggatttcttacccatataacttaactaccagatgtcttttgtgctgatgaaagctttaccgtgttatgaccaagatgcccttctaaggatcattatcatttgcctttttttttttttttttttttttttgagacgcagtctcactctgtcgcccaggctggagtgcagtggcgtgatctcagctcactgcaacctctgcctcctgggttcaagcaattctcctgcctcagcctcctgagtagctgggactacaggcgcccgccaccacgcccagctaatttttgtatttttagtagagacagggtttcatcatgttggccaggcttgtcttgaactcctgacctcgtgatccacccaccacggactcctcaagtgctgggattacaggcgtgagccaccatgcccggcctcatttgccattcttttttttttttttttctttgagatggagtctcactctattgcccaggctggagtgctgtggcacaatctcggctcactgcaacctctgcctcccggattcaagtgattctcctgcctcagccttccgagtagctgggattacaggcatgcaccaccatgcccagctaatttttgtatttttactagagacagggtttcaccacattggtgaggctggtctcaaactcctgacctcgtgatccgcccgcctcagcctcccaaagtgctgggattacaggcgtgaaccactgcgcccggcctcatttgccattcttgagcgttaaatcaaaccttgcaaagttgggcactagttgccactgagactttagagaaatctgcttatcctggaattactcttcttggagtgctgcgggaagcactgcagttgggaggtacttggtctaaaaagagcttcatttgcataaaatacatttttgattgttttgtttgctaaggactcaattgagccctagtaatttggtgaggtcgagtgggtagaaaataaaaagaagcattcctttcttccccaaccttcttttcctcaccacaaccttcaccattacggtgttacttcattattttatgaagttctaggaaatgattgtgtgaataaattgtctccattgtttatatttggggaaatctgccaaaatttgaggaaagtataaacgtcagtttttttttttctcacaatgcccaatacatcagccattctctccacgtaagctgctgcatgcaagtggagtattactgaagagtacaccattggtcttagctatttttttctcttcctgcagtcctcttctgcccatgttttcctatacacagcaactataaggtgctgaagacatttggttttctcttaagctgaaggagttctcagctgttctgtctttggggcatgggcatcagggagattctgacagtagaaaggtattatgtagtgtgatttttttgttgctttctggggtgaactgtatacttaacaggtggtgtacttttttattaccagatttgaatccagctgatgctcttttatactacagtggccagcaggaaaacaatgtacaaactttttttttttttaatgcatttaaaatgaagggcattctgcctttttttttttttttttttttttttttttaggggcaaagtcaatcttaatgtttcaagtctggatttaggcaactacatttactaggattttttaaattgtatcccttagcatgttgtttatttggtttttacttaaatgtttacttctaatgttttcctaacatggtctcattttgtaatgtaaatttgtattaaatgccatacacacattttcattcttctgctaaaacatgtattgtgtgcacttactaaattttaaagcattaaaaattatttcaaaatagccagtgtctctgttttctaaaccacttctgggtagcttggggctggaatattggatagtctttattggatagtctttattggatagtctttttagaatgattcttgtgctgaccatcagagccttacagacatcaaatcatgtttattcacacattcattcattgagtcaacaaatacctattgagcatctgctgtgtgcctgccaagaagtatcccagtggttgtgatacatacatgataaaacatactgtcttcaagaagtttacaatctagtgagaaggacaaacttgtgaacagttacaataaagtgtaatgagggttaaaaaataaggccggggctggacgcaatggctcacgcctgaatcccagcacttcgaggccaaagcaggtgcatcacttgaggccaggagttcaagaaaagcctggccagcatggcaaaacaccatctctattaaaaatacaaaaatcagccgggtgtggtggcacatgcctgtaatcccagctacttgggaagctgaagcaggagaatcacttgaacctgggaggcagaagttgcagtgagccaagatcttgccactgcactccagcctgggtaacagagcaagaccctgtctccaaaaaataataataataaataagcatagtgctagggagaagatggtcaaactctatttcataaagaagataattctttagctaaaacctgagagatacataggaacttgccaagaggccacaaaacaggccaagtgcacagtaagtacaacagtagggagaaatggtgagccagggatgagagtaagttggaagaatgaaagtgatgaatgagaggtggccaggcgcagtggctcacacctgaaatcccagcacttcaggaggtcgaggtgggtggatcacttgaggtcaggagttcgagaccagcctggccaacatggtaaaaccccatctctctactaaaaatacaaaaattagctggatgtggaggcagacacctgtaatcctagctactcgggaggctaaggcaggagaatcacttgaacccaggaagcagaggttgcagtgagccgagatcgtgccacttgcactgcagcctgggcgacagagggagactttgtctttaaaaaaaaaaaaaagtgatgagaggtgaaacaagaaagatgaaaaggttctcggatgccatgctaaaatttgggcggggggcaggggttgtcctgaaaaggaagaagaatcattgaatctcttgaaacatgagaaggtcacaaacaaaatctatgttttggaaagattgccctgacaacacttgttgatgctagaatattcctacgtctagtgtatgtatgtttacatgcactcacacgtgaagacatgataccagcaatttaaatggactctggttaactgaagcagaaaaggagtttattggatgggcatgaaatacctcacagaatctagttaatcagagaggaaccaggtttggaaaatggacaggaaccaaggcgatgcaagctgcaggagtccgtccacgctggaatcagtgctgcaacttcagagattgatttctcaactgtctttccttctttgcctcatttgcttaagatctaaagtcccacatatcaagattcagttgagtgagtcttaagtgcccaggctttaatttgcaggggatggagtgagggaattacgatccttacactcctgtggtcccaccaaagtcatccaattagagatttctcccaaattgagagggcatgccgagaagcagaaagagaaaaataaatccactgtaatgaacattcatgaaatctttaaaatttggatgtgagaaatgtgtgagaccacccaaaccagcagtgcttctgagaattatacaaaagatgatttaaggaaaggcgtagttacaagaagtcaacctttcctaataagtgtaggtgaactgctgaacaaacagcccccaagtctcagtggtctcataagctcatttctcaaagcatagttcaaagcaggggggtagagtggcgttggggggcgggtcttccatttagccatccagagacccaacgtcatccatgtcatgactctgctgccctctaaatcttcattcactcagctgatagggaaagaaaaagactgcccacttccactcatgttccattggccagaattcaataatgtggcctcatcttactgcaagggaggctggaaaaagtgcccaggagaaaggctgtcatggatatgggtaagcattagccgtctccacttcgggtcccttccagtgaaccttctcttcccgaaaataggtttaaaattatgtgcctgatctttctgaaagagggggtaactgaaagaggggaggatttgaaagccagacccaggagaatcactaatgagttctgtagttgattggcaaagtgtgctataggaatggggagtacctcctttgtgcaacatatttgtgcttctcagttgcatctctcaagactaaagttcagcctgttctacctctggggatgttcaattccaaaaattttccactaattgttctgtaaaagcatgggactaagagctgtaagaacttagttggaattcactcctactacttcatagctatatgaacgcgagccaatcttttaatcttgctgaacctcaattttccaccctacttccctaccctactatcttcctacctcacagttattgtgaaaataaagtgagtcatatttgaaattgtctgtaaactctaaggcataatgtagccagaatacattataataactgtaatttatgagtcctaaatctctttcaagcttcaaggggttttagtatttggagatgtgatgatcaagtacttaagtacataagaacaaaaattttaatatctcatcagaaccatggttcattaagcccaatattgtcattggcagagaaacccaagggtatgcagaaggctgcggttattgtccttgatgtcaacgtcaaaggctagcgacaaaacccaacatgttctaattccatttagtaatcaattatgacattatcctctatgatttacttcaatcttttaaaaggtatatttgtattatcatattgtgccctcttgttctgtttttggagtgaggccttaccttttcatttctaagcttactatgttagctcctttcagatttcaagggaaaggaacagaggtatttattgcaaacttctatgaagaagaaaggaaatccaggaatttgtctcagcagctgtatttgtaggtgtggtgaacctgaatatagtttcttttctctttcagaatataagaaaaaaatattaatagccactgagcacttaccctatggcagggactacccgaagcactttatgtaaatatcacagaactgcacagcacattgggaggcaggctccatcatttccatatgtggaaaacgagaatcagagaggctaaggaacttgcccaacgtcacagagctggtaagtgtatttgaacccaaggagtctaaccctggaatgtgtgtcatccatcaaaagtgtttctcagggccatgggcacactggctcacgcctataatcccagcactttgggaggctgaggcaggtggatcacctgaggtcaggaatttgagaccagcctggccaacatggtgaaatcccatctctactaaaaatacaaaaattag

SEQ ID NO: 10619 - DNA, 15176 bp, Homo sapiens
ggtaaggtcacagatcaacaggatcccaaggcagaatttttcttagtacagaacaaaatgaaaagtctcccatgtctacttctttctacacagacgcggcaaccatccgatttctcaatcttttccccacctttcccctctttctattccacaaaaccgccattgtcatcatggcccgttctcaatgagctgttgggtacacctcccagacggggtggtggccgggcagaggggctcctcacttcccagtaggggcgaccgggcagaggcgcccctcacctcccggacggcgcggctggccgggcggggggctgaccccccacctccctcccggatggggcagctggccgggcgggggactgacccccccacctccctcccggacggggcggctggccgggcagaggggctcctcacttcccagtaggggcggccaggcagaggcgcccctcagctcccggaccgggtggctggccgggcggggggctgacccccccacctccctcctggacggggcggctggccgggcggggggctgaccccccacctccctcccggacggggcgtctcgcctggcggggggctgacccccccacctccctcccggactgagcggctggccaggcggggggctgactcccccacctccctcccggacggggcggctggccgggcggggggctgacccccccacctccctcccggacggggcggctggccgggcagaggggctcctcacttcccagtaggggcggccgggcagaggcgcccctcacctcccggacggggtggctggccgggagggggctgacccccccacctcccttccggatggggtggctgccgggcggagacgctcctcacttcccagacggggtggcagccgggcggaggggttcctcacttctcagatggggcggccgggcagagacgctcctcacctcccagacggggcggcggggcagaggcgctccccacatctcagacgatgggcggccgggcagagacgctcctcacttcctagatgggatggtggccgggaagaggcgctcctcacttcctaggtgggatggcggccgggcagagacgctcctcattttccagactgggcagccaggcagaggggctcctcacatcccagacgatgggcggccaggcagagacgcacctcacttcccagacggggtagcggccgggcagaggctgcaatctcggcactttggggggccaaggcaggcggctgggaggtggaggttgtagccagccgagatcacgccactgcactccagcctgggcaccattgagcactaagttaacgagactccgtctgcaatcccggcacctcgggaggccgaggctggcggatcactcgcggttaggagctggagaccagcccggccaacacagcgaaactccgtctccaccaaaaaaatacgaaaacccgtcaggcgtggcggcgcgcgcctgcaatggcaggcactgggcaggctgaggcaggagaatcaggcagggaggttgcagtgagccgagatggcagcagcacagtccagagggagactgtggaaaggggagagggagagggaagagagggagagggggagggggagggggagggggagggggagggggagagggagagggagagggagaggagagggagaggtctaatttacaaatacaaattcttatgagaaaaattttaattactgaggatgtttggtttgaaaagaagattagttactaccagtattagtactattgctactatcacctctgctattagtgttactataaatattggaagctaaaatgaaccaagtgttcatcacagagaagtcatagtattaagttccctatacgctatctcatttatttctcacaatagtcctgtgctgaatgccataattatttgcattattatgagagttaggtgtgcctgaaagaagcaaggtaacgtcaccaagatcagagctactaaagaaagagcaattatcaagattcagatctttttgactacaaggcctgggatttcaatcactagaaataaaggtgtatgagaagtggatggcccagttattacataaacccacagaaaatgaaaatgaagaggcttaaatgaaagtggacacaccatgactggaaatactataggacttaattttaagaacaagcaataacgtaacaggcgtttgaagaataggcaggaccccatcctgaaaaccttaccctggaacactttcaggtgtgacagccatcctggctagacagtcctagcctggctggaatagatggttactgaagatcttgcccaaccctagccttctaggacttacacatcgtgtatctcctaggacggaacacagttttacctaaccttccagttttctccctcttgtttttctccattctgccttcccagtatttgcagctttcctccttttttttttttttttttccaactatacatgcagtggctgtttctctggatccagatgcagctcatcccaacctcatccgatctgagggtagaagatacacttcttcaacggagaatgttccccgaactgggatgcccccacacaccaaggacaaggggaatccaaaaccatcttcagtgttctgggtttaccacaggggagacattactttaccacaggggagacagacattactgggaggtagaagtaaataatggggacagaagttggaccaggaacgagatgagctctgggtgtttgttcagcacaatgaagagagagtggtggtttgtagaaagtccagagaagaatttctgcatggtgacatgtgaagaaggaagggtcatggctctcacttcctgcccagagactctgtcaggagcctccctgtccccctagaaggtttccaggacagcaaggctggagacgtgtcttttcacaacgaggtcgattagtcccacatctattctcttactggaatcaccttctgtgggattttccatccttattctagccttcagagtgctggcacatctgtgaccttctgcttagatcatcatgaaaattgtcctgattcttttccagttacccctgtaacttctttaacgagttgtgatagagatgttgcccaggaagctaatgttctattagcataataagcagcgaagtgttggcacctctgctgtctccactggagcatcttctaggtacattcaccaggaaagctgtccttggatggtgagtaggtcagtttcactaggtgtgatttcactttctgtcaaagaggaagaggcagaaagtgaagtgagagaactggaaaatgtccagggagatttcctccggtgctgctattggggaaatacagtctctttgtgggcagcaactatttctcacaagaaaactccaaacaagttcatggatttctcatctgttttcatgctgagtgtgtgttgaagtatataattttaaagctacatttacagggaaatctcttcttactatttttgttatcaaatatggaggaggggaggcgtttgaagggaagtattgcagtagagtgaattctcacttccattaccactgttggagatgcataggaatctgtccaagtcctttaatagctcagcgtgtttgctcttcaggctctagtgtacaatcaactgctaatcttggactttgacaagggacggagaaggctcatgaataattgtaaataattggaggaggagcccaagccttctggaaggaaagagcccttttctttaataagttctcactggtcagcaagtccagaattgtgtcctatgtgagaatgtgaatgaaagaggagtcaatgttgcagtttatactttaggagagaaagcagtaaagtagaaataaagaaacatctgtaccaagagtcattgctaacattaacattctttttcttcctgacctgttctgcccactgttgagggtttcccttgtccttgctgcatgtaagacttctccagctgtttatcatcaagttgtcttcaaggatatagaatatgagcttctcctgctttttgtttgtttgtgtatttttgtttgtttgtttgttttttctttgacggagtctcgctctgtcaccaggctggagtgctgtggcaccatctctgctcactgtaacctgcacctcccaggttcaagcgattctcctgcctcagcctcctgagtagctgggactataggcatgtaccaccacgcccagctaatttttgtattttttttaatactttaagttctagggtacatgtgcacaacgtgcaggtttgttacacatgtatacatgtgccatgttggtttgctgcacccatcaactcatcatttaaattaggtatttctcctaatgctatccctccccgctcctcccaccccacgacagaccctggtgtgtgatgttccccgccctgtgtccaggtgttctcattgttcaattcccacgcagccataaaaaaggatgagttcatatcctttgtagggacatggatgaacctggaaaccacaatttttgtatttttagtataagagagagggtttcaccgtgttggcccagatggtctccatctctttaccttgtgatccacccgccttgtcctcagaaagtgttgggattacaggcgtgagccaccgcacctggccgagcttcttctgttaaatgaaccctttcttcctgatgatggaagagatccccttagtttttcttctacagtatttgcagatctgtaaaccacaagtgcctctaacaatctgtcctgtagatgtatctccttggtgaaatttcacgtcacacactaagtggcaaagacagtattcgaagccaggaagaatcaagccagagcctagtcctaatttcactgaccctaaagggaggcttacacatttcatcaagaaataatcaaggcaggacagaggtaaataaatggtgataaaatattaatagttataatcaaatggacatggtggatgagaagggatttctggacatgcgagccctaaacatgggggtaacaacaaaacaggaacaaatggggtggaactgtggtatagaacacgaaatgtaacaggttcagccttagacattttacttttttatacacttaggacattcagcatgaggttcaagaggagtttttactatctctttttcagagtctaaattcatattttttctacaacaagattcttaaacttgtcacttctttactcattttaatgggtgtttgtccttctaagcttagagattggggagcagtggctgcaggtggacatggtagaaaacgtgaaggtggatggttgattggactcagagctttagacctgtcagggataacagtgtccatcttattttcatttgtagctttgagtaaatcaataagtagtgcagggtctccaagtagcctatcctttctggaaaagtgaattcaccacctggctacatcaattaattctttattgctggactactctggcactcccatttttagtaaagtttatgaaggtataataagacattccaaaaacagagtgactccactgcaaaaaagaaagacctgagggcaggaattatgtcttattaaggattgtatctctaggccttagcatagtacattcaacaggtaagatattcaataaatatcactttatgagacaattcatgcattttacaaatgtttattgataatcaatgtatgtcatttttacaggttgtggggctagacaagaaggaaaaaaatcactgtcctcatggaagttaaattgtactgacaaaggaggaaaatgtcagggagttaacaattcagtctctgtggcttcctcctgtcctctccctgaaactgagatccagccaatctgcacatttattctgagagtggccccactttaatgactacacccagctgtctacacaccaggaggggagggaactgtatcctgaggcaccaacccgattacccacccaacagccacagggacttccagtgactggggcatcatcctcaacgccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactaggaaggaagactcaaaagtaagtgaaaaataatagttaacctttagatgttgtgcaataaattatttttaattacattaaatcaaaatagtgttaaaatattttcaggtaaacctagtatatttactaataaatttaagtcttcataaatataaagatagatcaatgtaaatgtaaaaatcatttgttaaactccagagattatataaacaaaaggtgaacctaatgtaaaactgtggactttagttgaaaataatgtgtcactattctttcatgggttgtaacaaatgtgccacactaatgtaagatgttaataatagcagaaataggggggagagaggagggatctaggagctctctggattttccattttattttgttataaatctaaaactgttcttaaaaataatgtctgttaattttttttttaaaaaggaaagaagcactgatacatgctatgacatggaagaactctaaaaatattaggctaagggaaagaagccacatacacatacacatacacagatagtttatggttccatttatataaaatattcagaatagaaaagttcatagggacagaaagtagattacctggggagtagggggtgaaaaatgggtagtaactgcttaatgggtatgaagtttcgtttagggcgatgaaaatattctggaactagaaagtgatgatgatggtcacacagcaatgtcacatatacaataccacagaactgtacactttaaaatggttaaagggttttattttatgttatgtattttaccacaattgaaaaaaatgtttattaaaattaatgtgtaaacatttgtggaagaataatgtgtagtttctaacatttatgtgtttaaatttatgagtttaaaaatagaaaaaaaaatgatggcccagaagagcaagttcagagtgctgttcatgagtgatccgcatgggaccgcgatgcctctgacgtctgccatcctggagagcagcagagcgtcactagcaggtcctcgtcttctcacttcataacattctttccaaaagtcttgttgacattcttctgtcttccacatatagtttatcttcttgaactcattataactttaaaatatttttactgtgttacatgtactgcttatatttgtttattttataattattaattttaaattgtgcactttattttgctctaacaataaaattgacatgttcgtatagatgatacataatttttcgcttggatcggaaagtctaaaatttttttcctgactcaatttcctgtatcaactttctcaaaaagtctggaggagggattttacaacacttcataagattttcaagattatattttagtgatcagatttttctcccccttatgcagctgtattttctttcacttttttttaactgtatatatatattttttattttctcagttccacctatgtggacaattaattgtcaccatcttaaataaactgatcaggccaggtgtggtggctcatgcctgtaattccagcactttgggaggccgaggcgagtggatcatttgaggccagaagtttgagaccagcctggccaacaaagtgaaaccccatctctactaaaaatacaaaaataggctgggcatggtggcacatgcctgtaatcccagctactcatgagactgaggcaagagaattgcttgaacccgggaggcagaggttgcagtcagctgagatcatgccactgcactccagcctgggtgacagagtgagactttgtaaaaaaaaaaaaaaaaaaaaaagaaaagaaaaaaaaaaaaaaaagaaactgaccaaatccttgattattcctttcatttcttcctgtaggctaaattgtatttcccatgggattttctaagggtccttgattatcagatgtcagattgtgattgataggccggatctcagagaacctggaacaggataggtctctgaaaagatcagtctccagcagattttcctgagtagaattaaaacaccttgagttagtacttcaatgatcatggcagcccccttcaagcagttagagaaatgagaaatgatcaggactcagaatatcattctggtttccagaatcccagattgttattttcctgatacgttggagatgttcttgtgggtacagaaaaaatgtccagagaacctacattagggaaccaaagaatgaagcggggtgcagagtcccagagaaggaagttttggggaaggtgtagatagggcacttgccaatcatgttataagaggagaggtattcagaggcacggtcagggggattctgacttgttcaggggccaccttcaaggggatggggcttggaagagaggggatggcccagaactcatttcttttgcaatccattgcctaaaactcactgtcaggtgacacagagatgactctttctttgcaacatgtgcttggcaacctccgggacccatcgcgccctgttcccagtctccacctctcagtaccagctccctgacaggagttccctctggcccatagagcagatagtcagatctctgtgggatatctggctgcctgaatgtccatggatcacacgcttgttytgttcagaagaaatcagtytcaggtgagctgtgtttgaagccaatgtcacattcactgtaaagaaagagaatccattctgataattaatcaatataatttcattctattaayagccaaacaggaagacaagtgtttcacrgacrtaagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaayctcagctctcagcctygaaaacaaggatggctgtactactcacttttttcttcttcttccctaaccagatcactggggaatgggcagcaggaaatcaaatcattatcttttaatcattttgcttctattacaagtggaaacactgacctcatgcatcactgagcctggattgcatgataagccctgggctttcctgtttctcatgtttccttagttactggatattcactgactgcctcccataggtgacttgtgaaaagggaggctcggggaagtacgcagtacggttcccactgcagtgtgctccgctgtttctgtttccctgacttacctcttttcagctcctcttcctgggcaggcctacagccacagcaagaagcaatccccaaacaagcagtgttttccacaaaaacgtcatcctggactctaaaatggaaacccaagaatcccttgaaactgtgaaactgggacaatattaagattgtacttttcatctgagcagcttctaggctggagagaagggagagaatttggcctcccaggaagcagttggcctgctcctccctgctctggagatgcagaggagagaatgcaagtatttcatgtttgctcgtctcagaaatgtacacatgcacagacaagttttcccttctctcttccaactatatcacacaatcactggaatgacttgaggaggaaaggataaaattactcaagccgcaaccatgaagatggtattaataaaaatcagtttctaatccagaagaaaatcctccatgagggggaaaacacaaagttctgtaatttaattgttttcacatcagaagaagagaatttaaagagagagagtgaaaacagggtcaattacgagaatttagtgtgtatccaatgataaaaataattgcagggcgctagttgagggtgtcagagagaaactcagaggagtagaatccctgggtgtcctgaaaaccagctttgcagaggatagcaggagacctcgtcagagagcagcaaataaaaatcacaaaggaagaagagcaatacaatgagtaagtctgagttggtcttcatatttattttccaaacctgaaggaacataaggaatcaccaacctgagagagaaaaagttgcgattttctcctcgcccaaaaaggggatgctgatggaacaagtgacgtccacagcggagatgtttgtgacccttagcaatgtctgcacgtggaacagcccgtggctgccttgagtcagggcctgggaagatgatggtatcgtctttccttccatgtccctccatggcacgtggggctgtgggaaccacccatctgaagagcacatcggctgcatttctccatcttcttgcccctccacagtgatcagtggggaagaacccagacctggggcagagaaagcaaccaaagcctggggtcctttcaagtggatgagtgggcagcaatttcactgggaggaaagaaggggatgtggagggcttggggaagggagaaaagcttaagggggattgcactccacttagggatgaggctggctggagcattttcttattttgtttgtttgcttatttttattctttgtattcctaaatcattctgggatgattaagaggtaaggtaaatgttcaaatccaacatttattctgtccctgagaacaaaataacttcggccagggcatgggtcacatggacaggattaacatacggagtaggaggatattctcaaaaatcgaaaccttataaatatctacgtccaatggcagaaaatacgaggctcatgaaacttctcaacatgcgctcccatggctaaacgtgtttattaatttagaatcaaaatccgtgggagaaacacgtagcatatccaagacttgggcctatatgtactcaatggcatctgctaaccttggacgtttcaattctcacacacacggacagtgggaaatgatgctgcagggagtgatttcatcttttctcccctgtccctgccaaaactgtcaatatttataattttggtttacacagtggatccagtttagtcttcagatgattacagtttctagaattttattgcatttctcagaattctaataacacactgtgaaacaatgagccttttgtaaaatatgtagtaagatactcagatttccttaaagatatggtcaatttttgaagatactggaaaagatacaagttatatgcccaaataattaaatttcatccatttgagtttgtggattttaagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacctaccaccttcagatccaaactggcctcctggtagacatcatctttttcaaaaaggcagcggtactgcccgtcgtccgaaggtctggcactgagtatctgcagggtcagtctgccctcgtcaatggcgtcactcaccagtacagtcctccctctgtactctgccatctgctctccagccacatggtccccatccatatacacatgcacagcagggtaacggtgggatcggtcccacctcacctccatgctctgtgcattcgccttgggggacaggtaacaggttagctgtatatcttctcccactctgacgaggatgggctgggaaggtccattcacttttaaagaagctgttaaatagagtggacaaaacacaatgaaagaatcaaaatggaaccaataatgtcatctctaagaacagctccattggagtttagaaaccatgagcatcccagggttgctgtgaggctcagggtcatccttaggtgaggtgggggtttcatggactcagaatagaggttgctcttctttaaggaggaatcattccatgatgtgtgtcagtctgagtaaaacagtaattgaatccctacctgcttctacctgtatttttttcagtttacagaccaataataaaataattttgcaattaaaactcccagataggctgggtgtggtggctcaagtctataatcccagcactttgggaggccgaagcgggtggatcaccagaggtcaggagttcaagaccagcctggccaacatggtgaaaccccgtctctacagaaatacaaaaattagtcgggcatgatggtgggtgcctgtaatcccagctactcaggaggctgaggtggaagaattgctcgaacccgggaggcagaggttgcagtgagctgagatcatgccactgcactccaggctgggtgacaaagcgagactttaaaaacaaacaaacaaaaaacacccagaataaagtgaacagtttataaatttggccccagatgcctctgtacctgactccttatgtaacaaactgcaatttaacttagtacgtcaactactgaaagcctaacttaggttgcagtttgttacataagcactcaggtacagaggcatcctggggccaaatttataaattgctcattttattctgagagttttaattgcaaaattattttatgaataagcctaacttaggagctaaggctaacttaggagtacacttttgtaataaatagctgagtagcagctgctgcacttctgttagttgcaggcagccaactgttgaaaccctgttcaaatcggcaaacgccaggctgcaaccaatagagctgtctctgtacctcacttctgttttctgtacctcatttccattttctgtccataaatgctgtctgaccaaattgctgctttgaattctctgaaaccgttctgattctgagggatggcttgtttatgagtcatccttttctcagttagactctgctaaatttagtctgtctaaagtttttcttctaacacttcaattctgtatgattttaaactacttcttaatctgtcttaaactacttcttaatgcctcagtttcttaaactgtaaatttgctatacaactaccaaaatcataatgtttcagagttgaacaaaatagtttgcattaagtgcctggaagaccctgcagcgtgagcagaggtgcacagacctgtgagacttgaaggcgttggagccatccccaccctctgacgtggtaatagggaggggtttaaaaacgtgtctcatgtggacttttggtaatgatatttgaagaagctttcctctaggtggactttatagtaccttgtaagtctggtccagccgctatattttatttccccaatgctccacataggtggagttatagacacacaccagttgaatgtcctcaaataattttgaaaattaaaattaacattttaagatcaataattggggaagtcggcaaagtacaaattgtgaaacaatgatgaatgtaaaaaaggggtctaattctcccactgtgcaaagtggggaaagatgttctctgagggctttcctgggcccaagctatattacattttccattctcatcaggccctgcccgtgccattttttctctattctaaattaagtgtcgtccttttctgttaaatgataagaatggttttgcataaggtgtgatcatttataatagaaacacaagcataaaattgttggttctctgcatagagtcactggccaaaggcgttaacatcccattatgtcattggccgaaaactgccagctacctttgtagagaggaaagtccctgtcaacacaatttgaattttcagattattaccttccattccaggtaacagttgactcccagttatttccagcattttgtttgctttgtcctgtaattttacctaaaacaatattattttcctctcctatgtatctattaaagtctgaagacaagaatcagaaaaaatggactagggattagtttggggctgtttctgcatccacatggcttacggtaaattacttaataaaacagactgtttcctcatctcctttatccatatgaggattttattccctgtccgtgtgtgacctgtgcacatattagatcttaaactggcttgccctgcctgacataggtaattaagagctaaaattgacttcaatggagactgaaggaagcaaaatgtaagtatggagattcaattaatttgatgcattacagatacagacaaaactccttttgtccagaatccaagtaaaactaaagtttaaagtgctaaaaaaatcatgcagccctgtttgttaataattgatgttctactagaatacaagctccttgggagccactatgcctaacccactttttttttctttcaattttaagttccggggtacatgtgcaggatgtgcaggtttgttacataggtaaacatgtgccatggtggcttactgcacaggtcatcccatcacccaggtgttaagcccagcatccattagctgttcttcctgatgctctccctcccccatcccccaacaggtgtccagtgtgtgttgttccctgccatgcatccatgtgttctcaccaatcagctcccccttataagtgtgaacatgcagtagttaacctcctttttctatacggttttgtacacagccttccagacaattttgtgctgaaatatattgctttgttttgttttggttattgtttgtatgttctgaatgccttctgaatatccactgaaaaattaattcccttctggagcgtgaagtacactgaattatacactgattccttgaaacctgataatctcatcatcataccacataatcctctttcaatcagcatattcaattaatgcactatctcatttctcaaatatgctaagttatatctaatctcttagaactggacactacattagagattaaattcaacctgttcactttaaagatgagaaaaatagagatgaatgagctgacaaagtcacacataagtaattaaggacttgcactgttaagttagatagatgtagattagaaggtaaacatcaccatttcttcctgatttttggcaaaccatgtatgtctctaagattgtttcttagctgtaatatgaggataaagcaatta

SEQ ID NO: 10620 - DNA, 34403 bp, Homo sapiens
aacctccatacaaattcaggtttatttttatttttaattgcatttatttttctttttttgaaacaatgtctccattcgtcacccaggctggagtgcagtaacacaatcatagctcaatgcagcctcgaactcctggtctcaagcaattctgcctcaccttccagagctgaaattacaggtacaagccaccgggccaagccaaatccaagttaatactgtaatataaaattccaacatttcagagaaagtgaaaatcaccaagttattgtagtccctggagtcactgtcaagactttggtgagggctcagtggctcacgcctgtaatcccagcactctgggaggctgaggcgggtggatcacctgaggtcaggagttcgagaccagcctgtccaacatggcgaaaccccatctctactaaaaacacaaaaaattagatgggtgtggtggcgagtgactgtaattccagctactagggaggctgaggcaggagaatcacttgaaccctggaggtggaggttgcagtgagccaagatcgcaccactgcactccagcctgggcgacaagagcgaaactccgtctcagaaaaaaaaaaaaaaaaaaaaaaaaaaggccaggcgcggtggctcacgactgtaatcccagcactttgggaggccgaggcgggcagatcacgaggtcaggagatcgagactatcctggccaacacggtgaaaccccgtctctaccaaaaaaaaaaatacaaaaaaatacaaaaaattagtgtggtggcgggcgtctgtagtcccagctactcgggaggctgaggcaggaggatggcgtgaacccaggagaatggcgtgaacccaggaggcggagcttgcagtgagccgagatcgcgccactgcactccagcctgggcgacagagctagactctgtctcaaaaaaaaaaaaaaaaaaaaactttggtgagaaatcttccaggtttttccctacttaaaatatacattatggaagtggtattactggcattataattcagtatatcctcatcttttaaaaaatggttaaaagtatgagacgcacacatcttctcataacaatacttaaaactgatcttacctcttttattgaccctataaaattgtattgcatagcagttctttggaggacgatggaaatgttctacatcttcattgtggtagtggagatgtgggtgtgtacaacagccaaaacacaacgagctatgcatttcaaatagatacattttagatacatttgattgtatgcaaagcaagtcccaataaaatggcttttaaaatatatcttctttgagatttgtactttgcttatgtaaaacaaaacaaaacaaaaaccttgtttttgtgcccaagagacacascctgacacatcggcaggtagaggcttacgtgtgtatatatattactgtatatttacagattcagagagagagacagagataaagctatgttaagaatattcatacataccaaaactagataaaaaccaaaaataaaagttagaaataataaaactctatattttaaatgttattctcttcttcaccttttttctcctctttccttcctctctcttcccttttttcttcaacacgctccccccacccccacccyccagccatccttccctactttctcccttctctgcacttgatccccggtgtattccagcctcgaggccaacacacgtcaccgcgtccgcctggggcaggtcggggaagggacgcgaggcggcgctgtcaccgcattctgagggccgcagtgccctgcgcccctgctggtcttgtatcatttcagtgaacgtcgctccagtctttgatggggccacactcgggatgtaaatttaggatcctcactgaaggggcgggaccctgagaggctttctcctggccccttagttgtgagttttcctgcaggcggaggagccagtttccgtcagaaccgcccagaggcaggcgctgccttcctggggtggcggagcagctggaagcgttttcggatcctggaatccgtgggcggcccgtgggaggggctgaggcgcatttccctactcacccggatccgaatccaccgcggtgctgtttcaagcgagtcagattccacatcgcgctccaccccggactcggaattcctgccccacaggtctgcattttcacagcggcagctgtgagtgccccgcggctggagaccagaagcctgaaggcaactccgtcctccccagcccacagcgccgttattccgtttctatatcagcaaacacttgtagaccagggcggggtracgggtgatctcagtcctcgcagtgaactccgggccgcaggcttgaaaacgcgcgcgggcgcccagcccaaccccgccctgggttctgtaagcgaccgcactgggtcctttctctttcttttccggacccagcagtggcgcctaaagtctghgaggagraagtcgcctctgtgccccggagttcagaggtctaaggcgagtcctgaggaagaaaacgtagttgatggggcagagcagaaggggctggaggtggggtggagggagagggcattggacagaaggcctgggagacttggtgggggacgggcagccaggcctggaccctggggagtgcctcaccccgagcggaagaccatctgggcttcccctagcccagaaagggtggattggcttcacctctgctggccatcacctctacatgccttggaactaaccttgtatattattattattgtcgttatttaagtattaaaagtattttttggggtgagctgaatgagaccctttgctagagctggcacagggaggaaggtcgtcctggagggagggtagacactgtggagggaagggagacctctgtcaggagagctgagaccacctctctgcccctcactactcttgtaatctttaggagtgtaaataatccccctaaggtggggacaggaccccagtccctgctgtgcgcaatagattatgatgatcaaaataaataatcagtgaatgtggatgggaaatctaagtaattgttaaaaccctgtgatgcttaaattttcactcacagaaatgtgtaggctaggagttttaagaggaatggttagtaattataggtatagttcagttttaaaaaatgtttgtaagagtgacaaagatagaatgaacacagttccagatcatggactgttcatcgtgtagtgggggatggtacaagatggtagatgacagctgggcatggtggcactcacctacagtcccaggtactcaggaggctgaagtggctggattgcttgggcccaggcatctgaagctgcagtgagctgtgatcacactgatgccctccaactggcggcagagtgagatctccccctcttaaaaataaataaataaataaatagtagatggagttcaagaatgcaggcaaagttggtacccatcagggaggttcaaaccatgggctagaacagtggttctaaaacttgcctacacattggaagcacgtagagagctttaaaagatattgaagcttaggtccaacctagccttactgattcaattggttttggctgtgacctgggaccgtggatattaaaaactctccaggtggttctgtgaagtggctaggtttgaggaccactggctagatgttccaaagagtaagagacgtgtgtgttggggacgagatgattctttcagtagaaagaggcttttgcatggtgttttattatcgagatataatttatgtgccacgtaatttaccatttaaaaatgtacagtccagggcccactcagaaccatcccagcaacctgaccacagctggtctttgctggacaccatgaaccacactgcccaaaccttcttcattcctgccaacagtggctgccctcccccgccccccaaccccagctatgagatgctcaaggaggagcatgaggtggctgtgctgggggcgccccacaaccctgctcccccaatgtccaccatgatccatatctgcagcgagacctccgtgtctgactatgttgtctggtccctgtccaacatcctcttcatgaacccccactgcctgggattcatagcattcacctactccctgaagtctagggacaggaagatggttggagacctgactggggcccaggcctatgcctccactgccaagtacctgaacatctgagccctgattgtgtgcatcatcatgaccattctgctcaccgtcatcatcctagtgttgatcttccaagtctgtcgatagatcaggaggcatcatccaggccaggagctctgcccatgacctgtattccacatactccaacttccattcctcgtcctggccccagagctgagttctgtatcagcgctttatcctcacacactcttctacaatggcattcaataaagtgcatgtgttcctggttaaaaaaaaaaaaatgtactggtcagtggcttttagcataatcacaacatcgtgccacagtcgctattatctaattgggaagattttctttttttaaaggctagtcaagtaaagcagtgggagcggagaaggaaaaaagaaatctgtaattggttgtgatcaattagttgtaaacaccactacactctgaccagcctaattgggaagatttaaggatgtgacacggtctaatgggctcagaggcagaagcgacagtaatctggaagcaggagactgcttaggcagtggcatcccggtgggacagggcaaggagattggggagcccacttttactgcaacactggaaagagggatgtcaccagagaaatgggggtggtgacagacaggaggttgtggcagctgtggcttccatggtagagacctcacgtgtgacattcagcacatggggtgctgtgggggtcttagagcactctgactatagctgggacagtcacagtgtttaggaagcctgtacagtgatctaggctgaatcctgtgcagtgatctaggctgaaagccgagactaaagtagtggctgtgggatcaaaatagggttggaggagctttgagtacttgagaaggaaaagggggaaatcagaaggcaccacggaaagagaaacaggggaggaagagaggatgatgtcatgcgagacgtgtagagtgtccttgtagacctgtcacattggaagctactatggtctcagaggtacagatgtcctaaagcaggctggaaaagggagtctggggagagcttggtgttggagtggacactggcaagctgcctccttggccttttgatcacccaggggctgaatagagaggcagccccgggagacctcacacacttacaggaagtgaccataagaaaggggacctagctttgagtaaaagggaggagaaggagattgtaaagctgaaacgtctaagagatttgtcgtcttagcggatcagctggggcaggtgcttcagaaacagaggtagctgaggtctggaaacaggtctgcaaatctggtcactggccacatagccagtaacgctgtgcgcggctgaggggagtgtgttggaagaataaccaggcctcgtctcttctgtaagtgtgtcctggaaagaacaagcgaatgacagtcagcttgatggggtggctggcgaaacggtcttggtgaggcacgctatcctaggggtgggggtgcggggatggggtggtcgcaatacagggagggcggcagggcccaggtcgtgctcatgcggttggggctgtactctcagctgctcggagccagtccccgcatttggcggcgcttccgcgcgctcccccttttctgggctccaggtcccgccagccaaagttctccaggtctcctgaccgctggaacgttccccttctgagtgtggccccgccctccmagctcgtgattggccctaagctgcgggcgccagttttcattgggtgagcggtcrctggggtggggccaggtgacaggaaatttctggtgggccttcgcggctccgctgggttggcagccgcttgagccactgcgaggaaagcaaagtctgggccatggagatgagcctagtcctgctgttcctgatccgcactgccctttttgcaccccagggagctgctgctggtaagtggggttcctggcggtcctcggcggagcggcagcggcggggcgtttctgggggtccgggtgggtagcggcgagcgctgtgcggccgaggcggggctcaggtgcgctgtcgggggtgcggggagtggacgcggmccgttcccgccacacctcaaccctgcttccacgtctcttttcagtcctcctcgggatcgctcatcacccgccccctgcattttctggtcttgtcctgcactttctctcctctcctctcctccgtctcctctcacttttcggacaaaccagtctttctgaggcccctgggttcctgggctgctcctgtgaatggcattcgagggcccttccagcgcggccgctgaggcagccacctcccccggtgctgggggcggccctaaggtccctgaagccctgtcctctcccggagccgacgtgttctcagctcctgggccgcatctcctggagttggggccctcctttctcgggacccggagctagtgcttcctgctgctgtggggactgtggggctcctgaccctcacgctgaggggttggagtctgcaggctccgggcagaggattcttcctgcgacttctctcatccccagctcattctcccctggcctcccgctgccggggatcctctcttgtcttgcatccttccctgctactattaactccrgtgatctaaggacaccagattccctcccacctcctcccctgccctcagggcaccttgggtcctgttgccctcccagctccctgttaccccttcctatctgcagttctctgatacatttctaggatgtcctctgcctcatcccctgcccccgccaccgcaggtccctcctgcctcccttatgggcctttcctagaagcagccttaacccagggctgcccctatgcctcccactccyaactctccctgaccctaactctctggtgccgccttttgtcccagggtcttccctccgtcccactcccctctagaccacccaaggggagccctagtgctaatgttggttgggccttaggcagggcacagggcagggcagatgccccctcccctctagtgcaggtgcctgctctgggccctgcctcacggtggccccttccctactccttcatcctcagccccaccctcttgaggaccccccactccagcccacgggtgctggaccatccctccctggtccctccgcccctctccgccttgggaccttgtgctgctcctacctcttgcccagctgccttgggccctcagcaagttctcatctttcccaagccccaccctcactcagagcaccctcccctcctgtcctcaccctaaccaaagttcccccagggtcacccccacaccatgctcaccccatcctccagtccttgccctgcacatctgtcctcctctacccagacccaacacaggccgtgtgtccaactgcttcttttttttttttttttagacggcgcctccctctgtcgccaaagttggagtgcagtggcgcggtctcggctcactgcaagctccgcctcccggattcaagtgattcccctgccttagcctcctaagtagctgggattacaagtgcccaccaccacacccggctaatattttgtattttaatagagactgggtttcaccatgttgaccgggatggtctcaatctcctgacctcgtgatctgcctgcctaagcctcccraagtgctgggattacaggcgtgagccaccacacctagctggtaattcattttttaatttttggaggaatcaacacactgttttccataacaggtgccctattttgtatttccaaatgcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgtgtctgttggccatttgtacatcttgtttggggaattggctatgcaagtcctttgcctacttttgtattagttgaatgtctcctgtttgagttgtaggagttctttatgtattctggatattaatctcttatcagatatatatgatttgcaaatattttctttcattctgggggttgctttttcactgtgtttattgtgtttttaatgaacttttttattttgatgagtccaatttatcaattttttctttgttkttgtatctttggtgttatatccaagaaagtgctatcaaattctatggcatgaagataattccctatgttttattgtaagagtttttcagttttagttcttgagtttaggtctttgatgtttttcttagttaattttcatatgtggtgtaagttagggatccaacttcatttttttttttttttggcatgtgaacatctggttttcctagcaccatttgttgaaaagatgcactgactctttaagacccttgccaccagcccaccccaggggacaccaactggtccatccacctccctacttggggcattgccatgccactctgaagcccacaccattgcttctccctgggatayggacctcgtagaaaacgtctctggcaccacagcctacctgcccctcctgcctcacagccaagtctcccttgcccccaccttgtccatgttgagccttcctcaaaggcagtggaccttgcctccatctcaccctcacctgtgcaccacagccatggtggtcatgggtccctctgagcctgggtcccttacagtttctgctctcccctctggcaagaccttccttccaccactgcctwcatgctcctcccttgaacctgcagggcagccccttccattggcctcctccctataccctgarggggcctgtggctgccctgccctggcacctggcctacaagtttgccatccccattcccccttcttctgttcctcagtcycctcctctatcctcccaccttcccagttttccttgcgtctgaaatcctcattcttgtccctttgcccgtgtgcatttcctgcctcctcaggaaggtcgggacrgcagacctgtgtgttaaacattgatgtgaagttacttccaggaagaagtttcatctgtgatttcctcttccccagagccccacagtctttgttacaacctcacggtgctgtcccrggatggatctgtgcagtcagggtttctcgctgaggracatctggatggtcwgctcttcctgctctgtgacaggcagaaaggcagggcagggcccyggggacagtgggcagaagcagtcctgggagctgagacctgggacacagagactgaagacttgacagagaatgggcaggagctcaggaggaccctggmtcatatcaagggccagaaaggaggtgagagtgggcagtgggcaagagtaatgggagaggccttttccaggagagttgggggcagagagcaggacctgtctcttcccactggatttggctgtgagtaggggtgaggaatggtgctcagcggggctcagcccacacagggagggatggaagagggccagggaggggtccttcctggtccgagttcctcacttggactggaatggagaagtcactgctgggtaggggcaggcagccttgcattccctccaggagattasggtttgtgagatcaggaagccagcagcaccaggggctttaggcatttctacacatatgggaagctcttcctctctcccarcctggagactcagtaatggacagtgcccyggtcctccagarctcagactttggctatgaatgtcacaaatttctgggaggaaaatgccatgcagaccaagacacactattgccctgtgcaggcagactacatgcaaaagctatggtgwtatctgaaattctggaggtatcagaaaaacaggtactgtgaaagtagtgggtccycctatagaagcctgaacctggrgtgggcattaggcaggaaaggaaggcctcaaggccagggctgcctcatctgcctcccagcctgcccatcctggagagctacctcctagccccacgasccaggagcccacccctgacaaccctctcctcagcatcaaagccggagtcccagagtgtraggccacagtcctgaggcccatcttccagcaagcctaggggaattgraccccaggtaaggaccgatttgcagaaggtctggggtcagtgtgggtttcagcgagagtcagaacaatagagaggaccagtcctgttccctgcatctcccttagaggggagaaaggcttggccacatgcctcactggctctgcccttttgtctccaatgacccccacagtgaatgagatgcacagtggggccttagaaggcaatgtcaccatgatgtgctggyctccatcttctatccctggaatatctctctgacctggcatcaggatgaggcatctttgagccaggatgcccagcagtctaggggtgtcctgcccaatgggaatgggacctaccagacctgcatggccaccaggattccccgaggagaggagcagaggttcacctgctacatgggacacagagggaatcacagcactcaccctgtgccctctggtgagccwggggcaactctcaagggtttcgacctagggaggtcaggccagggtggggatagcagggacggctgtggctttgcgtgctcagtgtgtcacaaggccctttttttagagaaggccctggtgcttcagagtcaatggcagccattctgtatgctgctattgctactgtcattattattaktaktagtagtagtagtagtattctctgtgtcctttggtgcaagaagaagacaacatcagctgcagagtccaggtgagaaaacggggcagtggctggagatggaaggactcctctctgggcagcagggtcccctcatagctcctgcacagatagacatgtaggtaacaaggtcctggaacaggggatggacattggggtatttgggaggggaatgggagccacatctccatctacacccctaagtcctgcccaagccagggctgggccacggccctcaaatgtccagyggtggcctyctcctgctgcaggtgaggagtgggcagcagggagggcygtggcacctgctctgtccccatcctggtctctcttgtttcttgggctcaccacggtgcgtccaggtggggtgagttgagaatcacgtgctgattgctgagggcctggatgatcatggcttcagtgggagtaaatagtaaaggcggctgtgatctggggaggrgctagaaactggagaggaatccgaggaraggcggtgcccctagtctcttcctctctgcatccctctctcctgtttctccagccatcaggaggacaccaagaaaaagacccacgaagcccagactgggaggcctgcctgtgcagcccctttgaggtccccttgtaacagggrgggtcctgagtgcacacrgccatctctgtccactttgcagctccccatgggcctcctccaggagctrtcttgggggtatcatgtcctctgcatcactggaggttcccaccacatggccctgcctccctgagtttctgtgcagatgttatrgaggagtatataagcagacatccctgggccatttgggaagcaggaaccagctccttgtcagggcagctgtggtccctgttttcatcatatgtccaagtgttaccttgtctagcccccaggaacacagtccccaggaccatgttttttggggcacccacagcaggggcagtgcaggtctggttgctcctgctctcacctgcagcatctccygtagaggaattgtcagttctggttccctgtgggcagtaaaggtttccttgtaggtcactggggcattggccagaaaaaggttgtgaaaatcacatgctaatttctcaaaattcctgctttcaatgttgatgtccaataaagatgttcataatttcagctggatattcttaataggatttcctccaataccgatgctgtaaagyatattgaatggaacaggaattcaaatttgaaactctctctctagaagggtccatgtgggagatggtggctgtggctgtggcaatccccaggtgcagagtgggcggaggcagcctcaggctgaggggtctcaagaaatcccttattccatagggagaagaagaagatcctctgtgggtgtgagggcagtggcctgggtggaatccctgctaggaaccagacaggaaggccttgcagcctcaccaagcarcagccctggggtggagctggatttccagggatgagtggaccaggcaggagcagggcatcccaagtgcaggtcatggacctgggtgtcaagggaagcagagccttcttgagcaagggggtctccagggtcaggtcaggtgcagaccccatggcagccacgtgtttccatcctgggcctgacaggcctgctgggcttcctggtgggctctccaggtaggagctgcctgctcaggactggaaggggaggaacactgagctgtaggtggagggcggaacccacagtgggcagggcctgccctggtgtgcaggtgcttctgcaggaaaggagggcctggggaaagagggagagaaaggccttgtgtgtgacccagcccaggcctggaagtacgtggagccagggcctctctctggggaggcctcccactgtgtccragctggccaggcttgagaggaggggagggcactgagtttcttctggagtcttgtcatttagtcctgcggccctttcagtcchtacagagtgcatagtgggcacagggcragtgctgatcttcatgaagtcatgggargggactggcaggggctgrgaaaagtgccataggagggagaaaaatgtgggagcatcatcttccctcagagaaagggtraatctgattttggagtgactgaggagggagaaatcctcagggagtaaaaagcagcactctgcacccaggggagcatttattggtttctctattttctscagagcacgtgagcctgcaaggcccggatcaacgcccggttgggacaggagaccaccagggcagtgcacagctgggatttcagtctctggtgtcaactcctgggtctactggctccactgagggcagctacactctgcagccagatggccagaattcaactccctgcccaggtctcaccagcactttcccacttggtgcctcagtttcctcatctatgaaatggggaarctaacagcatttatttcttgtggttgggtggatgaaaagcgttagtatatatgaggggtttgcagctgtgccacattatttttgttatcatttgattatattttaatatattacatatgcrgtcattgtattattattataaatgagatttatgagtgagtgtcctggttacrgctccttctggggagcccaggaccagctttcctggcaccttgaggtcccctcaccctgtcacactctcatgcattacctcatatctactatgtcttcataattttatactatagaaatttaccctttaagtagacatttctggtctgtgttttatttcaagtgtctgggaagggatagagtatgaggttcaagagagaaggagaggtctgtcttsatgccttgacacagcacaaagaaatctccccacctcccccrcatctccccaccagttctcggtgatggacagattcacagcaacacagaaagggctgggaagggatggagggggacatctgcagccagtgtttaggggctgaccctgtgggaagacacctgccttgcagaggacctctgcatcttgcagatgcagagctgaagtctgatatgagggagaggacagggagtgctttggactttcctgattaagaagaatagagatcagtctgcttctggggttaagtgaccmctggggagattggactgaattaatgaagaataaatgaactgggaatgaggatgagtaaagcaagtatcagcatctcccattatcagttcagactgattggtagagtggggaggtgggatagttcctgaccctgttgtgaggttccttttaactttctggccttggggcacagatgggtggtgctcttcttggtcagggtagcctcrgctccactcaggtaaggcagtggtggcagggagagttaggggatcacctgtgaaacggaccaaggcagggatgggagccctctgtgcagcaaaagtggatgcaaggcctgcctagaagcaagaggatgaaggaacctagttgggtcctggtccactgcctgcctgtgttcacaggtcaaccagtaaaggaggtggggtagagaattcaatcgtgggctatctatccagagatgtgtttacaggtgtattatttcacatttgtgttcacgtttggtgtcaaaaacacatttatacatgcctgtttcatgtttaagtattttcacattttagttaacccttaaatatcattgttgaatgcggttgtcattagacataaacttgcatattcactgaagcttttgtttttattttaatcaaatttataattgtgcacaattgaaagagtcaaatatttgtgcagaatctcttgagaaaaatgagagtcctctctgcctcttctcaatttctgcctttctaggggccaaccactttcaagttttttagctgattcttttgactttacttctgtatctctaactaccatttctttattattattgcttgatttttttcagatgcacccattgttgcacagcgcaatggtggatgcaacagttaagagtacttgttctctttcactcttcccagtatatttatatagtgattatgtttagttcagccatctcttgtttcttttaccatgactaatcctctcatatgtcaactggactacttttcactgcctgtacaacattggttcttcttggagttaatacttgtatttgtttttgtttattttattaactctcattaatttaagtttgatatctcttttgtttgtatgattctttcaagacgttggacactttggacattctgttaattttatcttcttggaaatgtccctcctgggcccttctggctgctcccatctggattggaggcttctccccgtggagcagagtcactgtcctaggatctccctccatcactatctgggaaggtgctttacatgcagtggagccacctgggttccagccaaaatgcagactgattcaacatgtcaaggctgggcctgtgagcctttctgtctagtttcaggaggtgctgattttcctggttcatgggtgatagctggggtagcagggatctctctttttgtctcatagttttctgtatctaaggtaagcgcatactaatatatttttaatgaattmatgtactttttccctaaattagtaacagggctaattagtcttttccttgggccaaaaactacattatgtaaaatttggtatcttaactattttaaagtatacagtagtacagtattaactgtaaatacatagttgtgcaacagatctctagaacttttcatcttgcaacactgaaactctatgcccattgaacaaacattcatccatccccctcacygagcccctagcagccattagtctactttcagtttagacacctcatataaatggaaatgtgcagtattgggttttctttgtgattggcttattttacttagcagtgtccttcaggttyatccctgttgcagcctgtgaccaggtttccttyttaaggctgartgatattccgttgtcgatatataccacattttcttcattcatgtgttggtgtgtgttgtcttggctatcgtgaataatgctgctttgaatatgggwatacaatgtttttcttttcaaaccttccctcactttggtggaattaatcctttagtagctacttctgacagcacatatttaaagtatgtttgtatggttcaatttttccattgtttttattctctccaggaagaggagataaatatatgaaggtgctgtttggcacagaatttaatagggaagaaagagacagtataactcaccagtgctgggtctcatcatcctgcaatttcagaacaactatgaatacaaaaagaattttaaaatcccagtcctgcctagaaaggggaagtcatctctaaatatggtggccctggggcagctggcctccctgccaggcctcttccatgggggccctttctgcagtgactgtggtttcttcccattttactctgtcctgtgtcctgactgaagcgacaaggtgtgtctgcagctgtgctcacacctggaggaaacctcaatggtgtgagtaaattgtaaatgtttacttattatgggttattttattatttatgragtatgtattttgatttcattctactgacaacacaataaaccaggacatgatgaccctagcagcacatcctctttcctgtgtcaagaagcatcgtccggggaggtgagaagaagacagtcctccctagaattgaagaaccagggagaascagatgggctgggcaggtgggttttcacctggaacctggaggatgagcaatgacatctctccaccctgagctcagcccsggcatccacctcctgggctcatgagcagtgcagtggtgcctcctagtggtctctgctcttccttttccagatcaagcacaaacctgagatccaactgtccctcttatgcgcctgggtttcttcactggacaccagtatgagtcaactttcctgtaaagcagaacaagcacgagattggaccatgttagaggaggaatggtgtcatctccacttctggagagatccctgtccccgtgttygggggaaggaccaagcctcactcccatgcagagaagaggctctgactgtaactgcacctgtggagaggtgaggacctgtcccctctacaccgatggccagagcctccagagtggggccaggyttttccctcagctgtgtcctgtcaggttyatctaggcctcaaagaatagaccctggacattgcctctggcaatgtgagctggacacacacccagatgtaaggtagccctgccaagtatcctggggttgccagtagttctgggtgctcagtgtctggagcggagggtgggaaggaggcttgrtgcagaacaagaaccatatgtcacatactattttattctttattagtgtttttgtcataaaaaaccccacgggtaccataaaagataaaagatctaaaaatrgtgccctttaatcaaaagtaaacaccctttaaccatcagagagagggagaagtttggcagctgacctagaagccccatcaactgccccagctcaatgataaactcttctcttcttcaaataaaagcacatcctggcttacatggccatcacttctttgtacaattttatatttttatcatctaaarttatagtttagttttacctttaagagtatatttttatcctcatttattccatagattcctgcttgaaatttatattgtctggtagtttcctgtcctttgcattttgcagattgcaccccaaggtgtggtttaatgtatctctatgacctgtattttctgtaaattggtagtttgttatagaggtttgcgtctattcagggtttttttttttttttttttttttgccatgaggattgatggtactatatcatgtttttcatcaagaggaagaattcaatactagttatttcttttttgtgatgttaattgccattgctgttcagtggctaaatctgttaattcattacaaattgcaaaagtctcagtctttcatttcttttcatatactagctgcataatttctaaaataaaagatttaccctcttccaccagttatctattcagtagaaacttgttttttgagagactaaaccaagtttctaatcacctatgacccagcaattccactttttgttatataccaatagaaatgcatgcatttgtgtgccaaaatatatgaaaatattatttatagcagcacgatttgtagactctgaatacaacacaaatgtctatcaacagtggagagacaagaagtgtgagctatttataaagctgagcacctgactgccacgggagtgaatagtgaccacacacagcaagacctgggacatggcagtgactgtgtccagaactgacagaactaatctatcatattagaaatcaagaaagtgtctgctctagggttggggagggtgatttatgaccaagtagaacccagtggtgtttcctggaggctggcaatgctattccttgatgtggctgctatttacctgagtgttcactttgtgaaaatccacggcccacttatggtttgtccacctttctccatgcatgttgtccttcattcaagtatacatttctgatgttttgaaacaattctctctaagctaatatagaatctccattactgaaagtccttagaaatgctgcattggaaaaaattagtccaattattaaaaatctatgaaataaatgctgtgactcagacattaagaggagaatctacaacaagagcagtaggcttgggagctaacacaagaacagctttggaaatggctgttgagccaggaactaggaatcaaaacccaaaaaggcccatgcaaggtggagggtgtgaaatgatgccccagtagtgcatgaatgaatgagtcatgggcagtggctcatgggttgcttggtcagtcaggaacttgagcaaaataaagttggaaaactgggggatggaagagagaggtatgcacagacctcttgacatgggcagagcttcagaagatggtggttgcaggtttccccaaatagagaacatcaataaaaaggtagaaattttacaaagagaccagataaaaagtttggagctgaaaagtgcaataactgaaatgaaaaattcactagaggggctccagagcaaatttcaccatgcagaatggagaatcagcaagcttgaagataagacaattgaaattctctagttcagtagcagaaagaaaaaaaattatgaagaaaaataaacagaactttaaagatctgtgagacaacatcaagcacatgcactttgggagtcctcaaagaaaggagagagagaaaggagaagaatgactatttaaagaataactccaaaccttccaaatttgatgaaaaacattattcatccaacaaacttgacaaattttaagcagcaaaaaaaattaaatttaaagaggtccacaccaagagaacattataatcaacctgtcaaaagccaatgacaaacagagcatattgaaatgaataacagagaaggaacttttcaggttcaatggatcctcaataagattgcagcccagttttcttcagaaaccatagagttcagaaggcattggaatgttgacaaatttagaggtcagaaaaaaaaagactgtcatgcaggaattgtgtgtctggaaaaactctccttcagaaataatggattttatatatatataaatatatatatatacatatatatacatatatatacatatatatacatatatatgactatacatagtacyacatatatataactatatatagtactactatgaaattatatatatagtactatatatagtagtcatactataaaagctagtagtaatatgtatatttttggtgtttatatgtgtgtgtgtgtgtgtgtgtgtgtgcatatatatatagtactatatatagtagtcctataaaagctagtagtaacatgtatatttttggtgtttaattcttcctttgtttttcctatttggtttaaaagaaaatgcccattgactaatgaatgaataaacaacatgtagtgtatttctacaatggaatatgatttagccataaaaggaatgaaatactgatacatgctacaacattgctgaatctcaaaaacatgataagtgaaggaaatcagctacaaaaggatacatatttcatgaacccatytttgtgaaatcttcagaagagaccaatctatagagaaagaaagcagacttgtggtgacagggtctggtggcaggaggaaatggagggtgactgcttaatggtgcagagtttcccctgaggtgatgaaatactctggaactagagagtgatgatggctacataacattgygaacctactaattgtcactgcattgtacacctattgtacaatgggtacagtggtaaattttgtgttcatgtatattgtatcacagtaaaaaagaggctgaagaatagattccaaaatcttttatatggtaaactcctgagtttgcttgagcatctgcccatctgtctttccccctcaggatgtcatctcctactcagagctcacccttgttcttctgtaagtagaaagcctttcttcacaacactcccagatcagccagacccaacccccaaaatgactttctgtcttggatccaaatgctcaggtgcaactctggggcaatttcagtgggagtgaagagattatccaactaggatgattcatttggagggaaatgtttgaccttatgttaggaaagtcatttgctttcctaaaaaggatcctgcttaccagtgagtatataatttttktatgcccggggtggagttcacagcagaggaactaacaatagctctaggaacaccatacacctcatgcgtagctgactcacccatctgcctcccccagctgaaggaaggagctggattattaccttggcccatccatcaactgcatttcactggatgtgcaccctctacaagtgtgaaccttccagggttctcagttgctcttcctgctgttgtgtggcctccactggtgtggctcatgcccagggggcctgcaggagactgagtgtctcctaattctcaaggccaacattttcagtgagctcaaatgaagattttatgttctcagggactcatattttcatctgtggaagggaaaaatccatctcgctgtcttaggtgtgatggtaattttacataaatatatatawaattatagtatttttatgtctataaatgagataatcagtattttataaattgatggtattcttagcattgacttcattgctcagctaaaygctgtaaccaaaggatgagtcatggagtggaggaagaatatttttctactctctggaggtgccataatcggcatttctgccctatggrtttcaaatgagaaatttgctttaggctgaggttggaaggagatctgaacttctttgtattactattattttagatggggtcttgctatgttgtccaagctggagagaagtgactattcacaggtgtgataatagcacacgacagcctcaaaatcctgggctcaagtgattctcccatctcagcctcctgagtagctgggactacaggtgtgcactcagccacttttcattgttattttacttcaaatgctttattttgaatattagaaatgtgaaaatctatttgatcacagaagactttaaaatacacagatcaatgcctacttgaattaaaaaaaaaataaaatacacagaagaaataccacctaggtctcccctcaaaaatatcactgctattgtattgttgaaccttcctggactcagtgtgactgttggtccctggagctgtcctttgcgtggtgctgatttccattttgttggtggtggtttgtttttgtttttgtttttgtttttgtttctgaaacacaatttcactttgtcactgaggctggagtgcagtggtgcgacctcagctcactgcaacctccgcctctcgggttcaagtgatttccatgcctcagcctcctgagtagctgagattacacgcatgcgccaccaggcccagcaaattttttgtatttttagtagagacagggttttgccatattggccagtctggtctcgaactcccgacctcaagtgatccacctgcctcagcttctcaaagtgctgggattacaggaatgagccaaggcgcctggcccattttgttgttctctatgtatatatttttataggtatctttattgtacaaggttgcattcatatgtyatgggttatcttgaatgttgctttttgaatgtattattatacaagtagttttccatgttgtaaactctgtataaagtttacatgcttttttggccggcatggtggctcacgcctataatcccagcactttgggaggccgaggtgggtggatcacttgaggtcaggaattcgagaccagactggccaacatggtgaaaccccatctgtactaaaaaatacaaaaaattagccaggagtctaggcatgtgcctgtagtcccagctactcaggatgctgagccaggagaattgcttgaacccaggaggcagatgttgcagtgagccgagatcactgccactgtactccagcctgggtgacagaatgagactccatctaaaaaaatttttaaatttaaaaagttgacacacttttacaagctgcatcccatctcagataaggaggtgatgtaactgagttcttttagatccatctgctttcatcttatctttttgtaggtaatattttgacaagcatgtttgtacataaagattctcctgtggttgggattttaaaaattcatagactactcaggccaggtgcggtgcctcaagcctgtaatctcaacacattggaaggccaaggagggtggattgtctgagcccagaagttcaagaccagcctgggcaacatggcaaaatcctgtctctacaaaaaatacaaaaaaaaattagctgggcatggtggcatgagcctgtagtcctaggtaccccagtgtttgaggtgggaagattgttcgagcctggaaggttgaggctgaagtgagctgtgatcatgccactgccctccagaccrggctacagagtgagaatttgtctccaaaaataaataaattcatagactactcaagtgataaatattaaacmagagactgctttaaacattttaaagccttattatactgtcatactgtgattgtactgacatatttattcatttaacaaatacttactgagagctatttactgattatgatggtgagaaacaatggtaaggaaacagaccagatccctttatcaaagaacatacatttcagtgatactgactgtaatggttaattttaggtgtcatattgactggrttaagggatgcctagatagctggtataacattatttctgggtgtgcctgygagggtgtttctggaagggattggcatgtgagtgactgagcggggaaaatcctctctcgctgtgggcagccacaatccaatcacctaggggcccagatagaacaaaaaagcagaaaggagtcaaattttctctctctctctctctcaatctgggacacttttcctgcccttggacatcagaactccaggttgtayggtctttggactcttgagtgttgcaccagtcaaccctttatcctcccacctcctcctctggcccctcaggcctttggccttggactgagccaggctactgtcttccttggttctccagcttgcaggtggcctctcatggatcttatcagcctccataactatgtgagccatttccactaataaatcccctcttgtctatctatctatctatctatctatctatctatctatccatctactctattgggtctttctgtcttggtaaccctgatacaccaacagacaataaacaaatagaatctgtcacagtatcagtgataattgccactgataaaaaatacacctaggctagaagattggtgggagtggcgggaatggcagggaatagatttcagaaaaggtaactgggcatgacgtttctgagaacttgaccatgggacatttgaacagagactcgaatggtgtgaggagtgagccatgtggacccccggggagcaggtgcatgtgggagtcacagcaggggcaggtagcagagacaggatggagcagtgacaaaaggctggtgtgagtggagatgagtgagctgggctgagaatggcgggatgaggccacaggggtcctatgatgaggggcttgtaggaaacggtgagagactgaggtttcattgtgcctaggaaagaaaagggctgaggtgttcataggatatgtcctaattttcgtttgagaggctcactctgcctttgtgtgagtaatggacagtgggcatgagaggcagcaggcagcccagctggaaagcccttctggtttacarttcttgagagggtggctctcgggtggtggcaggagaggagtgaaaagtgattggatttagtgttgatatacttgttaatattgtggtaaaacatacataccatgtaatttaccttctaaccactttttcagtgtacaattcggtggcctaaagcacatttacaatgttgtgtaaccaccaccaatatgcatttccagaacattttcatcatcccaacagaaactggacccattaaaccaaagctgcccattctccctaccctcaatttctggtaaattctattttactctctgtttctatgaatttgcctattttagctgcatcacataagtgaaatattatatttgtctttttgtttctggctcatttcacttayagtgttctcaaggttcatscaacctgaatttcattcacttttaaggctgaataatattccatgctatgtgcaccatgggtcgtttatctaatcatcctccgatggacactcggttgcttccaccttttggccattgggaatagtgctgctacgagcatgagtgtacaattatctgtgtgagttcctgctttcaattcttttgggtatatgcccaaaagtggaattgttggctcctatggaaattgtgtttttactttcttgaggaagcatcatactgtttttcatggtcgctrtaccactgtacactctcaccagcagtgtacaagtgttgtgacttctccacatcttcgccaacayttggactagtgaagttcagcatattttcatgtgcctattgcccatttgtatatcttctttggagaattgtctattcatgttgttcactcatttttgaatgagattgtttgtttttctgttgttaagtcatagttctttatgtattctggatattaattctttatcaggtatataaytggcaaatatttcctcccattctgtgcattttcttttaactctsttaatagtgtcccttgatatataaaaaaggtttttaaattttgatagtctaatttattgtttttcttttattggttgtgcttttgctcaccagccaagaagccattgccacatccaatgttcctaagattttcttcaatgttttcttctaaaagatttataggttgaactcctaagttgagttccttgaaccattctgagttaattgagttaatttttgaatatggtgtaaggtgatgctatgaattttgtccaacatcattattttgtatgtgggtattaaggtttcctggtactatcagctgaagtggggctgatacacttgtaagatgcagtgagcactgataaatgggaacaccatgcatttatttacttgtctttactccacaggtgattggaggaggcttttggtgacaaacccaaaagaaatgaatacatatgaattcttattaaatcaaaatcaaataaaattataaattttaaaatgttaagagtgaggcaagactagaacatcactagacaggctgaaacatgctgaaatggagggtttactgctttccttgctttaaattttgctggctcacaatggcttatgtttattgcataagggggccacagggarggktgcttgctcacataaggagcccctggttttcttcagaaacaagttcaaattctccacttagagccaaaaaaaattaattgcaagatgttcaaactgaagttggcttctataaagtcaaagaataagcagtaagtgtaaaataaacctcaggaatccaaggaaattctacctttttacctagaaatggcctcryartgcgtcgctgaagggagagggtcccttccaggaaccccatgatgtaggggtttctgctgcagtcccaaattgagttgtcccttctctctaactgcaggtcccacaagaccttactgcagcttcaataatttcacctggtctaagatttgaggggtttaatgctttttattttgagctgctgtctgggacttagaaaggtgacttgcattttttgtcaaaatattatttctttgatggaatttgacattggtggacactctgccttcctgtgtggttcctacaagggcagatgaccttgcacttctttttggcacttcactagcagtgatagaaggtttgaagttagggcctccctcaatctttaccctctctctaatgcagaggattgcggcctgttggcagaagagtrgtgtcttgggccccagctgacctgatgaatatcaayatccaatgccctgtaatgaagtcatgtgtgcacatatcatcacttctgcatgcagtctcatgggaaggtgggttcctggaccccaggttamaggcctaagcactacaggcatacagatggagctccagggaagggagagatgactggggtgggaccacacttttccttcagggtgtccctcagttcaaggaagcttgtactcaagggagagaaagtcctggcaggcctccttacccttggcaatcttggtattggggctggataattatctgttatgtgggtgattgggctgacttgtgcactgcaggatgttcagcatccctggtcattccccacaagatgctggtagcacctyctcctcactccagtcatggcaacaaaacatttttccagacatagctaatgtcctctggtgggaaaattgctcctggatgagaatacttgtttgagaggtagagacactcaggagctgggcctgtagagggaaagtgatccrgaagtagatacaaagcagagtggggctggagaagacaggaagggagtctaggtctggaggggcctggcctgatggttgaaggtctggagctcagaacctcagggtatggggamctaaagctcgtgaggaatggggagagtggcagaacctcctattgccagaatatcacactcatacccactaaacacccagcccatggttctgcatctckgggaagtcaggataaatttggctgtatggggtcagwaagagtcctggtaaccctaggctttgtgtgcctcctgatgtgatgaatgtgcggtcacagctcctcctgtaaacattgctgccaaatgtttaacccagagctacataggtccttaggaggcatagcagttagaggaaaaaagttaaaggcatcaggggaamtaatatgataaattcagtgtggagaagattccacaggtatttggcctcatctctgaaacaggtaatgccattctaaaagaaaaaagatgggttgattgttatagattgtaggtaattaaagaaayataaccaaaggcaacgagtggacattttaagraaacaagctataaaaaataggtacaaaaatgtactgaaagaagtggagatatttgaacataaaaggactttaaataatattatggaattatttattttctttggtgtgataatgttggttcttattcttaggaggtgtgtgatgaagtatttagtggtctagtatcatgggtcttgcaacttactttagaatgactcagtcaaaaatcttaatctggacccttttcataagatggtgccaagaacgaagaaggaagctcctgcccctcctaaagccgaagccaaagcraaggctttgcaaggccaagaaggcagtgttgaaagatgtccacagccacaaaaaaaacaagatccacatgtcacccaccttcyggcggcccaagacactgtgactccggaggcagcccaaatatccttggaagagcacccccaggagaaataagcttgaccaccatgttatcatcaagwttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctaattccaaatatatgtatatcttttcaccattaaaagaatcttaatctctctattcactctttctcttcacacacacacacacacacacacatttacgtgcatgctataaaaacatatctacctgtatctataaaaagatatatttttattctttatttttaaaatttatgtatgttcgtgaggcacaagtgcaattctgctacattgatatcttgcttctcagtcccacacaaggaagctgtctcacactatagagaaaatattcatgaacaaattcgtatcagtcacagtgagaggtaacactctaaatagcccatttcatgctcaagacatccaagtcaaagaaacccaatagcacagctgagtcccctctgttcccccccaacaccccactcacatcagggcccctgccctggagtgtcacctttattagctgtgagagacaccccagagccctgggcactgtcagtgattggggtagaacaaaaacaggacctggtcagagcccacagatgtggctagaggaactgtggggtgggtgagctccctcataggctcctgaccacaatatcccaacaatctcagggatcagcctccttcatcttacctgcagcctgagagtagctccctctgtttctatctatgggaagaaaatgtcctgtgagaggccagaaaggaggcagggccataaggtcctagagcaaacccctagtctttgatcccagagaagtttccagaaaagtgtaactgtagatccagggcaggatcaagaaatatgaagaaagcagatgtgggtcctggaccaactgccctcctgaggtctgtcatcagcagggaccttcccctgtgatttgtgactgctgggatcaggtcccatcaccaccataatcatcgaagtgaagaatctgtccttcattttcacaggagctttacaaatgagtaggtgctggcacacagggcccaggctgggtagacccatgagtgtggatggtgcttcccagtaatgaggcagggcacacttctacttggggcttgcaacccccagtgggacaagaaaactcagactccactcctcaccccttcctacctgagctcttcttcctccacatcacagcagcgaccacagctccagtgaccacagctccaaggacaacaaggccagcaacgatgcccacgatggggatggtgggctggggagactgctctgggaaaggaagggaaggtgaggggccctgatctccaggcctcagccctgaccctgctgaagagctccagaagggctcctgctttccctgagaaaagacatgacccctcgttcccctctttacccatctccctccttaccccatctcaggatgaggggctggggcagcccctcgtgctgcacatggcatgtgtatctctgttcctctccaggaggcaccaccacagcggcccacttctggaaggttccatcccctgcaggcctggtctccacaagctctgtgtcctgggtctgttcctccccatcccgctgccaggtcagcgtgatctccgcagggtagaagcccagggcccagcacctcagggtggcctcatggtcagagatggggtggtgggcaacgtgtgcctttggaggatctgagaagagtcagaaaattcaggcactttgcactcctcatgggaaaccccagcagcacccatgtgaccaacctgagaatggacaggacacctggggtggggaagggagcacagaacccagacaccagcctggacacagacacctgggaaaatctcctattccttggaaagttagagtctctgaggggggagcagggacttctggccctgacctaagtggaggccgagggactggaatcagagcctcaaacacattgagtgtgaggcagagaacaaaacttgagagaaaagtcacggggcccaaggctgttggagggctcaaaggggaccgcggatcggtattccagggactgtcttccctccattccctcagaaatttcatcccttaattgtcccagagagcagggcggactctcacagtcactctctggtaccggatctcgaaagccaggaagattcttcctactcaggactagagggagggcgatatcctagcattgggcccactttcctcccaaccttgtgcgaggccatcccaagagatctacaggagatagggaaggcgcccatggcccctggtacctgcgcgctgtagcgtctccttcccattctccaagtatctgcggagcaactccaggcactcgccctccaggtaggtcctgaactcctctgcatattcctctgcctcatagaagcgctgggtgatctgagccacggtgtccgccgcggtccaggagcgcaggtcctcgttcagggagatgtaatccttgccgtcgtacgcgtgctggtgatacccgcggaggaggcgtccgtcgggccccatgtcgcagccattcattccctggagggtgtgagaccctagccggtccccgcagtcagccccgcccagctagccccgccccctccccgcccaacccgcggggattttggcctaaactgaaaatgaacctgggtaaaggcgcctgggactctcccgggtggagggtctgggcgggtcccgctgcctcggggtagatttcggatccggagactctgagggacccgggcggtccgtggcggatggggggtggtcgtgacctgcgcccccggccgggttcactcaccagcctcgctctggttgtagcggcggagcaggttcctcagggccactcggtcagtctgtgcgttggccttggcgtaccctgtggtccactcccaatactgcggcccctcttgctccacccacggctcccgcggctccatcctcggaatcgcggcgtcgctgtcgaaccgcaggaattgcgtgtcgtctacgtactccacggcgatgtagcggggctccccgcggccgggccgcgacacagcggtgctgaaatacctcaaggagtgggagcctgggggcgaggaggggctgagacccgccagaccctcctccggaggcggctccctgagtcctgcgcccccaccgggcgggcccctcactcctccccacagaggccgtttctctctggaccccgcactcacccgcccaagtatcggtcagggccagggcccctgagagcagcaggaggaggcttcggggcgccatgaccccaacctccgcgtctgggaaaaatatgagtcccgcggggtgcgtgggactttagaacctgggaactgcggcgacactgattggcttctctagaaacgcgacgcccaatgggagtgagaaatggggccgcgttatgagtatccaggaagaaggacctgacacgggttgggagagaaagagaaactctggggagatggggaattctcaatactgagcctcccaaccccagacaccgcctcggggcctgagcccttgagagccactcctggggccctgggactttgccctccccctccccctccccctcctgtgcagggtgtgtctcaatgtctccctgagtcttcgcccgggggctgagaaaccagggagaaaccttcggcatggacccagtccatctcccttcattattcattccgaaatcccagtcccttgattgaactttctgcctcccattccatacctggactccccggactcttttggaagaaaattcaccccaaggagcttggtgccagacaatgaacttgtcctgagaatgaaggtgtagagacagtttcttcttcttccttttcttcttcttcttcttcttcttcttcttcttcttcttcttcttcttcttcttcttcttcttcttcttcttcttcttcttcttcttcttcttcttcttcctcttcctcttcctcttcctctccttctccttctccttctccttctcctccttctttcctcctcctcctgctcctccccgcccccctcctcttcttctctggaaaagttgtacctgagcatatgaaataggacagagaccagtttctttctttctttttttttttttattagctgcagtgagtagtagaatcttggtaacccctgaattatcaggaaccttttttttttttttttttttttttttgagacggagtctctctctgccgcccaggctggagtgcagtggcgcgatctcggctcactgcaagctctgcgtcccgggttcacgccattcttctgcttcagcctcccgagtagctgagactacagatgcccgccaccacgcccggctaatttttttgtagagacgggtttcaccgtgttagccaggatggtctcgatctcctgacctcgtgatcctcccgcctcggcctcccaaagtgctgcgattacaggcatgagccaccgcgcccgaccaatcaggaatcttatgtgtaaaaactgttactttggccccttgatatataaatgtgtctaaatgcattacagttgtacaactctcagagctcctaagttttgctttcccagactatgtatctgtgactcttgttgtattctaaaattaccttcattccatagccctgagtttctgtgggagtccaggacatctcctgacaatacaaagtagcacaacgtgtgattgtatattgcaaccaggagccaatacattcattcacctcaaagttgcaagtgttcaacgcagtcacaatgcccctcaccagtgctcatgcacttcctgtttttaggaagtatccgcatctaagtggtgtgcatgttttattggaacacttagtatttttttaaacctgaaaaaaagcagaaaaagcaattaatttttaggcagtcccacataaggtgttaaaggccaaatgcaaggaacaccctgctaggctctgtagatggatgtattaaaaatttataaaacaatgtgtttaaagctaagaattctgctgctttcaaattctgtccctctgctccttctcctcacctcctgcttctccagcccttccctccgtccctctcatccctcaggccctcctcttcccttagtccccaccactctgtcactcctgaatagtggctctagcactgttccattacctgccacctgagtgttctctccacagtggtcctgctactgtgagtcaaagtgtgtcgtttcttcacctaaaacactccagtggctccacttcggtcttgtgaagcttctagaatgtcaggcacttgagcatatgagggcatacctggttcagcataggcactaaattaatttttgttgtctagttgaatgaaatatgattgtataaaaatttaatcgcatcatggaatattataaaatgaaaaatactggaaaaaggaaatattttattttactcatgtagtgtgcttatcaatttataaattcattccatgtgtctgttgagtctgtgtatgacttttgtatgactgcataacaaattaccacaaacactggctttaaacaacacccatttattgtatttatttatttatttttagagacatggtctccctctgttatccacggtgaagtgcagttgcatgatcatggttccctgcaacctcaaactcctggcctctagaggtccccctgcctcagtgtctggagtacctgggactacaggcaagtaccaccgtgctcaggtaaattaaaaaaaaaaaaaattcctttttgtagagaggaaggtctcctcaaattgcccaggctagtctcactcctggctgcaagtaatcctcctgtgtcattcccacaaaccttaggattacaggcatgagctaccacgcttgaccaaacaacacttatttatttatttacagttccttagtcagaaatctgagcatgattggagggttctctgtttagggtttcccaaaactgtgttttcattttgagggcctccttcaggcttatacagaggcgacataattcagtttctgccagttgtaggactaaggttcctgttccttgcctactgtcaaggtagagagaggctgctctcaattcctggtgcccaccagcattctttgccacacagccccttcatttttagaatccacattggaggaaccccctcw

SEQ ID NO: 10621 - DNA, 58777 bp, Homo sapiens
  misc_feature (1)...(58777): n = A,T,C or G, or insertion/deletion polymorphism (see Tables 1-2)
aatttctccatctgatttttgacacatttcttgcccatacctaactcaactgcagtttttttacctttttaagcaattcacttttgagtctttccgaaacactcaactttgttttccttgaatattttttgtttttacactagatttcaaaggttcacataataagtgcttagattgccaggcgcggtggctcacgcctgtaatcccagcactttgggaggccgaggtgggcggatcacaaggtcaggagatcgagaccatcctggctaacatggtgaaaccccgtctctactaaaaatacaaaaaattagccgggcgtggttgaaggcgcctgtagtcccagctactcgggaggctgaggaaggagaatggcgtgaacccgggaggcggagcttgcagtgagccaagatcccaccactgcactccagcctgggtgacagagggagactccgtctcaaaaaaaaaaaaaaaaagtgcttagattatattattataatcacgttataactggaataaactggtttggaaacaaatacgactcaaattggtgggagcagaagtccatattctggagagggagtaggatagcaaagcttttcttgtattgtttcatctatctttgaaggaaaagaaaactttttgccccctcaaacaattgaagctgattcccagtttggtgatgaagtggatgttggtgcttcatcagatctgaattagcaagagtattggttcccaaactttctggtaatcataatctggggagtacatattgtatgatcctatttatatgaaattctggaaaaagcaacactatagggagagaaaatagataagtggttgttagagattgaggaacagattgactaaaaagggcttgcatgtgggaatttttagggtgaaactattttgtatggtactgtgatggtggatacgtttgtctacaaacttgtcaaaatccatagaacaatacatcacaaagtctgaacttttttcaagttttgccaaaaaataaatctctattgaggatgtcaaggggatctcagaatggaatgtggactatgacaaatgacaccaactgtattacaaatttatgacataacctcactgagctagagacaaaaagaactgtataggaacactgtactctggttggtaaatgtttcttacaggggtacaggttgtctattctgtaactgcatctatactaggcttaaacaaataagtaaatatagataatcatggccagctatctcactgttagaaaaagaaattacaaatatgcaaaggagaaatgcaggaatgaaccctgtggtgctggattggagttggagatatcaatatgaactcatgtctacacaggtagttatggaagtaaatatagacatgtatgtctatataaatgtaaatgtatatataaagatacagtgcatatgtttatacatgggttagtatacccatgtacatttttagctctgtacaggcctagaaagaatgatccttcagtagcaacaagcatacatagcactcatgtcttggtctctacaattcttcaataaaagggaacaaggctctttggagaaatggttgattccaggggcggagcaaagaaaaaaaaagtgatcccagaacatcttaagtgccagaaagtaaggaagtgataagcaaacaaatgatcaagcatgtaaaagagatacatgaagcaacctgaaagaggtcccaatggcaaaagctgaaataatttgagcagcaaaataacaacagattataaatcaaggaataaaataaatatccatgagtgcaccctgatgtaaattattgaataaatagctggagaagaaggggcaactctttcatttttttttctaagtttttaatcctctcagggtacagaaggacaactcttagagaagacttccaaataataaatgcagaaagaatgaaggaaataggaaaatcaccattcgaaaaccactataataattgctacaacagaaatccacgatgaatacctaaattagtgggcaaaactataagaagagatagaatatttgtgtagcttcaaagtatcttcccttaaatatatattgattattatggtggtttaaacatgtacccaaaagttcattgatactccttccttcataagataaagcttaatttccctctcctgagtgtgagctggatttagtgacttgctactaatggatggagtatggaaaaagaaaattagcaactctattgcggagaaacgtagcatataacacctcaatcaaatgatcatggttaacatcaccagtgataaatcatgtcacattttccttaatctgatgcagtgaagacatttcattctggtgttctttccccgagtctaaccatgagtaaacaaacaccaggcaaattcaagttgaggggtagtctacaaaatgcctgatcaatattcttttttttttttttgagatgtagtctcactctttctcctaggctggagtgcagtggcgcaatctcggctcactgcaacctccacctcccaggttcaagcgattctcctgcctcagcctcctgagtagctgggactacaggcgtgtgctactacgcctcgctaatttttgtatttttagtagatatggggttttgccgtattggccaggctgctctcaaactcctgacctcatgatccacctgcctcggcctcccaaagtgctcacacctgtaatcccagcactttgggaggctgaggcaagtggatcacttgaaaggccaggnnnnnnnnnnnnnnnnnnnnataacatggggggttatatccgtcccccatacgcgtgctcggccccccgacctcctccagcacatccgcctccccctccccctcccttccccccccgcccacccacccgggagtaacctcgttctgcccgcccactccgcactctcctttctcccccgtccccctcccctcgcctccccccccgcatcctgatgatcctcccctcccggatcggcgtctcccccccccgcccctctccgcgggaaagaccccgcggcaagtgggtcacttgcaagtccagaaaaaaagaccaacgtggccaacatggtaaaaaaccctgtctctactaaaaattaaaaaaattacctgggtgtggtggtacacgcctgtaattctagctactctcaaggctgaggcagaagaatcgcttgaacccgggaggtggaggttgcagtgagccgagattctgccacctcactccagactgagcgacagagtgagactccatctcaaaaaaaaaaaaaaatgctactgatgttattttgattatcagtggaatttgatttgaggactactgaactgcagaaatcaagagtggaggaaaaaaaaattgatctcatttttccctaaactatgcatgtgagattagccatcattaattataactttttttttttttttgagacagtttcgctcttgttgctcaggctggagtgcaatggcgtgatctcggctcactgcaacctccgccacccgagttcaagcgattcttctgcctcagcctcccgagtagctgggattacaggcgcctgccactatgcccggctaatgtttttgtatttttagtagagacggggtttcaccatgttggccaggctggtctcaaactcctgacctcaggagatccacctgcctcagcctcccaaagtgttgggattacaggcatgagcaccgcgcctggccaattatgacttttaaaaggaaaatatgtccattaatttgagagcatggaccaacgcagtagtgacatcaactacttcactcactttcagtctcttacccttggcagcctcctccaattgttcatggtgttttggaacagagtggttggtacctaatgtgacagtggtcacttaattttcagtaggtagatggccttggggcccaaatttcagtgacttgttcaaagggaggaagcaaaggaactgaatgaggaactgacttgggctcaggagtatgcatgtaggcctccgtgaaaacatctgaatgaacacagagtccactgtggtcaagaaatataaaaatacttaatgtgcttgtgcctcaagcttctgccatcagggacaggtttatttgcttttatttgtctactcttaagatctatgctttgttttgcttagagaatcaagtttagcattaataaacactagtgtgtaaactacattttcagatggggcagaaatgaccagttcctttggtttcatatcatcatataaacatttttttattttttgagacagggcctcactctgtcacccaggctggagtgcagtggctgctcttatttgtggttatgactgtaaaatataggtaaatataggtaagatcactcaaatgcctcagggttatgagtgcttgggggagaatggggtcaatgaggtccaaaaccatgacctagaagtcatcttgtcctaagtattttaccacttgtaagacagccaagctgtacatgaggcgggggatcctactgggagataaagcataatcagagcagaagtctagtatatgaggctcttcttcgatagcagaaggaagctacccttttatgtcctcaaaaggtcccagagtgctgtatttcctcgaggaagaaggagtatcagatcattactacaatggttgaactagtttacagtcccaccaacagtgtaaacgtgttcctacttctccacatcctctccaccacctgttgtttcctgactttttaatgatcgccattctaactggtgtgagatggtatctcattgtggttttgatttgcatttctctgatggccagtgctgatgagcattttttcatgtgtttgttggctgcataaatgaacacttggacacaggaaggggaacatcacacacctgggcatgttgtggggtagggggaggggggagggatagcattaggagatatacttaatgtaaatgacgagttaatgggtgcagcataccaacatggcacatgtatacatatgtaacaaacctgcacgttgtgcacatgtaccctagaacttaaagtatattaaaaaaaaaaaaaagaagatcattactacagaagagatcttccaccctgtggcagaacttccttttatcccattcacggatctggttgcccacgaagcaggcctgccatgaaaacatctgaatgagcatgcagagtccattatggtcaagaaatggaaaaatacttagttgtcatgtacattaattatttttcttaaaccttggggtaatagtccgggggcaggcctgcttttggggcctgtgttaaccccactgtgctccaagcacagagaaacacggtgcagcccacaattccttctggtttcttgaacaagtgtcttctcaggactcctctcagttcctgaatttcacaaaactgctaccgacgttttaccagttagaaaaatgtccaaaataggataacccagaattggggatggtggagggtgaggaaagtatgctttgccaagagaccgacatcatgtacagtgagagtaaaaggaacgggctgttttactggcgagtagaagttgttgactaatgtcaaagcaaggaaaagattcaaggatccgctatatccgtgcttatacttggcaaatcgcatttctctggttcagggcacaataaattccatcactccacaggaaagactgccctactagagtcaactgcggttgtgggcactttcgctgacaagcgaaaagccttgaggtaggtggatgctcccaggaaactcagacgtccgaagttcacgaggagttgggtcgtgagaggggccagacctcgatccgcggggcgacagctgcagtgtcgcgtcgcgagcaggagcttggcggcgtagagcgccagggtgccaacttcgcttccaggcctgtgggttccgcccggcgcgtgctgctgtcagtcaacgccctcggcccgcccccgccgaagctccaccaatcgtagccgggggtcggaggtgaggagacgtcgccgggtgaggaagcggggggctagcggcctggcgctgcggcgaccgaccggggcgtcaggatccctggcccccggagagcgaagggcgggcgggtcccggaggtgagtgctggatgtggtctgtgtgcggacgtcgggaggggccgctgcgggcggagcgacccattgcccggctctgccagcgcgctcctagactgcgaagcccctccctccgcgcgcatctgctcccgagtccccagccccgtgctgataggtgcagcccctggagtcgtggctgtgggcataggtgccagggaggggaggcccgggtcgaaggcataggcagaattggagccctgggttgccaaagcgtcgcagctaagaagccggagcccaggctagtaccggcggggcggggcggggcggggccgggagcgagcatctccatcctcagtttcctccacttgcggcaacgccacagctcggtacagttcggacctccacgccgcagcgaaagacttctgtcctccaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcaggtcgtatggggagaaacgagtgtaactttacaaggtgtgatatggagaccctggcctgttgcccatttctgcctgatcaaaggccactagggtggtaataagaggggttccgaggcaggatttatgcagcatttgtgcaaaattgtaaattttctttgcttttcattatttacattaaagggggattgttgccacatttcctaaagataaagaatcacactgctttggtgggcctccccgctcctcactgtggttaattatcatttggaacatcaggatatatttgaaactggcaggactcccagaccctgataattgtttggaggcagcagtatactatttctccgtagtgtttgggttctgcttttctttgaatttgtttagtatttttttttccatgtctgttatcctcacaatctctttggggccaatagagtgctgttatttgttactgagaaaggaaacgaagggataaatcactgaagtggggttagccttccccattgcctgggaattgggttgtcctgaccygacaatttaagttacaattcaaacatcattttggaaaggccatccttttaccaactgaaacgaataacagtccctggccactctatactagtggttctcccacttggctgtatgttgtaatcatctagggacctttttaaaaaaagctacttcttgggcctattcctacagattctgatttaattgtttgagtggggcccagttgtttgtattttaaaaagcttccacgatgattattaatgttcatgcagggttgaggaccacaacctatcaatgtgttcaatatttaaaaaatagcacttagtacagtgtgacttatataactgattttattacttctccacttgctatgtaacctccatgaatacatggggccctgctttggaagaagggcaagggaaggtccagatgagtcagcactttgtgcatgtgaggctgcgggacacgaaggagaaatggaatctgtggaaacaagtcctgcagactactgcccctgcttcatcttttttcaaggattgaccctatttggttaacccatcattgttagggtcctggatgggtctccagttcttcattctgtagatcctgccctgtttcaaggtcttactcagcatcctatgaaatacagctactctttgcaaagtttgaaatatatgcatttaagtgtagatattttccatgtaaatctgtgcttttgtctcttactattgttctgaactatatattctgaactaaagttccagacacttgctgtgactagtacagttacatttatttggccaacaggtcagagtagttaggatagggactgcctcagaaactggacagtttctatgcagttgtcctataatatattatctttgtggaatggttgcctgagaacattagctccccagaggatagggttgctgtctgattttctttgtttaatattgaactcaggaatttcatttgtgttactgacaattgtaattccaaatgatgtaagtgactgctttgtaattctcttgtgagatgggggtaggaaccctaatggcagtctggggttgttgtcacaggccataaagaagttagattggccactatgagtcttggatatggaagtaggcttaataaaaatttggcagaacacttccaacaaatactgggttccacatgtaaggcagagcatgcatttaactttttgcttgttctttgcacatattataaaaataaagcatgagtaagtggtggtctgacatttgaaaacaggatcactcaagtttagattccttgaataataacttttagatctgtacagataccccttttttctgtaggggaaaacaagatcattggatcattgaactaaataattataatagtttttaagaaaaataacatttggagcttttatctttggtttatattttttcacttatatcgctgtttataaagttttgaccttcagccaaggtctgagagtgatttacsatgttgaagttcatgtatttaaatagactatttaaattactgttttttattagtaaggaaaaggaaacgttcctatgcccactcctcccactatatcatgtataactctcttgcctgtaaaattgtactcttaatttctaatgtttttctttacttcattttcagtatctttaacctttatatcatatgcatatttttgtttcagcaagaagaattgtatagaaatgtaaamaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaaggtaaattacattgaattatatatttttatttttttggttaatctgaggaacttttttctataatcattccctgccaacactgttgttcttacttgattttaaggctccttgcaaatagcattcctgttataatgcgtaggttttatgtttataggaaaataccaaaaacctgttacagttttttttttacactacaattacctcatgccgtgaaatagttttcttcttttacttaaaaatctttcagtttaagttgaattgatttcacagatgtgatttaatgctttgtttctgctatgtctcatctttaatttttacttttagaaattggttttattctttattttatttcatttttttttgagacagagtcctgctctgttgcccaggctggagtacattggtgtgatgatcatggttcactgcagcctcgacctcccaggctcaagcaattctcctacctcagcctcctgagtaactgggactataggtgcgtactaccatgcccagctaattaaaaaaaaattttttgtgtgtgtggagttgggggtctcactatcttgcctcagctagtctcaaactcctggtctcaagcaaacctcctgttttggcctcccaaagtgttgggattattggcgtgagccaccatgcctggcccagctttattctttgtatttgtgatttttatttcccggtgaaaaattaggacatacagataaaggagaaaacaaaaactgccaagaggtgacaactattaaaattttaatatatatcttttcttttttttttgagacggagtctcgctctgtcacccaggctggagtgcagtggcgtgatctccgctcactgcaagctccgcctcccaggttcacgctgttctcctgcctcagcctcccgagtagctgggactacaggcacccgccaccacgcccagctaatttgttgtatttttagtagagacaaggtttcaccatgttagccaggatggtcccgatctcctgaccttgtgatccgcctgcctcggcctcccaaagtgctgggattacaggcgtgagccactgcacctggcctggtatatatcttttcaaagagaggtctgtctagtgtgcctcacgcaacatctatttaggtgtacaaatgggtctctcaaatgtcagtgctctacttacagcacagagtcaggtcttttcctgscacaatcctcctaaattattgtcagtagaagcctctagctgggagggacttcttgcattgctgcctctggtcctgtagttcttttgctttagagtctcctgcccttgccttctttctgcatcactgacagctgtgtgctgctgctgcctggctgaaccacactgatgtcctttaaatggctagtgtccacacaatgcatgaccacacctgcctatggtgcaactaaattcctgtggactaccatctttggtcttttccctctctggccattgtggaaacctgattttttttttatggacaactttttgagaaggatttcaatggcagaacagttgggaccctgatgacagagttatcctctattttacagccagtttcttccaagaagttatagacagtttgaggtggatgagtgtctggatattggagagaggaggtgtcaggaaatggagaagcacagtctttcacatttcctggcatccctgtggaggtggccaggactggtggatttatttctccttaagaaggggctgacatcttgtctaatatgagtgtaagcttttcaaggggaatttctggcacttagtacagtgtgtggtatagcgtaggcctccataattatttgttgcatagattgttgaatcattgtgtaccatgtaaagaactaagtaccttgagcaaatcagaaaagtataatgcagtatcattaagttgcttttctctgatatatggttttttaaaaaaatacagtcataattggtatagtctagtttgagagataagaaatacaaatagagggagcatgagggagaaaaaaatacaaatagagatcagcagagaagtgaaaataataagtgctatgggaactctgaggatggagagcttgttggaatggctcacccttgtctcctttgtgaagctgattggcattgtcattgtggttgggactggttcagacaggtgaggcagaggagtgagagaatgggggcttgccaggtccaacacaaagtggaggggagagttgatgcagctgagttattctgagatactctgcaccatgattttgtaccctttctgcctttatttctgtgtcctgcccttcatggaaagtctccctggggatagaatactaggacattttctgtttacctgtatcaaaatggcaagtggaaagagcatttgaatttgttacgtgggagaacagttaggcactgctgactctgaagtcctctgcctctagcaggtgtgatgaaggattttgggatcctgttacccatttttcaagcttgactttcctctcccacatcttccaggcaggtgtgtgtcttcctgtgccttatcatgtagctgagggagcatcaggaccacatatgtggtggggagagctggaaacctaaagagtgtgtcgcgtctcctgccatacctctgtatgagagrggtagcacttcttgtttgccagagaatgtcaggatgctttgcacagtatcccagagctcttcatgaaaacagtttcctcttcatgttctttaagtgtaattaatgtagcagtgttacataacttaaagggaaggggaagggaagtgattttattgactgaggtctctgtagaaatttagcagttacttttatttcacaatttctgagtttgaagacatacttccttactttcttaaaagttaaaacctaaataggcaataggggaaatattgtatttacacggaagcctgacactgggaaaggaaactttgaggagattgtctggaaatgaaaagacgttactgtgctctggctctttgctttctccttgtgactttgggccttagataaggttaaggaagaggaaatgtgatgtttttcctctcaccccaccctaggccattgcaattggygatgttctctcatctctcctctttgaaggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagaggtgagtacccagtataatcyctcataactaagggagccgagtctggggatctggggctaactagcctgggaaaacgttggttatcggaagkttatcgtagtcacagttcttgttttcatttattcggtaagtatttgcgtrctcacaatggttatatacgctgctagtcaccgagggtacagtgaagacatttcttcacttacaggcctttctttctagtgctcacataataagtgtgcatggaagaaaagtagtagtaatcataatcacataataatagtaaygataattggacattgtgaaaagtgcaaaaaggaaagggagctattctaggatacctttagagtgatgaaggaaaaacctcttcaaggaggggacctttcagtcaacccatggaaaaaagctgaaggagtatttcaagggagggagtagatgagtctgtgttggagattactagatggtactcagggaccatgtcttactgaatccctcacaagggcctgtcactaagaaggtacttagtagtgttccttcttccctgtccccagccccaacatgaactcatataaccaaaatttatggtggagtttctgtataaaggatgctgtccttttgttttgttggcttgtggtacttctcagattacatatccaacttaattatggcatttcttttcttattgggttttattagcctaaggtgctctaaaagctaagccataggcttttaaaaaaatttctcctgctggaatcaactttgtggtttttagcagaacacctaatctctctgtgaaatgggcacactaaggtcctacagatcttttcctgtgcgctgtgagtaaaatttgtttggtactatggagaatgtgaagtaattctgttaaagattctgttaaagatttcctattagaaataggcttaaggcataaaagctargtatttcttcttctttttctttgcttaaactgttcttgygtgttttactatataagatactaccaatcctacaccgatagttccttttacctggaagctgttgatgatgtgtctagatattttagaaactctttttttaaagtattttttgtggtaaataactaacatagaatttgtcattttaaccatttttaggtgtacaattgagtagcattaagtacattcacattgttgtgcaatcaccccaccatctatgtctagaactttttcatcttcccaaactgcagctctttacccattaaacagtgattacctaggtcaggcgcagtggctcacacctgtaatcccagcactttgggaggctgaggtgggaggatcccttgaggtcaggagttcaagaccagcctggtcaacctggtgaaaccccgtctctactgagaatcacttgtacctgggaggcagaggttgctgtgagccgagatcatgccactgcattccagcttgggctacagagggagactgtctcaaaaaaaaaaacacaacaaatccaaaaaacaatgattacccattcctgcctatcccctgcccctggcattcactcttctactttgtgtctctatgaacttgacaactctaagtaccttataccagtggaatcaatcatatgatatttgtcctttttttgtttgtttgtttgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccttctgagtagctgggattacaggcgtgtgccaccacgcttagctaatttttgtatttttagtagagatggcgttatgccatttgaccaggctggtcttgaactcctgacctcaagcgatcctcccaccttggccttccaaagtgctgggatcacaggtgtgagccatgaagcctggcctggtatttgtctttttgtgattggcttatttctgttagcataacgtccccaaggttcactcatgtagcatgtatcagaatttcttttctttttaaggctgagtaatacttctctgtctacacatagacggaggaatattattcaaccttaaaaaggaaggaaattccgatagatgctacagcatgtacatacataccacattttgtttatccattcatctgacatttgggttgtttctaccttttggctataatggataacaagtatttcttcaagactctgcttttaattctttggaataggtacccgcaaatggaattgctggattatatggtaattttaattttttgaggaaccaccatattattttccataatagctgcatcattttttatccttatcaacagtacacaagggttccaatttctttgcatcctcgccagcacttgtcattttgttttgtttttttgatagtagccttctttgtggatgtgaggtaatgtataacagtagttttaatttgcattgccataattattaatgatgttgagcatctttctatcatktgcttttggataaatatccaattccggtactcactgtttaacggagttgtttgtttgttttttgttgttgttgagttgtaggagttctttatgtgttctggatattcactccttatcagacatatgatttgcaaatattttctcccattccataggttgctttttcactctgattttgtcctctgatacataaaaatttttactttggatgtagtccagtttatctgttttgacttttgttgcctgtgtatttggtgtcatatccaagaaatcatcaccaaattcaatgttgtaagacctttcctctgtgttttcttctaagagttttatagttttagctcttacgtttaggtctttgatctactttgttatcctttaaaaaaattgtgatgaaaacacataaaatttggtatcttagttatttttaggtgtacaggtcagtagcattaagtctttttttttgagacggagtcttgctctgttgcccaggttggagtgcagtagcatgatctcgtctcactgcaacctcctcctcccagattcaagtgattctcttgcttcagcctcccgagtagctgggattacaggcgtctgccaccatgcccagctaatttttgtatttttagtagagatggggttttgccatgttggccaggcgggtcttgaactcttgacctcaggcgatccacccacctcggcctcccaaagtgctgggattacgagcatgagccaccatgcctggcctcagtagcattaagtcttatttacattgtcttggaatagatttccraaaccccttttatctttttaatatctgtagaattgtgtttatcttattactcctgatcactctgaccagagatttgtgttttattgatctttttgaagaaccagcttttgatttcattttctgtattttttctgtttttttgtttggtcaatttccattctgatctttattatttcccttcttctgtttactttggatttaattgtctcgtcctagtttcttaaagtgatagctaaagtcattgttttgagatctttcttttctaattaaatgtttaatgctataaattttcttctacaaggctgggtgtggtggcttaggcctgtaatcccagcactttgggaggctgagacaggaggatcacctgaggccagaagtttgagaccagcctgggcaacatagtgagaccccatctctacaaaaaattttgaaaaattaggtgagtgtagtggtgtgtgcctgttgtcctagctacttgggaagctgagacgggagaatcccttgagcccaggagtttgactttatggtgagctatgatcatgtcactgcacttcagcttgggcagcagggtgagaccctgtctctaaaaaaataaaaataaaaataataaaaaatgtatttctatatactgctctaatgtataccacacatttagatattgttctcattttcattttcattcagctgaattacattctaatttccctttttcttttctttaacccatgtgttatttaggttttttttggcgacaaattttcactctgtcacctaggctggagtgcagtggcatgctcatggctcactacagccacaacctttgggctcaagtgatcctcccacctccccctcccaagtaactgggactacaggtgtctgcaaccatgcccagctaattttttatgtttttgcagagatggggtctcactatgttgtccaggcttttttcaaacttctggactcaagcgatcctcctgcctaagcctcccaaagtgctgcgaatacaggtgtgagccactgcatccagccccatatattatttagaagtgttatttaactttcaaatatttagatattttgcaaatacctttctgttattgattcctcatttaattcccctgagagcatactttgtattacttgaattcttttaaaacattattgagatttgtttatggcacaaaatatggtctattttggtatatattctatgtgtactggaaaggaatgcattctgcttytattgcatggagtattctataaatgtcagttagatcaacatggttcatggtgttggttgtcttctgtatatctttactattttctgtctacatgctctatcagttattgaaaggagaatattgaagtctctcactataattgtgaatttgtctatttcaccttgcatttctgtcagttttcacttcatgtgttgtgaaattctgttcttaggtacataaatgtttagaattgtgtcctcttgatgaatttagttgctttatcatcatgagttggccttcttcatgcttggtaaaattctttgctccgaaatgtactctgtatgawattatataaccactctagctttcctttgtttgctgttagcaagtatatctttttccataattttattattttttattttttttgagacagggtcatgctctgtwgcccaggctggagtgcagtggcatgaccatggctcaccacaacctctgtctcgcgggctcaagtgatcctctcctctcagccttctgagtagctgggacaacaggtgtgcgccaccacgtctggctaattttttgtattttctttttagatacggggtttcgccacattgcccaggctggtcttgcactcctgggctcaagtgatccagctgccttggccttccaaagtgctgggattacaggtgtgagtcaccacacccagccagttattattttttaaacctacttgtgtttttatatttatttattgaattgtattttttttaaaactttcattttaggtttgggggtacatgtaaaggtttgttacacaggaaagcatatgtcagtgggggtttgtgtacatattatttcatcacccaattattaagcccagtaccctctctgctcctctccctcctcccactgtcctygctcaagtaaaccccagtgtctgttgtttccttctttgtgttcataagttcttatcatttagttcccacttacaagtgagtacatgccgtatttggttttctgttcctgtgttagtttgctaaggataacagcctacagctccatccatgttcccacaaaagatatgatctctttcattcttatggctgcatagtattccatgctgtatatgtaatataagattttcttgcattttcttatattttttatggaacataagattttctttatccagtctgttatttatttatttatttttgggtcagagtcttgcactgtcacctgggctggagtgcaatggcacgatctctgctcactgcaacctccgcctcccaggttcaagttattctcctgcctcagcctcccaagtaactgcgattacagatgtccaccaccacgyctggctaatttttgtatttttagtagagacatggtttcactatattggccgggctgatctcgaactcgtgatctgcctgcctcagcctcccaaagtgctgagattacaggtgtgagccaccacgcccggccttatccagtctgtttttgatgggcatttaggttgattccatgtctctgctgttgtgaatagtgctgcagtgaacatttgcatgcatgtgtctttatggtagaatgacttctattcctctaggtatacactctgtaataagattgctggtggaatcgtagttctgcttttaggtctttgaggaattgccataatgctttccacaatcgttgaactaatttacgctcacaccaacactgtataagtgttccctttcctcttcaacattgccagcatctgttattttttgactttttaataatagctattctgactggtgtgagatctcactgtggttttgatttgcatttctctaatgatcagtgatattgagctctttggccgcatgtgtgtcttctgagaagtttctgttcatgtcctttgcccatcttttaatggggttgtttcttgtagattttgtttcagttcctcatagacactggatattagacctttgtcagatgcatagtttgcaaatattttctaccattctgcaggttgtctgtttactctattgatagtatcttttgctgtgccagagctcttaagtttaattagatcccagttgtcaatttctgcttttgttgcaattgcttttggtgtttttgtcatgaaatctttgcccattcctatgtctgggatggtrttgcctaggtggtcttctagggtttttacagttttggattttacatttaaatctttaatccatcttgagttgatttttgtatgtagtgtaaggaaggggtccagtttcaattttttgcatatggctagccagttattccagcaccgtttattgaatagggagtcttttcctcattgcttgtttttgtcacctttgttgaacatcagattggtcataaatgtgtggccttgtttctggattctctattctgttttgttggtctctgtgcctgtttttgtaccagtactattctgttttggttactgttgccttgtagtatagtttgaagtcaggtaacatgatgacaccagctttattctttttgcttaggattgccttggctatttgggctctttttggttgcatatgaattttaaaatagtttttttctggttttgtgaagaatgttgtcagtagtttgctagraatagcattgaatctgtaaattgctttgggcagtatagccattttaattatattgattcttcttattaatgagcatggaatgttcttccatttgtttgtgtcttctctgatttatttgagtagtgttttgtaattctcattttagagctctttcacctcccttgttagctgtattcatgagtattttattctttttgtggcaactgtgaatgggattgcctttctgatttggctctcagtttggctgctgttgatgtataggaatgctggtgatttttgtacattgtttttgtattctgaaactttgctgaagttgtttattaactagaggagcttttgggctgagattatgggtttttctaaatatagaatcatgtcgtctgcaaacagagatagtttgatttcctctcttcctatttggatgccctttatttctttctcttgcctgatcctctggctaggatttccaatgttgaatataagtggtgagaggtgacatgcttttcttgtgctggttttcacggggaatgcttccagcttttgctcattcatgttgtctgtggtgtttttatatttaaaacaggtttcttctagctagcatgtaattggatcttgttttttatctaatctgacaatctctgccttttagttggggtgcttagcctgtttacatttaatatattttttgaaagcattatggttacatctaccattttgctgtttgttttttatttgtcccacctcttctctattcccctttttcctttttttctgccttttttttttgtattaattgacaaggtctttttttttttttttttttttttttttttatctgtgcttttccagtctggctggtaggaagtactattcctgtataaactcaggttattgtttttatttttatttttatttttgctttcagtagttctctccccagcctccaatagtttctttatacacatatgcttatcatcgctctgttgaatacttgagtgggactgtctgtagatctcctgagttatttttcttcacagttgttttgctttcctgtgaattataatcaccatggtctttaagactctcagcctcatctccttgccttgggtgctttgccatgctccaccggggctcctcttcctgtgctgcagcctggaaactctctcaagacactaagctaaggacagtccttgggctcatctcgtttgtttactgtctctcaggcatcactgtgttttattgtctgatgcctagtgtctggaaaaccattgtttcatgtattttgccttttttttttttcagttgtttcatgtgagaggctaaatcgcattactgtttctctatctttgctggaagtggaagtttgagggacttgaatttgtggggaaagagattatagagaagctgaaggggggaggagaggatgagatctagagcacagatggagcatataaccttttataggacaaggagcatgagtatattgtgagtattcttgttattttattaactacataggaggagccgtgttccttcctctgacctaagagggaaagatatcctgatggttggcaatgcagatacatttgcttagagggtaggacattcagggagtttctggctgtgaagaagatggaaggtaggagggtagagcccaggaggtttgtgtgggacttgaaataatggttttctagatggagttcgaaataatggatttctagatggagtaggatggcagagggacaataaatttcaagaccttaagtgtgcatggcacttactgcattggttttgtgaatgtgtgtgttaattttatcatattcaacacacaaagtattataatagacaaaaaaagatagttgtgtagttcttgggtagagaaggaggaaggtaaagggagagacagagagacttgagagggtaggctgcagtcccacatcagtaatgttataacagtcaggaaggaatgttagaaaattattcttttgttctactttagttcttggaaacttccgtacttaatgccagctaaaggctctaattatttgaacgaactaactcttctctactgaatggagaaggcaggtatcaatattgaataaacagttgtgatattgaaaatcagatgcgtcttttagtggagtgagctataagcattttcacctgtctgaagaggtcatcttgtccagcatgatactgttgtcatgaattttaagctacttattactgtgatgataattgataaagaagcttggagtaaatggagaaaaggctctggctctgaaatttgtcagtctctcactctctaatccctttccatactatgcttctgacactcactatactcttatgattggagtatcttatcagtttctaaaacgcagactcaattgtaatgaaaaatattacataagctgggcacaatggctcatgcctggattcctagcacattgggaggcccaggtgggcggatcatctgaggtcaggagttttgrgaccagcttggccgacatggcgaaacccccgtctctactaaaaatacaaaaaagctgggcgtggtagcgggtgcctataatcctagctactcgggaggctgagacatgagaatcacttgaatctgggtgtcagaggttgcactgagctgagattgcaccactgcacttcagcctgggcaacaaagtgagacttatctaaaaaaaaaaaaaaaagcagtccatattatgagaagggggtatttgtaacaatatctagcaaaagattggagggagaattgcagtcttttatttctccgataaactctcattgagcaagttctgtattttttttcttttgccttattcattgatattttagatatgtattataacacctgtgtattagggctttgggcttcaggtaaagatgcccaattcaagctaatggtaatatatattactcatttgaatagaagtcagtagataggttgggcatagttcttttgggaatcagcctctgtttgtctgtaagcctcttaactgtgccttcttttgtgtgttacctttcatctatggcatcctccttcatggttgattgtaggatggctaccagagcaatggcgtttttgctttcttgtacatgcccacctgaagaaacagttgttctcttgaaatgatctcaaggtactgtgttttttcatttgcaagtacaattcaaatagctgttaccaaggggaattagtggtgcctggatttggctgcatgcaagcataagcctccagcaacctcacctggttctcatagtccagaattgggtcacatgcccattcctgaaccagccgtttacctgggactacccctccatcagttaggcccacccctgggctgacaggtcagcaaacagcattgctatggttcactaggccaggagtgaaatggatgtgggacaggcaatcaccatgttcactccagcccataggttatgatggcttgaggagtgagccatctgtttggtatttcctcttagctctaaacctaaaaagatggcgggtgtgaagttgcccttgtctttaggaaaattaagcaaattgacatttttgcatttttgtcatttgcaagtaaaattcaggggaattaccaccaaatgtgtggtgatttctggattgggttgcatgtatcagtcagttgggcgaggaagaaaggaaaaggttaggaagaggagctatgctgtaagcacatggtgcatgatttggtccttaatggtgtgtcacagacttacaacaactaaaaaggagagggtggctggaacatttcctgaaaggtaatcagtaagttaataaagggaatttttcaaagtcagttttgttttccccatgccattttttaaatgaacaaatactgccatatactcctttaaaatgaagcctcctaaatgagattctttaaagtgaaaatgtgtgtatgttagtataaaatcagaggggaaaaatacagaatctaagaagagcattaaacattcttgtatcttgagattatttttaccttatgtaggattttgaagtggtttgttataggtggggatcctgaggccttgtttaagtgttttactagaaacaaggaaatgctatagctattgaggagagagatttttggttttgctttgttgtttattcccctgcagtttaaccaattgcataacgtaagatgtagttttctacatcttaggtagattagttatatgcctcaggttaggtatataacttttttcctgcccatttattcctgtatcctgtttactaataaagtaattcatggaatagatggaaatttcaaagaatggagaatggtattaagtacacagttggatcccctccccattctttactctgagtgaatgtagttgcttatttttaattatttgggtagttagcactaattatacattacatacttatatcttgatttgtgaactttacaaggtatctcctgacttgttcatatgaggcagtgtatcatgggtggttaagaacacaggtcttaattcagacagcttggcttctaatcctctgctgcttctaacctacatggccttgagcaaattattaagctattcttttttttttttaattttttttttttattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatgattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatkatgagcattttttcatgtgttttttggcttattaagctattctttgcctcagtttccttgtctctaaaatggacataataacaggacttaccacatgtgataatttgaacattgaatttaaagattcatgtaaactgtttacaagagtatccagcacataagtgatcacaataaatgttggctgtttctgctactgctgttttttaatttttctttcttttaagcacagggtctcactctgttgcccaggctagagtgcggtggcacagtcattgttcactgtaacctctaactcctgggctcaagcaatcctcatatatatacacatatatatgtatgtgtatatatgtatgtatatatgtatgtagatatatgtctatatatataatgtatatatatgtgtgtctatatatatatatatatwtwttttttttttcttttaaagtttttgagacaaagtcttgttctgttgtccaggctggagtgcagtggcacaatctcagcgtactgcaacctctgcctcctgggttcaagcaattctcgtgcttcagcctcctgagtagctgagattacaggtgtgtaccaccacacccagctaaatttttgtatttttagtagagacagggtttcaccatgttgcccagactagtctcgaactcttgagctcaaacgatcccgatctgtccacctctgcctcccaaagtgctaggattacaggcgtgagccactgtgcccagcccagttttaatttatatttatttatttatttgttagagacaaggtcttgctctgttgctctggctggagttccatggtgtgatcatagctcactacaacctggagctcctgggttcagtgatcttcccagctcagccttccgtgtagctaggactacaggcatatgccaccacgcttggctaactttaaaaaaaaattcttgtagagatgggggtcttgctatgtttcccaggttggtcttgaactcctggcctcaagcagttcttctgcttcagcctcccgaagtgttggaattacaggcatgagccactgcacctgatctactactgttaacataatgaaagatgaggcctctgcttcattctccttccacaatttgtaaaattaattttatttctatatataacattaaataatgtatctagtccttttatttccccaacagcataatatatcttaacttcctgctctaagtgatgaagaaagccctactcattcttatttatttatttgttattatttttttgagatggagtctcattctgtcgcccagcctggagtgcagtggcgcgatcttggctcactgcaacctctgcctcctgggttcaagcagttctctccctcagccttccgagtagttgggattacaggcgcctgccaccacactcagctaatttttgtatttttagtagagatggggtttcagcatgttggccaggctggtcttgaactcctgaccttgtgatccatctgcctcggcctcccaaagtgctgggattacaggtgtgagccaccgcatctggcctacttcattcttttatatttgatttccactagttataatattacttttgcatcattaggtgcattctttatggattgtatccttcaaggaattggtccatttcatctgggttatcaaatttatgggcatagaattgttcataatattcctttattcctttaatgtccatgggatctgtagtgatggcttctctttcatttctgatattaataatttgtgtcctccctctttttttcttagcctgggtagagggcttatcaattttatcaatcttttraaaaaccagctttgggtttcattgatttttctttattgatttcctgttttcaagttcattgatttctgctatcatgtttattatttttcttctgcttattttggatattgtttgctcttctttttctagtttgctaagatgtaaggttaaattactgattttaggttgtttttcttycctaaaatatgtatagtactatgaatttccctctaagcacttctcttgcttcattctatagtgtttaatgaattatattttcaccttcacctagttaacatatttttaaatttctcatgagattttgtatgttacccatttgtataccattttgggatttttccagctctctttctattattgatttctagtttaatttcattatggcttaagagaagacactgtatgatttttattttaaaaaatttttaaggtgtattttatggcccaaaatgtggtccgttttggtgaatgttccatgtgagcttgatatgaagtagtttacagatgtcaactatatccagtttattgatggtgctgttgaattcaactatgtccttaccgattttctgcctgctggatctgtgtatttctgatagaggattgttgaagtttcagactataatgtagattcatctatttctccattagtttttgcctcacatgttttgatactcattggttaggtacatacatgttaagggttgtttttttttttggagaattgactcctttattattatgtaatgaccctctttatctttgctaaccttccttgctttgaaatctgctctgtctgaaattaatataactactactggtttctttggattagtgttagcatggtatatctttctccattcctttacttttttcttggtgtttctccatcttaggttggactgggtggctcgagtgggctggagttggatatttcccttctctcaagttggttaggctctgataaaactccaataggctaggttctgataaagtggtttctcttgaggggcagctttgttaagaacaacacagtgctctgcatacttcaaaatgggtccttttccctttctcttcccggaagcccaaggggatttttctttgatattcactgtgagaatctgattgagctcctggagctaaaactcacagaagtgtggggagccctctgaatttatgccaaaatacagagacctattatagtggtaatttctgttgtttgtgtcttcttcttcagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatcygtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagaggtatgtactgctttttcttggggatgatttgaagagttcttttccactgtccttgtcccatttaggagactttctggtattcggtatgtgtttcttacctctctctcaacttggcccaatacagaagaggtagtgaataaaaaaaaaaacatagatttgtatttttcattagtgttttaaaaatgaagcttaatgcttatctgagtccaaattaaagaccttttacccttgaatttttgttctttaccctcatatctgtgttttcctttagaaccacatagcatgtttacacagtagctgtgtaagtaaaatcccttattcacagaacagatagaagttatctaagggtcagntgtggtgactcatgcttgtaatcccagcactttgggaggctgaaacgggaggatcgcttgagcccaggagtttgagaccagcctgggcaacatagcaagaccccatctattttatgtaaagaaaaaaataatccaagaacagggctggtagggctggtagtcaggctggtgttttatctttgtatctaatgaactgaaactttaaaaagtaacataataacagtttttaaaatcatttgaacctactgattaaaaaactatgaatatggcaacattgctgggttgacttaataagcataggaagtcaggaataccacagaaaactatattttttaagctaaatagttgttgaaattattgcagtattgtgttcaaatttctatttcaaatgtaagcttaaaatattttcagcatgatgagaaatacatggaataatgtgcagaaaggaatatggaaccagtatgaattaaaatttgtgttttcttcaacattccataacatcactaagaaataaaaaattataaaagctacatggttaaaaagtaccatgctggccaagcgtggtggctcatgactgtagtcccagcactttgggaggctgaggtgggaggaaggctggagcccaggagtttgaggttgcagtgagctgtgatcacaattgcactacagcctggacaacagagtgagaccctgtctcaacaaaaagtacaattgtttgaaagaatgtatacatgttttttrctttttagtgaaatatattgtttttaaacattccttggtagagagaatttttttgttggataaaagggaggtatttttgttaaggatatctgggcaccctaaaaatttcatactttatgtccactcattaccgtatgggagaaaagttgctaccataaagtatgtggtttgtaggagctcctaaaataaaactcttcagttttccaccctgaagtcagcttttggtcataccagattatgtacatatgtagtgggttcatgccatacttttagaaggccagcagagggagcactactcaatgtacagtgtttactgtactgctgagaagactagtattttctatggctcagtacaaaatgaaaacaaaattaaatttcacaactcctcaaaacaaaaccaaaacaaaatttttcattttattcgtgggttcaggtttcagacatgctatttattagtgactgagcagattattttatttctgtgtacttttttgcctatatatgaagactactcaattaccctattttagagggttggtttgtttgtttgttttgcaacagggtctcactttgtcatccaggctggagtgcagtggcatgattgcagcttgctgcagcctcaacgtcccgggttcgacggattctcccacctcagcctcccgagtagttcggactacaggtgtgcgccaccacacccagctaatttttgtatgttttgtagaaatgtggtttcactatgttgcccaggctggtcttgaacccctgggctcaagtagtcctcctgctttgtcctcccaaagggctggaattacagatgtgagccaccataccccgttagagttgtgtttttagatttttaagttattatggatacatcctagttgcacatatttttgaggtagatgtgatattttgatacaagcatataatatgtaatgatcaaatcagggtaattggagtatccattgcctaaagcatttatcatttctttgtgttgggaacattccaattccactgtcataattgttttgaaatatatagtaaatgattgttaactataattgccctatagagttacgttgtcagtctacttagtggcctagcaaagaggaagaaacatagtaatttacgcaaattccaggtggaaaatagagaaagtttagagaactaaattagtgtaaaacttaaaagtatttctgactataaattctaccattaaaaacaaaaaagcacccgtgaacccacaaggataaaataatgtgtttgtccctgcccttccttgcatatcctgggtgaggctggttgatggtacattgttgtagaataattgcggaattttatttacctggaagtttgctgagaaaacaatgtctgaggtggtgtaagtttttggaaagcaaacatttgacagagttctcataattgattttcattttccaccctttattctgttaaagttctgaaatattgcataaggccatctgaaaagaaaaagaaaaagattgaaattgattttttgggggatctttgggtatactgttttgagctcatggcccaaatatgttgagctgatatccttttttacttctcttccttggtagctcataaccttacttaaaccagaaagaattaagaagcttagccttggtatttggttccctaaatgacagttgaacaattaaaatatgtcatctttgttctttatctataagggaataaaagtgttacttttggaaaggacaacaggggtttccttaaagatcctattaatataagggaaggccttttgaaagaatgggcttatcacctacaacatttcccttttattttagcatgattgctacttttttctttctaactttgtgtttaaaaaattgaatctttagaaacattgcaggaataataacaatgaactcatatacctttaacttagattcactattattgttttgacacattttgctttatctttctttgtgtttatatgtatctgtgtataattttttcccctgaaccacctgagagtatgttgcagacatcatggcactgcactccataaatatgcctctcctaagaaaatggactttctctaacatataaccataatgatcacatttgggacatttatcattgttatagtactgttatttaatatgcagttcatattagatattcaagtttcttcagttgtcccaataatgacttctgtagctatctttttaattttaactaatctaatctatgcttactcagtgtgtttggttatctctttaatccaaaagaattctttagcctattttgttttgtacaacattggcaattttgatgttgctgttttgtagaatgtccttttttttttttttgagatagggtgtcgctttgtcatccaggctggggtgcggtgcagtgatctcagctcactgtaaccttcagctcacttgacttcctggggtcaagtgattcttgtgcctcaccctcccaagtagctgggagtactaggcacgcaccaccatagctggctaatttttgtatttttagtagagatggagttttgccatgttggccaggctggtctcaractcctggcctcaaggatatctgcccgtcttggcctcccaaagtgctgggattacaggcgtaagccaccacgcccagtctgctttggatttgctttattgttttcactttccatgtgattagattgaggctaaatattttggcaggaaaattatagaagaarttttcctgcaaatatttttacaggaaattatgtttttgtaagaaaattattattgtacaataataattatataattattataactatagacaartaaattgtatatttttttcttaccataaaagtctaaactcatgaaagtagtttatatgtgctctcttaaaaatcactttatttaagctatgaaatttgattatgctgtaatgtggccaggcctgtacacttccttcattacttgttttttgtctgtctccatgtcagctccatgaagaaggagatgctgtgtgttttgcttactgtagtagccctggattctaggacagtacctggcttaagaagcttaagaattatttgttgaataaacagttttttctgaaattgatgaaataataaaaaatgactgcacattcccatrtcaagaatttgagaagttaacattttatgtttttgtttttggtctaagtacaagagacctagttttattgtgactcagtttctggaatagttgccccggatttcgagtgcttttctccttacctccaccctcccccatgttttaatgcagccctccaaaaatatttactgagtgtggactctagaccagggcctgtgctaggatacaaagatgaatgaggcaccacccttatcttcgagtagtatatgttttattttattttatttttttcccctgctgcctcccttgagtagtacatgttttagtaaggggaacagacactaaagagtcctggtaatgatgagcaaagtactgcatgagtaagtatctggggggcaagtgtccccactaggactcctgtcagatctggaaaaggcctgaggaatctgatacatgacttaatgcagcgtatacttgcagcctgaaaactaagtaatgacaaaatagacattcttgtcagtgtgagccattctctgagtccaaggggagtacataattcaaacyagaattggtcattttggagtttgcactcttagcagtatacagtggagtgaaatttaagaatcaatttaatttcttttcagtttttatgtacataaaacctgcttactacaagagacccagtttattattttgtgttggttaacattcataagtatatttcatcataataaggctccgtgaaattagtcattttatcatttgccaataaagacatatatctgaaaataaatgttcctgaacctgagcttgtgcttttttattcctcttaaagtggtgtcaatatcaaaatgccagtcaactccagtggacctgattgggtaactgtgattcccaggagaataaaaggtaaaaaaaagaataagcttgatgatttgttgtttttcttactaactgggttgaggctctgtcgtttcatttatgttgcaaaaacttatatgccatagttacttctgggcacaattgaaaatattaaaagtactgtttgattaaaaaaatcagatcttatgtgcataattctgagttttgctatttattgttattttatttttatttttttgagacagggtcttgctctgttacctaggctggagtgcagtggcgcaatctttactcactgcagccttgatctcctaggctcaattgatcctcccatctcagcctcccgagtagctgggactacaggcacacaccaccacacctggctgatttttgcattttttttttgcagagacaaatttttgccatgttgcccaggatggtcttgaattcttgagctcaagcaatcctcccaccttggcctcccaaagtgctgggattacagacatgtgcacggccgagttttgctatttaagctcatgtaaaagttttcttctcttgccagccctcttctgtttggctcctcaagagtcttttgaacaaccttgtccaatatgatagcaactagtcacttgtagtgattcaaatttaaatcaattaagattaaataaaattcaaaatctagttatttaatcacacatgcccaataactatatgtagacagcattttatgtagaatttatccatcatctcaaaaagttgtgttggacattgctgctctagagatatgggtaaaattatcatggaaatgtttaaatcatcacaaaaagttgtgttggacattgctgctctagagatatgggtaaaattatcatggaaatgtttaaaataacattgggttggagaatagcagctcttctcaaagtgtggtctgtggatcagtggcatcagcattaccaggcaacctgatagaattgcaaattctcaggtcctatctcagatgactgaaacagaaaccctggctggtggggctgagcaagaaagttttaacaaacttttcgggtgactctgatttattggtgtagaatattaatagtaaaagaacaaaattcagagcagtaaatgtaaattttgcagaatagatataattagctatcgtgatttttagaaagaagggatgaatgttactagtgaggcttatgcagatggcgggcaaggtccttctagcttttaaaagtatattaactaatagtactgcactctgcagatgttggcaaacccttttgctgcaggggcttgatatttaatacctgtggatcaagcagagtggatattagccacaagccttgtatgagtggtggggaaggaactgaagagcaaggaccatctcaaggggcagcctcttttcagtttctgctgctttgttaccatgtagaaacaaaccctgtatgcccagctccgtagatttgtttttccaagagaaaccagaaactttgattttttaactgtgatatctccatattttagaacattgacatccaattcaagactttgaaaatattgtatgggctaaataaaatctgtttggcccatatgcagccagggcactgccagtttatatctcttgtctctagtatcatatgccacaagaattcccagtcttttcctgatgaagagctgtttttgatttacttgaaccaaatgaattactaattttagaggatatatatatatatatatatatatatatatatatatatgagacatttatcttttatctgtttgggcctcaaccctgaggtcaagatgtcagtagacaaggtgtccttcagtagtactgcgctctaaacactctccatgtccgacatcttcaggaggccctgtctcccactactggatctgtccttyttctcacasactcgactggcttgcccttattgtgatgtccctaggtgtcccagggatggtcagtgggaggaactttggaaagtttacctgtacctgacaagtcttgaggattagccaggaagtggctgtgggtttatgatgtactcttctggttagagggaagatagatttggtaattagtgagccttttgatatatttttagaggaagaaagtaactatgaattagtaggagcagaatatcctggttttgaataggaaaaccatcttgttgtaacaggtatataactggaaagaaaagagaagggcaattgatttatggactatggaaggaacccagcttggcagaacttcattgaatttcactctgtggaccagcagggggcattcaaagaccctaaatcaagggctcataattttttttccttcttttgcttcattctatgcaaacattctgtttctgcttaaactttcaccaactaattttagcattcatcaaggttcatcagatcttgcctgtggcaatgatttctgtggaattctaattgtgacttttaatgtctctcattctttcaacatttattagttggaattcttttgcaaagaagagttgtcccttcttcattttaagtatytatatcagtgtagactcatgaaaatttcattccttggaatgaaggaaaaaaaattataatccaatccaattcaatcattattttatttgcttttatttttgctcaaattgttccagttttggcagttggggaacactttcagtttggcttctttgtgcccttttgtcatcctgtgtgctgtcatccttttgtttgttttgagcacttccttagtttctggcaccacaagatatttgaggcttgtcttgtattttctttgccttagccttagaaggggtttayagtatttctacttttatttcacttatgaatcctatattttgaagttttttccctgtgaaattgtatttatgtattagctaattaatattcttacaaggtaaaactattgttaagattcatatttagattgcctgagattggcagtgctactgctacttgtgggcataattccagtcaaaagcaaggaaaaacagtttttagttctagctgactacctttttaagagcaagcatctggtttatgtcaggttttcccagtgccagaattactgctgagttttcattagtacctgtaatgtagtccccagattatcacagctgagtggctcagggaccttgacagattctgacctcatcaacaacttgaggttatattttttgggggaacttactgagagtttagaataagacttgatctaatagcaacagtatagataagaacaatgaagttttacatttgtgtgtatctttgtagctatggcaggttgaatactaagatgacttccagtgatctatgctcttacataatctccttccccttgagttgtggcagcgacatgtaaatatgatggtatataattcctatgatttgattatgttatatgacaaagttgactttaagagagtggcattatcctaggtagacctgaccttagatcagataagcccttaacaggggccatgttcttcctgaagaaattcaaagtgtaagaaggattccatgtgagggagattctttgttgttggttttaaagatgaagggggccacatggctaggaatataggcaacttctagtagctggagagcatctcctggctgataaccatcaaggaaatgggaaactcagtcttacaaccacaagtaactgaattctggcagcaacttgaatgaacttttttttttgtttttttttgtttgtttgtttttgagacagagtcttgctctgttgcccaggctggagtgcagtggtgcgatcctggctcactgcaaacctctgcctcctgtgttcaagsgattctcgtgcctcagcctcccaagtacctgggattacagccacacctggctaatttttctgtttttagtagagacggggttttcactgtgttggccaggctggtctcgaactcctgagctcaagcgatctacccaccttgccctcccaaagtgctgggattacatgcgtgagccacgcgcccggccttgaatgacctttttgaaggcttttctccagagaacacagccctgataatagcctgattcaacttgtgagactctgaggagagaacagagttatgcgatgtcccaaactcctgacctgcaggtctgtgggttaataaatgtctcttgtttttaagctactaagtttgtggtgatgtgttacacagcaatagaaaactaataaaataactaccatctagatcaagttattgaacatttagaacatataggatgtttccaggaccctagcatgcgctttactattcacactattacagtattgaattttcacaataacccttcaaaataactagtagttgacccattttatagatgatgtgaccaaagtccagagatttcacttattgtgtcatcgttttgagtccttctttgttagactctgagggtatagttagggaataagatgaaaatttaaatgatttctgaagtctcaagagttggaaatgtggagtcagacttagagtaggtcccgtgactcttcatctagcattttccctactgccccttaaccatgtttaggaggtatggccaatgatgtcttgatgctttggtttgcctgcagtagttaattttttttttttttttttttttttgagaaggtgtctcgctctgtcgcccaggctggagtgcagtagtgtgatctcggctcattaaaacttctgcctcctgggttcaagcaattcttctgcctcagcttcccaagtagctaccattgcaggcacaatgccaccatgcctggctaatttttgtatttttagtaaagatgtggttttgtatgttggccagcctggtctgaaactcctgacctcaagtgatccgcctgccttggcttcctaaagtgttgggattacaggtgtgagccaccactgtacctggcctgcagtagtgaaatttatcaaccttctagtatacaaatgatgaagtgaatgatagtgtttcatgttatgcagtaaaaacgaaactagtcattttgtggatgagacctcatctgatgttgatttctagaaaatggcagataaatgttataacaaatgggacaaagctattttatttttaaaaaatttaattatctggatgcagatgtcaaagggacaaagctattttaaagacaactactttccaattactggaaagaataatttgatacagaatatctttaatttcgttaaccgggaaaatcaaagggcccatgttctgcatataaaactactaactgatagcatttgagggaaggaagcctcctcaatatatcagcaaaatgtatttctttgtaagtggtaccacctctaccactacctgcctctacgcttattgagaaactttgccaagtcactctgtgacttgctttcttcatctttaaaaggtatttcgacggccrggcgcagtggctcatgcctgtaatcccaggactttgggaggccgaggcgggtgggtcatgaggtcaggagatgagaccattctggctaacamggtgaaaccccatctctactaaaaatgcaaaaaactagccgggcgtggtggcaggcgcctgtagtcccagctactcaggaggctgaggcaggagaatggcgtgaacccgggaggcggaggttgcagtgagccgagattgcgccactgcactccagtctgggtgacagagtgagactccgtctcaaaaaaaaaaaaaaaaaaaaaaaaaaagatatttggactagctactctctaaggtcccattcaacagtctatgaatttatagaatttctatctatatagcattcttagcttacctctgtaaactgcagaggttttaggggactaaaatatataggaaagaaaattaaatttccaaggtttcatagggggaattcaaggagtaaactcaaactcaagccattacaattactgtgtagctgggcccttctcatattcccagcacttgacagagtgttcctaaccagctcaatatacactatcctcattcctcatcctgctgagggctgtccctccctactgaccttatcccaagcttcctatgctcatggcagtctctggtgcagggaattggttgatcccatttcttctgtcttgttttcccccttataaactgtgtactcccctttgtcctgccttttactgttcttaattctgcagacaattccataccataaaattaatggacaggtttgctgcacatctcaccccgcagccctccctgccccgccccacctcaattcacgttgtgtccttttygtccaactctttctggatgatttagggaaatttatctctctgcctttttctctttcgttttgttccatctttggcccagacagccctcattatggctaatggattacatggcgtgacaccctttggaggaaaatgcaaaccatgggctttaaagagaagccaagaaattttagagatgcagggacattactttcaaataataaaaaatatccyttctggttttgcccaaatcttcatatctgcttttacaaccacctctgtttaaacttcttccttcaccagcaattttcaagataaccataaagttgagtaataactcatttttattttttgttttaattatttttattccatgtgaatagtacattaggggttatattatctatttaggagactttcatatctcagttatcttacatgaactgcattgtgagttccaagaaacaccatttaaacagccacagacttcttaaaaatcatattaaaattgtcaggaaatgtttttgtcccagttgaccataagggggcaacataggtatgtgcatttcatttaaaaaatatgatttttttctcatgtagcatgcagcatgtttaaagaattaatgtcagatttagtaattgatttgctttccttagctctggtagtaaatataattaacatttgaatggaaatggtaattgtttcctgtgtgacatatacttttctttataacacatatttgacacagaataaccgagtctaccgaattaacagtggtaaaaaattgtaacatcaaaataacttttaattctcattctagtaaatgttttctgtgggccctaggtgtcgtctctggagctctctaactatgcagcctcgatgtactgatataatgagggagctttgcacaaggtgcagtaacatattaaagctacacttgataacatgttgagaaattatttttgaacaagcctaggaaatgtttaccctacatgcccccgacaatttttctttgataatcgcatttgccaaataaagcttttaaaatcagcgttcagtttccttttctacttgggctctgaacctgcaaagaattagcagatgccgaagaaaaaaagattagatatgcactctgtgtcaaatagaacatcatctttggagggataaaaaccaaaataatttggagtaacacagataatgtcaagtcaaataagctaaaagtagtcacaaataggggagtcacttaaatttaaatttctgagttgtgtaagcatttagagtccaaattgtggcttaataggtgactatagaatgactggactttgataaaggttgtgtaagaaaatgatataacctggtggtttcttgaagattgtaggtttgaataattgttagaaatgaataaatatataccttcaagaaaaaaaaaaagaaatggttaacatctataaacatctgtttttgagaagtgatctagcacacagtggttaagatcaygggctttgggctcacttgcttgggccaggtgctggctttgctccttactagctcagctctgggaccttggtcaagttgtttagctgttctgaaaggtagggatagtgataggacctacttcaaagagttactgtgagcatatgagataatacgtttgctcagaatagtgtctgaggcagagtaaacttgcaagaaatattagccatcacagtctgttttgaagcatgtaacgtgtggcattttctacaggaggtgttagggcagaaggatgttgactttccctctgaaaggtcgttttgcttgtgttatcaagtgtaactaggttasaaccaggaggtacacattggtgatgtatttttagcattgttcattatatataaagactttctgaaccttttgtataatggagaataatccgttagattgtctgccattagtttgttctccatattaagtggtgtttttttggaattaaaattaaaatttgaagatgggattcatggattctaactttgcttttaatgggctgaaaacagtgaactaatactactctgtatgtgtaaagtattagtctaagttgttacttgcctcgcaggcatgtgggtgagaaactgttctcttctgggagantgctggataaatgcttatgtccacacatttcctttggttttgtcttcctttatatttggctttgataaaaacatatgtaatcaggctgggcatggtggctcacgcctgtaattctagcactttgggaggtcgaggcgggcggatcacttgagatcagragtttgagatcagcctggccaacatagtgaaaccccatctgtactaaaagtgcaaaaattggccaggcgtggtggctcacgcctgtaatcccagcactttgggaggccgaggtgggtgatcacaacgtcaagagattgagaccatcttggccaacgtgatgaaaccctatctctactaaaaatacaaaaattaactgggtgtggtggtacacgcctgtactcccagctactcgggaggctgaggcaggagaatcgcttgaacccaggaggcagaggttgcagtgagctgagatcatgccactgcactccagcctggcgacagagygagactctgtctcggaaaaaaaaaaagcaaaacttagccaggcatggtaatgcgtgcctgtaatcccagttacttgggaggctgaggcaggagaatcacttgaacccaggaggcggaggttgcagtgagccgagattgtgccactgcactccagcctgggcaaaaagagtgagactccatctcaaaaaaaatgtaagcagagggaatgctgaaagtccctcctttcctttctgtccaccaataccttcatgcccatttcagatcttcccatttttgtacaaaggaaaaccttttttttttttaattttacttttaagttctgggatacatgtgcagaatgtgcaggtttattacataggtatacatgtagtttgctgcacctstcaacccatcatctaggttttaagccttgtatttgtcctaatgctctccctccccttccccccaaccccccgacaggccacggtgtgtgatgttcctctccctgtgtccatgtgttctcattgttcaactcctacttaygagtgagaacatgtggtgtttggttttctgttcctgtgttagtttgctgagaatgatgacttccagcttcatccatgtccctgcaaaggacatgaactcattcttttttatggctgtggaaaacctttttttaatcaggagaaaagtctgggatttgaggtctgacagcaggaaatgtttcccacatgctatcaggctaacaaatacatgggcataattgtttcttgggacatttttcatctatkgttggaggagaatattaaaatatttgtttttcttttttctttgcagaaactaacagtctagaactatctcaaggstcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccaggttggtactgtgccttttgtttcgtaactctttcccacatcagctttgaaataagcagactcactcargtgcctgaagaaaggttatcaggtgaggaaacatatatttctgtgtaggactaaagaggtacccaaaccctggagagatgtgtgacagtttctgatcaatagctgtgttgtgttgtactcatggaagcactgggttctcattgaggtttatgtcactgatgagctgtatgactttggacaagtcatttactttttagggcttcatttctccatgtgtgagatgagacagctggaccatgtcacttcacaggtgtctttcccttctaatattctgggttgtaaaatagaggtgggcatttccagttgtttctcccctagttctgtctcatccaactccaagtttatagtagctttgagtagaaggaagcagccagacctatggtagtccatattgcatccttgcagcaaagccatccctgtgtcatccattgggcctaccattggtgtgactctgagatggagttggctcctcctgagggagtctgggtaagttccagcattcttagcttcttgatttctctgcttggctctggggctgttctccagactcagaacaaaaccccagtggttggaggcccaccccttcttcacaagggcattcttttctttctggaaggggtatggatgaggtaaggaaggagggatcctgaaggagcagaaataaagaccctgcttacaatttagagagctgatagttttgtgggaactgtttttaatggccatgtgtgggcaaggcttttaataaagtaaagcctgatggtttgttgtgagttgtttgtgattgtttttatcagcctttttatttattatgtcaacttagttttattgattgattgattgagatgaggtctcactctctcacccaggctggagtgcaatggtgtgatcatggctcactgcagcctcaacctcctgggctcaagcgatcctcccacctcagcctcccaagcatttgggaccacaggcgtgagccactgcactcagctaatttttttgtattttttgtagagacatggtctcactgtgttgctcaggctagtctcgaattctcatgctcaagcagtccgcccgcctcaacctcccaaagtgctgatggctcacacctggcctcaacttagttttaaatttaatttttagaaggaaaggggaagtagatattgtccccaaaagtgtaaagtcagttccactttttgttttgcttgttttttaaattgaaacagatataactaagctttgtttgataaagtataatttgtacattaggagaagggaaatactttgtatggcttgatgctagacaaggtttgatgtgatgctgaccagtgagggccttcctaggtgtctgtagttgcttgcttcttaaattctaatgatgtagcttggtatttcctttgatyycaaggatcacactgactgttttcatcacgtcccaccatatactttacagacatatcttcacctgataaaaataaagcctgtgtcagtgcttgatctaatcaaaagaaagtggtagcttgagattttattcagttaaaatggggctaaatgctaagtagtagttaggtaggaaaatctagaagagaaacctggaaatgcaaggagaaaaaaatgaaacctactttaacccttaagaatatatgacaatttatatatatatatatatatatatatatatttttttttttttwtwttktttttttttttttgagatggtgtctcactctgtcacccaggctggagtgcagtggtgtgatctctactcactaaaacctctgcctcgcaggttcatgtgattctcctgcctcagcctcccaagtagctgagattacaggcacctgccaccatgcctggctaatttttgtatttttagtagagacgggtttcaccgtgttggccaggctggtctcaaacttctgacctcaagtgagctgcttgctttgccctcccaaagtgctgggattatgggcatgagccaccttgcccatcctataggacaattatattctgatgttactttttcaaaattgaccgtgaactcactgagggcaaggactatatagcttatccatctgagcattgctggcttgtagcacctatagtagtgggcactaagtaggtgctaaggaaatattagttaaattggattgtcaacatttacttaaggcacttaagggaatatttagggatatgagacacatcttctttcctcatgggtgcacgtactaagtgatgaattatacagagttttttaggaataacaaggactgccactgattcctgggaccttcagaatgtctccaggcaactggaccttgaaatacaacttagagggagaaaagggaatttttaatttgcgatgctatctgtgttattctcatgatagagatggaagtttttctgtaggacattaacatgatttttcatctacagggtaaaattgaaagtcaaaagaaacagggttgcttctttcttttgcttattgcaaaaagaggtgtttgttttcatttttcaaaattacatttgaacttgccttaattttatttttaaaaacattcatttttaatcaacagataagtatatttatggggtacaatgtgatattttatatatatacattgtggaattagtacatcaagtaaattaacatatccatcacctcacatacttacttttttatagtgagaatatttaaaatctcttcttttagcagttttgaaatatatgatacatgattatttactatggttaccatgttgtgcaatagatgtctaaaacattttccttctgagaccttgattaatatttccccattgcacctacccgtctagcagccctctggtaaccactattctactctctacttcaacttttttaagttccacatataagtcagtataaggcaaatattgcatgaggttccacatcaaagacatctgtgtgtggctbatttcacttagcataatgtcctctagtttcatccatgttgttacaaatgacggaatttccccaaagaagtatttggttgctgatatgtgctcataaaacagaagttaaagcccatgtcttgagagaaataatatttatctgttaggagaataaaatgtaaatgccaatttgatttttataatttaaattatcataaacagacacttctcaaaagaagacatacatacagccaacaaacatatgaagaaaaagctcaatatcactgatcattagagcaatgcaaatcaaaaccacaatgaaattgtggttctcacaccaatcagaatggctattattaaaaagccaaaaaacaacagatactggcaaggttgcagagaaaaggtaacaattatacactgttggtggaagtgtaaattaattcgatcattgtggaaagcagtatggtgattcctcaaagagctaaaagcagaactaccattcgacccagcaatcccattactgggtatatacccagaggaatataaatcattctgccataaagacacatgcaagsaaatgttcattgcagcgctgttcacgacagcaaagacgtggaatcaacctaaatgcccatcagtgacagactggataaagaaaatgtggtacatatgtaccatggaatactatgcagccataaaattgagataatatcttttgtgggagcatggatggagctggaggctattatctttagcaaactaacacaggaacagaaaaccaaatattgcatgttctcacttataagcgggagctaaatgataagaacttatgaacacacagaaggaaacagtagacactggggtctacttgagtgggggagttgggaggaaggagaggagcagacaaggtaactattgggtactgggcttaaaacctgggtgatgaaataatatgtgacacattttcctatgtaacaaacctttacgtgcactcccaaacctaaaataaaagtaaaaaaacccaaactttttagacatagataaaaaagattgcaatgatcagtgcaaatagcaacatttcttggcctaataattagagaaaaatgggttattttgtttttcaggcatagacaggtgtagtgtagagtctatcactgatggtgttatttataatgaatgttatgtttatgtaataatttaaataataaacatgttagaataaaggcccattgatacaaaagggggcagagttcagtgaaataggtattccctttacatttatattgtacctttttgttgtacttaaaaaaaaattgttatttgaagccacttaataaggtataatcaaaatatatgtgcttggtttgaaggtttttatgaacttgagttttccttgtttcagatttagtggagtttaacttgggtagtcccaagaatgtgggtcccttccttgcagtggaccagaagcacaacatcctgctcaaataccgctgccatggtccacccatccgcttcacgactgtctttagcaatgagctccaktatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacrgccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgrtattataaagctgtggaagttttttccactagtttcaggtgtttttttttttkttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctctaaaaaaaaaaaaaaaaaaaaaagagggaccatgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttaaactcctgagcycaagcatctgcccacctcagcttcccaaagtgctgggattacaggtgtgagccactgtgcccagctgagagtttttcttgtcntgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaawtttttttttaacaacttttaagttcaggggtacatgtgccagtttgtttcataggtaaacttacgtcatgggggtttgttgtatagatgatttcatcacccaggtgttaagcctagtacccattagtaatttttcctgatcctctccctcctcctaccctccaccctccaatagaccccagtgtgtgttgttgccctttatgtgtccatgtgttctcatcatttagctctcacttatcagtgagaacaactttcatcccacatctaatttgtctttcttcactctggtgtggaaattttgatagagattccaatatcacttaaacgtttcccagaatatttagatagaataatttagtttcttctgaaaagtttattttaggctagtgccacatggttgtgaatattagcatggtagccaaataatagtttgtttaaatgtatatttcccaatataaatataaggggcatcataatttttaaaaactataaaatctagaagaaaaatctatggataaaatccataattctatcatctgaatgcaatgaacattagcatttaggtatattttcttgcaggttttttaaccatatacttatagagaatatgtaatttgggtctgtgttttttacatataaatatttttctatgttaaatagtcttcataagttaattataaagatctgcttaatagttctgctactgcagttttcattattagataagttggtcattatagttggacatttaggtttacaatattaaagcagtggtttatatcaatttcagtggtttaaaatatgaatttctattttggaatgaaagtattaatttaatgtagtgaatctcatattccagaactgagatgattgatttgatgctatttgtgacagacagaacccataataaagcctttctatgcaagttacattttatagaattatcctactaaaagtaacctttcttcagcgaatgcaaaacagacctttggtgttccagtatgattcattttgccattctgaacaactatcattttaattaagaccatttaactgacacttcctggattcagttattaagtttcagattgaaacttgatccagtttaataactgaatccagtttcacatttatcaatctgaaaacttagtttgcagattggtaaatcagggtacttgacaagaataaatatggtacgcctttatatattcatgtgttacatgccagaaatgagtctgtttctggaccctgttcaaggaaatagtgatgactgagagaggtacagggaaataaacacccaagggaaacaacagaaataagcctccccaactttctaaaaaactgctcagcattatctctgtggattctgggtaaattcagctttttaacatcagctagtcactaatgccagaaattccacttcaagtgtatttattttcttgtgttaagcattattctacctggtttatgtctacaatgtagtattagtgtacttaggattcttgacacctcagtgtgcaataaataaaattttgaagttgttgtttttcatttgaaggtgagaccacagcccctgagtgctaaggggacctgggaatcctaggggaatggaggtggtggacgataagaggatggttgagggcaggagtttaaaggacacagaagctaggagagcagaaaatgtactccaccaccttctgtctaacttgtctcttaaaagtgcttttacattttaacttttttaaaaaatgtgggccgggcatagtggctcatgcctgtaatcccagcactttgggaggccgaggtgggcggatcacctgaggtcaagagttcaagaccagcctgaccaatatgatgaaaccccatctctactaaaaatacaaaaatagccaggtgtggtggcacatgcctgtcatcccagctactcaggaggctgaggtgggagaatcgcttgaacccgggaggtggaggttgcagtgagccgagatcatgccattgcactctagcctgggcaacgagagtgaaactctgtctcaataaataaataaataaataaaaaataaaaaagtgtgaacttaaatatatttatatgtgtgtacatatattttcttttttaatattctggttaaatgagaggccatcgggcctctttttaagagtctaatgatgtgtatatctaatgcccattccagctggattgtaacactgcttggggaagataacttaaaaaaaagtagtaccgagattacagcagctagtgtcctaaatggaaaagaagtgaaactaaatgtcataggagaaatcctttcagttttgtgcagtggttcatttgctgttaaatctaccccattaccattccccttactccttgaaaataaagtgatcttcatgttacaggaccattgctttatttatgtcacagatttcttgtcctttaattagtcagtgaaggcacatgattgcgatactactttttgattgccgtattgtaaaagctatatggtaaaaggtaactccctccacccgcccactgcaccctcacgtttaggggccacacagaaaaagcgaaataagatgaggtgaatctaatgagaaggcaactctaatgcccatcaggagattcactaggacattttaaaaggacgtctttaaggaaaaagttttgtttgtagatgttgcctctgattcctccctgcggctccagtccaggtcttggagccggccctcgaggggaatgtccgggactcgggtcggtacctttttggtctgggaatttccagtgtgcagaaaaaaaatccacaaatctaggcctcgctgccccctccctgcctcctctggccctcctcagtgcccacgcaacccggttcgaaagagaggatgaccgtattctgcattttagaaaacaggctcttagcttcccccgcccccgtcctcactagagtggagaactgaaagcgaacgctataaagggcgccagtgagaggggctggcctcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggtatatttttattatctgatattttattaaaatatcttaaatggtaagattttttttttctttttctttcctattcccatagtcagattcttaactttggagtcactctcttatgtttgagtagccatacttgctttggggcaaaatattgggggatagttttttggagaaagaaaatctgggatgtttttgtagtttagtaatagcaagaatcatgtctgtttgctttaaaggcccaggaaggactgagatactaatggaggagatcgatagaatgggtgatgaagtatcataaatctaatgtaacactatcttctgtcagtgacctagaactatgatatcccgaggcagaagtctcccaggagatttgatgtgtgggtttagaggagtactttcccaccaaccgtaggcatgaaactatatgggaaaatatatcagagtaaattgaaatactttatagcatgccctcattcattcttacagctgtaaaattaaaatgtatgaatggccattttatgaatgaggaaaacctgaaatttgatgatttggctggacccccagattcatgataatctgtatatgttaaggggttttgtttgaataaaagcacatttctaaatagaatggattagagattctcttcattgggattagtgaattcgctgcagtggctgaaggtgctgtcccaaagaggatgacagttacgtaaattttaagcatttggtaatatatatttcctctatttaaatctgacatctaaagaaatatctggctgggtggaatatttttttgcttctgttagacagtaggttgtttagacaataaaaggagagaaaagtttatcctagtctcattcaccaccccgcataatccctgatggagcagggcatcagccacacagatcatctaaacaggcagataaccctgcctgtttatttatttggcctcagaatacggtgtatggtccaccacccctctccaccgtctttctaacatcatcctgctgaggccaaagacacagttgggcagggtacaggcgtggagcactgcggtggcagagtcagtctgagaggagttagcacatgacatcagtgcacagtgcagatgacggaaacatttggcagcatcctctccagtgtggaggtgatgaccgaggtcagcataatccagctgttcagatacagacttttcctcactgaggaagaggaggcaaacccttctctttcttgtcctgtaacagacaagacaagaaagctctcagagagcaaaacaaaccctttcagaagctacagagccatggaaagcattactgaggggaaagattttctaattgttctgagaccaataatgaattgctcctgaaaacaccattttcttttggctcatagctgacactgatctggaggcctcttgatttttttctcccaggttaacaggaagatctcgagggccctggctgaacttcaccttttggctttcttggcctgatgctgaactctcgagggtgagaagggctgatatttctaaacaagtagcatccaggtgttacctagcttctggctgatgtcaaaaagggcagtgggatttttctaagatttttctcttaaattagacatttttttgaagttgctacaaaattactatgaattttatttataggcattttactgtgatttcatgagaactaagattttttgtgtgtgtgtgtgtgtgtgtggtttagtagtatttttttaaaccaatttgttgaatttctgctattttccatagcaagaggacatatgaatacatctaagaggggaattcagctctctgcttactgacagtttcagggttatgtaatctttaacaggcttggagagcatcatgccccctctcagttttggtgaagaggctccttaaaactagcatatgtggtttctgattaaagcactttctgttcctttaatttgggattgtctgtgaagtaaaataccttcctttcaaccgtagggaatgaaaatatttactgccgctgatggagttagtggattgggaattaacacttattaaacacttgttttgggagcttaccagcaagatctcatttagccctacagcattttttaggtagctgtaattagctttattttatttatttatttttgtaacttcaacttttattttagattcagggggtgcatgtataggtttgttacctgggtgtattgcgtgatgttgaggtttggggtacaactgatcccatcacccaggtactgatcatagttatttttcagcccttgctttcctccctctctcccccatctagcagtcctcagtgtctttgttgccatctttatgtccttgagtatccaatgtttagctcccacttaaaaatgagaacatgtggtatttggttttctgttcctgtgttaattcacttgggataatggcctccagctgcatccatgttgctgcaaaggacatgattctattcttttttatggctgtgtagatttccacagtgtatacgtaccacatttcctttatctagtccactgttgatgggcatctaggttgattccatgtctttgctattgtaagtaagtgctgcagtgaacatacaggtgcatgtgtctttttgatagaatgggaaatataaccacgacaaatggtgaattctgtcatggttatattaaacaataatcacaatgctacattctctatacatgataccaaatatctgaattaaacttatcaaaatactgttaattacctagatgttatatctataaaatgccaacctccagatatttggagacattaaaaatgattttttcactgtttgttcagatatttagcaacatgcaggcacttttaatattggtagaagacttttggatatgttttagcattgagtagtttatgtgcatccccattcctctgattgtttcagtcaagtttgctagacagcctagtactgtgaatctgtagagggtctaatactgtaaatcatgcgttcttagagagggtgatattatctccaagagggcaaaaataggttcttcagggaaaaatcttagctattacaatagtttgtggcccccaaagggccatagtacataatagatatacagtatatctgtgatattaaactttcatcaggggatgattaggaaaaagatgtctaaaaagaccctgtagtggggtctaatactgaaagaaaggttgagacatgtcattgtaaatgctctggatgtacttattcaactgaggtcaaaagatttttctgtggtttgttgtctttttgtgtcttgctttgtgtctacatcctcatttttcatggattttaaaagtactggtttccagagggggaacaacgtttttagtttcttttcttttctcttttctcctcctcctcctttttctccttctccttcttctcctccttctcctctttttctttttcctctctctctcctttctttttttttgatacagaatctccctctgtcgcccatggttggagtgcagtagccccttcttggctcactgcaaactccgccttccgagtttaagtgattctcatgcctcaacctcctgagtagctgggactacaggcacatgccaccacgcccaactaatttttgtatttttagtagagtggagtttcaccatgtttgccaggctagtcttgaactcctgacctcaagtgatccatctgcctcagcctcccaaagttttgctttttttttgagacagagttttgctctcccacccaagctggagtgcagtggcatggtggcatgatcatagctcactgtgtcctctaccttctgggc

SEQ ID NO: 10622 - DNA, 19656 bp, Homo sapiens
  misc_feature (1)...(19656): n = A,T,C or G, or insertion/deletion polymorphism (see Tables 1-2)
tattatacttttagctgtttcatatttaggtatttgatccattgagttaatttttgactgcagaatgaggtaggggtccaagttcgttcttttgcatgttgatatccagttgtcccaatatcacttattgaagaagttatttccctcgttgaatagtcttggtatctgttgaaaatcaattgaccatagacatatgggtttattaaattaaaattatatttcatttgtctatatgtgtatacttatgccaatatcacactgtcttcattctgtaacttttttttttttttttttttttttttttttttttttgggagagnnnnnnnnnnnnnnnnnnnntttttttttttttctgagacggagtctcgctctgtcgcccaggccggactgcggactgcagtggcgcaatctcggctcactgcaagctccgcttcccgggttcacaccattctcctgcctcagcctcccgagtagctgggactacaggcgcccgccaccgcgcccggctaattttttgtatttttagtagagacggggtttcgccttgttagccaggatggtctcgatctcctgacctcatgatccacccgcctcagcctcccaaagtgctgggattacaggcgtgagccaccgcgcccggcccattctgtaactttgtagtaagttttgaaactgcaaagtgtgattcctctaactttgatcttctttttcaagattgctttgaggtcaggtgtggtggcacacactgtaatctcagcacttggggaagctgaggtgagtggatcatctgaggtcaggagttcaagaccagcctggccaacatggtgaaaccccatctctactacaaatacaaaaattagccaggcggtaatggcgtgcgcctgtaatcccagctacttgggaggctgaggcaggataatcacttgagcctgggaggtggagattgcagtgagctgagattgcaccactgtactccagtctttgtgacagagtgagactctgactcaaaaaataaaataaaacgattgctttggctattctgagtcacttgcatttctatataaattttagaatcagcttgtcaacttctgcaaaaaggcagctgggattttgataggcatttcattgaatctgtatattaatttggggattattgccatgttaacaatattaagtcttccaacccatcagtacaggatatctttccatttatttaggtcttctttaatttctttcaatgatgttttacaattttcagtgtatgtgatacttcttttgataaatttttttctgtgtattttattatttttgatgccttaggaattgtttttctaatttcattttcatagtatctattgccaatgtatagaaattgaactgatgtttgcatattgatcttgtatcctaccacttggctaaatttgtttttaaattccaatagttttgtgtgtggattccttgaaattttttatacacaaaattacattattggcaagtagagatagttttacttctttccaatctggatcccttctattttgttttcttgcctaattgccctggctagagccttcagtacaatgttgaatagaaatggtgagaacaggcacttttgtcttgtttcaaactcaggatgaaagttttcagtctttcaccactaagtatgatgttagctgtggggggttttgcagatgacctttatcagttggttaacttttccttcattcctagtttattgagtgtatttgcattcaagaaatatttattgagcacctactatgtgtcaggcattgttctaagtgctggagacacagcaatgaacaaaatagaagatagcatgataatggcagagaaagaccttaaacacaaactatgtcaagtggtgagacatatggctcacatgtgtgtgtgtgtgtgtgcacacgtattttaagtgtactggacacagtgactcatatctataatcccaggattttgggaggccaaggcaggattgcttgaggccaggaatttgagaccagcataagcaacatgtgagaccccatctctatagaaataaatagccaggcatggtggtgcacacctgtagtcccagctacttgggaggctgaggcaagaggatagcttaagcccaagaggtcaaggcggcagtgagctatgatcatgccactgcattccagcctgggtgacagagcaagtccccgtctcaaaaagtgtgcacatgcacacataaatatggacaaccactggaaagatacacaagacatgagtgacagcaattgactctgaggtagacacagtggctgcagctggcgtgagagggaggctccctggtgattcttcaccctcctttggcaacttttgaatctgataccactaaatgttgtatcagtccattctcacattgctataaagaactacctgagactgggtagtttataaagaaaagaggtttaattgactcacagttgcacaggctgtataggagtcatggctggggaggcctcaggaaactttacaatcttggtggaaagcgaagcaagcacatcttcatatggtgacaggagagacagagagagacagagagagagaaggtgcttgtgaaggggcaggtgctacacacttttttttctttttctttttttttttgagagatagggtcttgctctgccacccaggctagagtgcaggggctcaatcttggctcactgcaacctccacctcccaggttcagcctcccaaatagctgggattacaggcatgtgccaccacaccgggctaatttttttatatttttagtagagactgggttttgccatgttggccaggctggcctcccaaagtgctgggattacaggtatgagccactgcacctggccaaagaaagtttttttgttttgttttgtttttttgttttttttgagacagggtctcactctgttgcccagactggagtgaagtggtgcaatctcagctcactgcagctctgactttccaggctcaagcaattctcccacctcagcctccacagtagctgggactttaggcatgagctaccatgcctgcctaatttttgtatattttgtagagacggggtttcaccatgttgcccaggctggtcttgaactcctgggctcaagtgatctgcccacctcagcctcccaagtgctaggattacaggcttgagccaccatacccagtttgtgctacacactttaaacaaccggatcttgtgagaacgcaccctcacgagaactgcaagggggaaatccacccccttgatccaatcacctcctaccaggtccctcccccaacattgggaattacaattcaacacgagatttaggtggggacacagagccaaaccatatcaaatgtatgagctagtccaaaaagatacttttaaaacaatgttcgcttttactaaagattcagaaatacaaaggtaccaaaccaaaagaaaggcttttgttcacccaggcatcaaggccacaggtgagacctggaagctgctggggagcatctcacactgtgccacagtcttctggagggccaagtagctattggagaagaagatgctttggcttttggtccaatggttaattttgcaggaaaaacaaaagggtgggaaagctgtgttaaatcacccatagatgtgatgttaggagaaagtcaggcagcataggggttaacagtacaaaatccaagtcaatcaacccagacttgaatcctggctccaccagtagccattctgggcccctgttctttcatctgcagatgggacaaaggttaaatgagctgctatatggcagcatccagtccaatgctcgggacacaggtgtagctgttattagaaacaggtgaattaccccaaagttaaatggcatcagaccttcttcaggaaagagaattccagggtcagctctaggtcatccccctccagttctctttccagcatggtgagtggtcatgattcagcacgaaggcttccagagacccttgacacacatccgtatattcaatactctcccttcacaaaggcaaggaagttcccatccaaatctttaggtaacacatttcagcacttaaatcttaagcatttaattattctgagccaccacttaaccagagtaattctcaaattggcagaaaaacttcatgaggggagaggaggaacgaggaagaggtgatgttattttggtttgttttttcccgccctctctctgtcttgtttctaggagaaaaacaagtggacatgttccaagactcccagcagtgggaggggcgtcagattagtgcacaaatgtctgctttaaccgtaatgtagaggaaatacaaggaacttgcattaaataaaagatgcccacaacactaccagacatacagtaagtggtaacgagttctgagggccagcctggctgacacatcccaattttgcatttgaggggaaaagtactgttctctgagggacaagagtgaaaccaggaggggaccagaacatagctctactttcccagggtagcattgaggggagaggttggccaatagtgggcgtgagagatcacagctggaggagatttaggggattaaggaggtgcggtgctgatataattactcaggtagccttgaagagttgcttcaaagaatggagagcctccctccccagcacctgtaggcattcatagtacccctctatttctgagtggtaggaaatttccataattaatagttgagagagagagagagagagaatacgaaagaagggtgaggagctgtctccagcaggtgaccctgcgagagggaaggatgaggagtgaatagagaggttggcagaaggcacccccgtctccctcctgactctccctacttaggaagccagaggagacacacaggaggaggccacagttctcacagcccccaaagggaaaacacagttaccctccacaacaccaggaagtgacccgaagcgctgaaatcagctacccgagtagtgaaacctaagtcatggttgctgttctgcccccagaaggggagcagtcaccagttgttcatcgcgacagagcagatacactcaaaccccggtgccctgtgccaagacgtgcccacttcacctgcacaccctccttgaccatccggcacgcggccctggggcttgatgaagccctgcacccaaagtccctggcagagggatgagtcacgaacttgggccctggcagcagagggctgggtcggccaaggccagatggagcttgatttgcaatttcatcagcctgttccgctctgaggaaaggcacgatgtgatcttggtgttgtctaattcacaggctcgccctgttcttaaaggtgaaattgcactgtttgctaattcttctagtcccccagagaactggagctcagagggattgttctgacgctgtaagagtaaggaaaatgaggtttcgaaaatcaaagctgaatacaggctatcccagaggagtctgcagagcgcagcctcgggaggccccggccaagaggccttggcctcccggtcccaacctggcgcgccgtcagaggtgctgtcccagcccgggcgctggcggtccacgcaccgctcctacctcgggaggacatccgaagggtcacggccgctggacatgctgtcttttgcaaccccggccccagcaggccctttacagtgaggggtctcccgcaagagagggcaagaaccatcctaagccccgctcgcggagggcgggaaaaggggaagacggctaggttggtcctgcccaccggaaagtcggaagagtaagagtagcaagaagccttggggctgcaggtgggacctcagggagccgtgtctactaggaggacgcgtggacacgtccctcctggagtttcgatttaaaatgcgcccgaatgaggtagcgccgctctcactaggagcaaaagatccgtccacgtcggttccagaaacctcgtgtcccccaagcctgcccgcccgcctcacctgccaggcggctgaactcgcgcgcccgcagctcgcgcaggctgcccgggccgtagccgtaggctagccgcggtgcgctcgggtcccgggaacccgcgaaggtccacagctcccgccctgactccgcygccgcgccggccatggccccggctagtccatccaggcyggccgggcccgggaagtgmgcgaagccggcccccggcgactccgcccccrccacgcctcccaggcctccagcctcccagtctctcggaatccgcagcctaggtgtggcgccccgaccggactttcacttctggccagccctttccccacctgggcgcgggagcgggtgccagtctttaaacaacctctcgatgggtcccacgaagatgtttccagacccttggaatgccaagttcaagtttagctatgtctcgcggagaggccggtggaagaagcaacgaggtgatctttcctgcttggcatcggcatcctggaaccccgcgaccctcctcctcgcaggggtctcgggaccctcaccctctcaagcgggaaccggcgtctggcgggggcgggggtgggggcgttctcgggttgctgctacccagcggggcgtgtgcttgccgtttgttagaatgcggctgagcaaagggtagaaaaggggaaagattagggatccacgaggctaataaattctcagtggctgcacactttcggaaccgggaagctcgggggcttcccccggagcgggccctgcagctgggatccaagtgagctgagcttccccgccctcccaaccgcgtcctgggccctacttcctgcccttgcctccccaaccctgcatcccgccccgcacttcccgcacgtgggtgtggccgggccctctctattaaagcaagagtgccctaggacaaagccgcccctgtcccggacagagtggaataagagcgcctccttcaatccccactcgcgcctgcacccagagcacctgggacacagcggctctgtcttggagaacaggtgcctcaatagggagggcctggccaaacctatgcgcgggaagtgcggagcgggatgcaggggtggggcggcaggtgcaggtagtagagcccaggcatgcggttggggggtggggggaaatctcacgtgcgatcccaggtgcggaacccgctgctgggaatggggtggaagcaaaacaggtactgcacgcacaggcgaggtgcctcgtgggggaatcgaatgtcagggatggtggacagtgcggatgggcggcaggtgctggggctcaggggagataactcagaggcaggctcggtggagaacccaaggccggcgaccaggtgcaggcggcccacaggccctggaggcatacagcggggggacaaggtgggaaggaggcctatgccccaagagctcaacctgtgctgcatccaggccagctgccacccagggtatgggccgcagatgccctaggatccttgctgatgcatgatgcataccggtgcccagcgtgagagccatgggaaggcagcacgcagccctggctctcccgcccaggcccctgataccaggccagagaaagacccgccactaagagctcatttccccctggccggagacccaggggtctgtggactgcagcgctagggtccatgsccaggtacccatattcctcagtggcctctgcccactgaccacccccgctctctccctcactgctgaatgtccaggaccttactcgacaaacacccatagttgttcgaggaggagttaatgtactgatggatggatgcaggcatttgctcattgacatcactgcccaccccaccatctgcttgccttctggccatgcttcaagcaggcactttggatactggactgtcttctgtgaatgtggctttgggcagcactaataacaagagctagttacagggcctcactgtgtgccaggcactgcactgtgtacactcttacctgtcctggtcgttcaatgattaaatatgcagatctaggaggtggctcttacagatggggaagctgaggcagagagaggcagaataacttgcacacgggcacacagctagaagacaagctagcacctgggaagtcagtctccagagcccaggcagggaagtgtgttttgctaactctctggtgtgagccaccgtggttcccagggcctcagtttccccatctaagttgagaggggtggagttggtcctcccagcagctgttcagtgtgtcactcctcacccatccttttaaagccctgcttcctggtgagagtctcccctaggccagggtttccaggcattcatttgcatgaatcccctagagagcctattcaaaggcaggttctgactctttgaggttctgtgtttctaagtagcccaggtgatgctgatgccccattcacgaatggcactctgaggagggagggcctaggtcatttccctggaaatgtaaggagaacctctcctcaaggagttctacagccaactaacaaaccaccagtccacaggggtgctgcttcagacaagctcgcctagtgatggattggaataggccaagtcagtgcagaactcctgaaggttattaaaaatcacggatctaccattaatccagaaatactttaaagcagttggctatgcccatctagggcactgtgtgcttgggagggtggatgtgaagatagcacctacagctgagtaggaaaatgaacctacactagccacaaggcaatgtgggctgagtgcccaggcagcactggttcaggatgcaggtatagaattgaaagagaggaagcggctacttcctagcaagatatccagggaaggtagcccaaaggaggaagcctttgaagtgggccatagcagtgagccagtcaagatgggaggaggagtagggaatgtgagaaacactgggagtcttggcctctaattggcacccttaggtgcatttcaccaagattccctgggccgctcctaccagaaagagactatcagaagtcagattgctcgctctcaccctgccttaagcagaacctctatccccaccaaggaatgtctgacctgggaggaggagtgatctcctgggccctgtgctataggctgccatggccacttctcacctggtccagctgctggccttggagcttccaagcaacctgagctggtccatgctgagttccccagaggccagcttctgcacctaaagtttacagctaggtaggaaaacagctcttccaactcccacttgcaaccctttctcacctaagaacttgaaaaattatgtgtctatgagccagttgggcagacaggtgagatgccctcaattttgtaytttaaatctctccccgtgtgaatcttagtccctggtgcacctcactgagcctgattccttacctcctgatgatgcttcccgaaatccccttgctcccaggttaacaactcccacccccagtgtctcctagcaatgggctccacttgcaagaatctctactatatacaaagcattcattcatgtattcattcattcattcattcatthactcagcagaagatgaatgagtgcttgtcagagttaggcttggagttggtggtagacaaacaaaggaaaggcaggctttggaactagaaagtgccctatgagtgatttaggtagaactatccaatggccatgaccagactggatgagcctgtgagaattgggagcaggaaaaccagctataacctcttgcaactgtccaggcttgaaacactagaagattcacttgaaaattactagtgcttttggcaggggcatttattcagtgttcactgggcagctgtgccctgctgcaaacatggtaggcactgagaagacaacagtcagcaaggcagtctctgtgcctgagaggctcctgggatgaggaaggagataggttcatagtcaggtcacccctccaggctgcagagcgctagagaaaagtccttcccacaaaggtccaggcttggggtaaagagcctcccagacctggggctgctgggagacctgcccagagggtcctggaggaggaggtgggggaaggaaggcagcattccatactcaaaggtctagagctgcaaaaaggctcagagaattccagatgcaggacttttaatgaagctggagcacagactgcagctctgtggggataagtgtgatggggagtgagagaagtaagaggggtcagactttctggtacagaggagaaagctggccttggtctaaaagggacatgaacaccctagagtctcctcctgagagtggctggatcggggtgtgcttagaccccaggcagcagtgggggaggtgggagtggggaggttgcaggcagccctgctgtcagaggctgggcaaaagtcctggcgaagagcagtgagggcctggtctgaggcccagatcgtgcagaagtgatgaaattcagggatgaatgggacgaaggactggcccaaggtgacttggtgctgtcagattgggagactgagtggacagagggagtctcaggcatagggagacaatatggaactcggtcaggacatctcggtggagattcagggctcaaaagggacagagtgtctggggttggagacttgagtcatgtgaggggcttgtggacaggtcatctcaggagctctgaagtgtttagggaaagaggccagaaccctggggacagtggcacttaaagggtctctgtctcatgccacaggtgggaaagttcagttagagaagtggggacagagccagaagagagcaccttggcaatatctaaggccataaggcctattaggacaagggttaaacaattaggacagattgttaaacttgttgggtaggtggtatgcagtggcctaagcaggaacagctctattatccaggtggggatggcagctccactatagtggtcaagtcctaaatggtgagtaagggtagaggttttcccactggtgagccccctgaaaaccttggcctcctagtctggaagatattaggttgctgcaaaagtaattgcggcttttgcatcaaaatggcaaaaactgcaattacttttgcaccaacctacagttgggggctgcaattacgaggaatcaaatttcccaacaaatatcaggatagggataggtatgtccaagaaggctgaatttggtttggataatgaaattaacttgtttcctactagagtgaaatgcacacttttccaaaaatgagagctcacagacctggatatcctggtacctaggaagtcagaagagggctggcaaaggaagcagtgagacagacatagcattggagcaagtttatctcyaaagactggcagagtgccctggtagaaactgagagcagtggaaagaaagatcagaaaccccaggaagctccctcccctagagtgacacaagacctttcctgtgaatagaaatgaaaagggcagttcaacatcatgaaatgattgggaacaaggctccattatatctaatgtttgaaacaaccaaacccaccaatactaggtagaccacaggactgagagggcaaagggcccagagcagcaatcttcctggcgctgtcttcctgggggctcggcttctcccatgttcattcatgagcaggtccactgggccaggccagccccttcttggtcccttctgtgctagcacctccctcctactctttgccccctacccctttaaccaccaagacaggaatctcagatattctatttaccgactggcagattacatttgagaatacttcctccaccagccatcagcattatcaaactcattcatccctgaattcagcaaatatgtggcaatacatatttgctgaattcagggatgctgtggacaacaggaaaaccatctgatgcgcaggtgtttaggctttagcaggttcgtatagggggcttgcattggttgcccatcctgtatccattggcccctctgattttgctttggagaaccaccccacgttagagcagctatgtgatctcactgggacctactctgcctctaggccagcacaggtgatctcacagcttgttacatcagatgggcaggcccaagccacttaacatgcggctttcccctgcccactgtgattagctgaggaatggtccagtcagagtaaagttagagacttaatgctaagagttatttcctttgatactaacaaggaaaaaagtaatgtaggggctgtttgcattcctcttacggcaatgagggagaacggcctcaggggaaagctgccatgtggccaggcatggtggcccacccctataatcccagcacttcgggaggccaagacaggaggatggcttgagcccaggagtttgagaccagcttgggcaacatagtaaggccctgtctctattaaaaataataacgggccaggcccagtggctcatgcctgtaatcccagcacttcgggaggccaagacaggaggatggcttgagcccaggagtttgagaccagcttgggcaacatagtaaggccctgcctctattaaaaataataacgggccgggcccagtggctcatgcctgtaatcccagcactttgggaagctgaggtgggtggatcacctgaggtcaggagttcaggactagcctggccaacatggtgaaaccccgtctctactaaaaatacaaaaattagccaggagtgttggcatgtgcctgtaatcccagctattcagggggctgaggcaggagaatcacttgaacccaggagttggaggttgcagtgagccgagatcaygccactgcactccagcctgggcaacaagagtgaaactcagtctcaaataataacaaaagaagaaggctgccatggaaagggcagagctaagcaaactagagaaaggaaggcagagcccatatcaaactgcacctgaagcctatcccaccactgaatttttctcagtcatatgagccagtaattcctttgtgtttgagatgaacttccttacaatagaaggcatctacctgacacagcataaaacatacacaaaaatagaagatataaggtgacaagtgccataaaacaaaactggaataaaatactccggaattcagaggaaaaacaaaaaagaatacttgaggggtttaccaaaggctctatggagttgacacgagcagagctttatttaatcataatagtaccagatacaaattactgctgtcttatttatatcccagggaccaaactagtgtttttcatatattggctcatttaattctcagaacaatcctacacactggttactgttgttctccctttcttccagaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgttkttaaagtcagrggcaggcctttcttcatgccttcttcctctttkctggctggaaygcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccagaaagaaaattttacaattttttttcacacacagttgaatggaagccagactcatacactaatctcatctccacttttagagatgaggggaacagcttgcccacagtgacagccagtgtgagctgggtttctgttgcccaactcattggggttccaaccctcacctagactgccctatgaaatacctagaacttggtcaggagaaaagataagaggggaaaatgtcagcaaaagccaaagactaagggtagcaggggcagaagtgagagtgggaagtgaaaggtgatataatttccctattccactgagcaggaagaggctgcctttgcatccctctgtgtcgggagacagtctggggacagtcagcaggcaccttgctgcaggagagcccctgcaagagcagcctttgtggagctgtcccttccaccccagtaggagcttctcggacacagcatggcctctctccttcactctggtgtcttcactcagtactgggtcccagattttttttttttttttttttttttttgagatggagtctcactctgttgcccaggctggagtgcagtggctcgatctcggcccactgcaacctcctcctcctcctgggttcaagcggttctcctgcctcagcctctggaacatctgggattacaggcgcccaccaccatgcccgactaattttttttttttttttgtatttttagtagagatggggtttcaccatgttggccaggctggtctcgaactcctgacctcaagtgatccacccgcctcagcctcccaaattgctgggattacaggcatgagccaccacgcccggcccgggtcccagatctctgagtccaccagagtggggctcagagtcctctatccaccaaccacatgcagccatccaacacgctgtctctcttctggcctcagcctcattgtccttggagtgccagtcttttgtttaagcatggcagagccttaatactggaccatccactacatgctagaaggggaagaactcctcacaatgtaacaatttttgtatttaacttatggatatgctcattctttctaaacaattcttataaggaaattttaagtatattaaaaaattagaatagtatgaccaccccaacactgcccagcttcattaataatccacacatctaaaacccatctagtccttgacacacacacaatcattatgaaacaacccaagacataaattgatttcatccataaatactgaaattatgattcaagagaactttttttttttttttcttaaaccaaggctgaggtgggagaactgcttgagcccaggagttcaagaccagcttaggtaacactgcaaaacccagtctctagagaaaaaaaaaacaaaaccaatcataaccatagccccactgtcatatgtttaaatgttgtttccttaatatcatcaaatatccagccagagttcaaatttgctttgtcccttaagcacatttttacaagattgattggctagttcagatcaagaggcaaacaaggttcacacattgcactggattcacacgtctcaagtatctttcaatctccaggcttcccttcccttcccttttcctcttgtaatgtatttgttgaagaatctaggtccctctgtagtcactcctctccccattcccagcccctggtaaccacttacctgttttctgaccctataattttgtagggcccactttgtactgatgtacttctgactaggtgtgtttatgttcaagcatcagagccaaggcccaaacctctaccctggccctccttctgctgtggcccaactgtacccagagctgggctctcccgtctccctgcctgttaatcctagaagtgggtgccgaggagggagaaacaggaaggagggagttggggagggcagcttgttacatggacatcagggctgttcccactagcagcaacagctttgtgttagcttggctccaatttgaatgaaatattccaaggccattttccccaacacgttgttaccaaaaaaactcccagcatgcagaaaagttgaaagaattgtacagtgaacaccccttaaggagtttctaccattaacattttatttaaaggctttgggactctgaagtataatgtttgtgaaatgctatgagccagaccctccacactgaaaattcccagtgtaaattaatttgttaaatgctcttagaattcctgcaataaagaacacctatctaaccttagttatccctgtgtttcccaaatatatcttactttggagcactttttttttagtaccgatttacatcctgggaaatggtgtttaccatgctttaaaaaaaactgtggtaaaataaagataagatttaccatcttaaccattttagagtgtacagttgagttggcatacagcattcacataacttaactgtgcaaccaatccacaggactttttatcttgcaaaactgaaacactatacccattaaacaactcctcatttcctcctcccccagtccttggcaactaccattctacttgtttctatgcatttgactgctctagatacttcacataaatggaagcatagagtatttgtcttccagtgactggcttacttcacttagcatcatgtcctcaagattcatccatgttgcagcacatgtcagcgtatcttccttttagaggctgaataatattccactgtatgaatataccacattttgttgatcattcacccactgatgggcacatattgcttccatctcttagctactgtgaataatggtgccgtgagtatgggcatacaaaaactaccactaatattttacagtgcttgcttcatatctgtccatgtgtccgtcactccacccatcatattttttatgtatttcataagttacagaccacagtaacttcccttaaacatgtcagtatacatatcaatgaccagcgttcattgtttttttccaagtcattttgaactgccgtagcaatgagtaatatagcctcaaacgcacacatacacacacaacacgtgcgtcactacagaaaacttttcctggcagacaggaaagggcccattgttggtgatgtcattttaattaagataaaaccaccaccaccatttagtaatagcctggggtaacaagggctgcgtcacggactgccacttttgccatcctgctcagagcagggccatgcctaacccgtatctggggattgcttcagatattatgaatcgcttcaatattatgaattactacaattcataataattgcttcagatattatgaattacaatatggttcaaaggtgctttagcagatgaagacacaaatgtgtaaacacatatgaattacaatgcagactgcccagatgtgtagcaagtcctctgaatgtttactaaacagtaaggtgattccagaggaagatgcttgaggacaatttgggaaaactgacaacttgaaaactcagtctctctaggcaaggcctacttgcagataaccttgggagttctgtgctgggaggaaagctaaaggactaagttaggcctctgaatctgctctggaagcctgcatgcacttgggtcagaacaagcccatgtgtcaatgtgggtaaagattcctcagctgataagcaggaaaatgggcagggcattttggtctttgaggttcaaagctcagatgctcactgccttggtatacacgcacacacaccccaccccccagctgacggcacaagagtatacagatgcaatagtctaaagtacattgtccaaatatggatggccatgagccacatgtggctatgaagcacttaaatgtggctagtctgaactgagatgggccctataaaatatttcagtaacaggtttttatactgattataggttgacataataatattttggatataccgtattaaaggaaatatgtcattaaatttcacctgtttcctttattatgtggctacttgaaaattttaaaattacatatgtagctcacactataaaacacagattagaaatattgtatagcactgacctagaaacctccatttaggtaaaacatcttaacccctttggaagcaaaatatgttaaataacagcataaactcccaccaagaaaatcctcaccttcctcctttcaacacatttattatatacagctgtcactgcattgtcaatctgccaaatggctctatgttccaacagggctggagtagtcccctgctcacaccagccttcacaatacttcccatgtcttccctgttaacctctctccacccagcacccaggctcccaactctcctggctgcctccagccctcagctggcaccactgacatgctgtttccagtacccttttcttctttctgcatcctccctgggggacatacatccctcatctcgtgacttcagctgtcacataaattcaaatgtttcagaactctattttttacctcctacatctgtcagtttaaatgtcaggatattttactttcagtaaagccctaaaaagacaaatctatgtacttttaaagaataaaagaaatgactggctgcagctcaaacctacaactgcttgcgaaactctacaatgtctggcagatgctagaaagaaggggatcaagacagagcacacttggcgtggtatgctatctatagaaaatgttaaaataaaaattaagtaatctaggtttcctctctttattttctacatctactctctgaagagggcaataaataaggaaatgtcccaaagagggacaaattaagtcccaaaataacacaaaattgggcaaatccagtcatgaagaaagaacagaggttcttaaattgggacacacagaggcaggtctgcaggtctaggaatctctgaacatatgtgcaaaattctgggtatgtgtgcatatgttatataacaaagcgaagggtccatatagctttcatcgcatttcaaagggtctagcactgaaataaggactactgctatgtgacttaaaaaatgaaactcaggctgggcgcagtggctcacgcctgtaatcccagcactttgggaggccgaggcaagcagatcacctgagacgaggagtttgagacccgcctggccaacggtgaaacccagtctctactaaaaatacaaaaattagccgggcatggtggtgtgcctctagtcccagctactcaggaggctgaagaaagagaatcgcttgaacctgggaggtggaggttgtgacaaagcaagactccatctcaaaaaaaaaaaaaacccagaaactcaattcagttatgaaggtaaagatgacctgtttacatgataatattttaagataccagtgactgcaagcatgtagttattaagtccattacagtgcacatttattgactctgtgtatcttcacagtgtgatcttcaccacagcttgcaaagtgtaaccactcagcaccttctgcttccttctgttcagtttttccactgcaattcttccagcataattttctgatagccagtgtatgactttggctaaaacaaagatagagaaatcatgaaatgtttttccaattaatggtgtaaacatgaatggaagttaaaacctgaaaattgaaatgtacaggttttaaaatcgcatcattaacattttagccattttattttaacctggaaaatattttactatatttacttaaaactgcaagactaaattttaatcttactcactggcaataacatcaccaaaatgagcaagacacagacaatgaatctctgtcaaatgttgtttaaaaaaaaacaaaaaataaaatttttttaaatgaatgttgttttaatgatcaatggaatttcatgaaatggatattcaagttagtcttttagataacattactaaatttataacaattttaactttacaatatattctagattattttactattttgacatccctgtgaggtggatggaattgcatttttactactgggtaaagaaagacaatgacagattta

SEQ ID NO: 10623 - DNA, 6506 bp, Homo sapiens
  misc_feature (1)...(6506): n = A,T,C or G, or insertion/deletion polymorphism (see Tables 1-2)
aggcttactacaagtgagccccattctgtgacaatcagtaggactcaagacatgctgtaatcctaccaatgtcaacctgcctgttgttcaacaaaagtctgtgcttccgattttacctgtttagtcctgggaatgttgggatttatttcccgtaaaaccaaacctatggtttcatgcatcaagaccagagaccatggaagttccgtactgaaagccactttcttccagaaaccaatttaattgtcatttcctcaggaaataagctctcatatttgacacctctcacagccagctgagttgagaggattattctctttttttcagtgaaaaagttcagcctattagaccacctgtgtgactgatggtttggtgagagttgctacattgtttagcctgaactatccttatattgaatattgaaggaaagtgtgagatatataatttaaagaagcacatctgttgtagtataagtgtgtctcctttaaaattcaggtagggctcctcactcatgaatgggattaaggcccttgtaaaacacgcttcacacagtttttagcctctcatccttccaccttctacaatgtgagtacacagcgttcatcccctctggaggatgcaagacgccatcttggaagtggcgaccatgccctttgccagacattgaacctgttggtgccttaatcttggacttctcagcctccatgtgttctttataaattacccagtctactgtattttatcacagcacaaataaactaagacaacatctttgttactcataaatgtataaaacatacagaatttagttcattgccattggccatctttttaaatataaatttgtatgatttataaatagtgtgtcaaatttatataaacaagttttgaaagtttccttttaactgtattttagtacattcttgatgtagaattacttatttttgcctaattaactaattaactaattgtgatgtggtgacctaggaaaggaagctaaggttcaccttagtattacaggataaaagcaggagctatggatgtccttacgtaacataaacgcaaattgtgtcatttccagaggagagtaaccatggtgatgaggggaatcttttgaaataactagaattgctacaaagtatctaccccaaggtctataaaatgttgccattcattaaaagaagtagtcttactgatttgcacagccatgaattaaagtgataaaaataattttagtataatggacataattctctttagaaattgaatgtgaggtagtataatataacgacagagcttgaggggtttggaattacatatataataacttggttcaatagaattgacagaacaactctgctttaaaataattaatattttatgtgaagagtgttcagtctcttactcctggttcccattatgatttcctcatttgtttgaggctatggccctttactattccacttctctggttttatcgtaagggaagatataagaagattttgcaggccagacgtggtggctcacgcctgtaatcccagcactttgggaggccgagttactgtttactagccttgcatctttgcaaaagttgtttaatctccatcattttattctcttcacttgtagggatgaaaaggttatatccctcattcagctaatgtgagaattgattaaaaatatgatgtatggaaagctctgtacaattctgagtacaaagcaaaatgctcaaaaattgctaagaaattttagtcatttttattgcagcatggtgagtatcccattcctagaaacactaaggcacataaggaatgactgcctatcagaactgtggtagggtgtgaattaatgcagaactttatctgcatagttatactttgaagtccgttctgaatcttagatgctacatttatataaatacaaagcataatagctatctaaatgtagaattgtatgtttaaaattatatgattacatcaactgatgtaaatcacagattttccctagggttctgtttcctgaacattctgtaacgtattagttagcaaagtcttttttttttaaaactgagtctcgccgcatcaaccagaccggagtgcagtggcgtgctcccaactcactgcaacctctacctcccagaatcaagcaattcttgtgcctcagcctcccgagaagctgggattacaggcatgcaccaccaagaccagctgatttttctattttttttttttagtagagacggggtttcaccatcttggccaggctggtcttgaactcctgacctcaagtgatctgcccacctcagcctcccaaagtgctgggattataggcatgacccaccacgtcctgccagcaaagtcttcttatatattcccttacgataaaacaagagaagtggaatagtaaagggccatagtctcaatcaaatgaggaaatcctaatgggaaccaggaatgagggattgaacactcttcacataaaatattattttaaaacaaaattgttctgtcaacagctgactttgagtccttgatcgatctctcagacccatgaatacttggattgcacagttgaccttatcgcattgttagggtaagtgctatacaaaggcacattcagaccctccattgcatataggtggcccctgcaaaccccttgcctgtgtgtgttctggaggtgccactaaacttgggggaagcatcaggagatacacttgaaaaaactctttttactaagattaaattattaactaactttcaatttcctttaacttattagagacatctctacctgtaaataggtaaagattacactctccagtcaacagctgtcattctgtcatatcatcagatacccagggctgctgctccctgaggcatccacagaatcacattttccagtattgaaagacctgaaagatcacggtgccttcatttcaactgtgagacatgatgtaattttcacaaatctacaacagtaagatatagtgcaacaggaccagattaaggtctcctggtttgcaaccatgtcccctccatctcctttactcctgaacacactcactcctgcaaacagttctcttgtcaagtgggaaatgaatgctcttacaaggctcaaacttgtgaacacatcactgaccagcacagagctaaaataattggggctaaaaataccgccccaattaaagtgttttacatgcaactggttcaaacctttcaagtactaaaaacaatcctgtaaagaaggaaattctgtttcagaagaggaccttcatacagcatctctgaccagcaactgatgatgctattgaactcagatgctgattcgttctccaacactagattacccaatccaggagcaaggaaatcagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagacgtaagtgcacattgtgggtgctgagctactatggggtggggaaaatagggagttttgttaacattgtgcccaggccatgtaccttaagaaattgtgacgtatttttcagagattgcccatctttatcatatggatcccaaataatttccccaccacaaaaggagcttggctacttgcccactccatgagacttgtgtaaggggcctccatacaggtcatttctactcaaatctccaccaataaaacctttgcatcacatgtcctcagggtctttagaggatttagaaataaggatgctaaaataaattccccatacagcacttgcctttattatgttgacttatgtcagacaannnnnnnnnnnnnnnnnnnnaatattaattattttaaaactatcaggggaaattcagccagatatcaggcgaaattcccacccccgatattttcacgtaggttcttttctatattccctaagcgtcgaccagtctgagaaataaagggacagagtacaaaagagagaaattttaaagctgggtgtccccgggagacgtcacatgttggcaggttccgtgatgccccacaagccacaaaaccagcaagtttttattagtgattttcaagaggggagggagtgtacaaatagggtgtgggtcacagagattgagatcacatgcttcacaagctaatagagtatcacaaggcaaatagagacagggtgagatcacaggaccacaggaccggggtgaaattaaaattgctaatgaagtttcaggcacgcatggtcattgataacatcttatcaggagacagggtttgagagcagacaaccggtctgaccaaaaatttattaggtgggaatttcctcgtcctaataagcctgggagcactatgggatactggggcttctttcatctctacagctcgaccatagaagacggcgccccctgaagcggtcatttcagaggcctaccctcagggaagtattctctttctcagggatgttccctgctgagaaaaagaattcagcaatatttctcccatttgcttttgaaagaagagaaatatggctctgttccacgtggctcaccagtggtcagagtttaaggttatctttcttgttccctgaacattgctgttatcctgttcttttttcaaggtgcccagatttcatattgttcaaacacacatgctctacaaacaatttgtgcagttaacacaatcatcaaaaggtcctgaggcgatgtgcatcctcctcagattacaaagatgatgggattaagagattaaagtaaagacaggcataggaaatcacaagggtattgattggggaagtgataagtgtccatgaaatcttcacgatttatgttcagagattgcagtaaagacaggtgtaagaaattacaaaagtattaatttggggaactaataaatgtccatgaaatcttcacaatctatgttcttctgccatggcttcaggtggtacctccattcggggtccctgacttcccgcaacaaaaacagagttgttctgtcaacagctgactttgagtccttgatcagtctctcacaccgctgaatacttggattgcacagttgaccttatcacattgttagggtaagtgctgtacaaaggcaccttcagaccctccattgcacataggtggcccctgcaagccccttgcctgagtgtgttctggagctgccactaaacttgagggcagcatcaggagatacacttgaaaaaaccctttttactcagattaaattactaacaaacttttcatttcctttaacttactaaaaacatctctacctgtaaatacgtacagattacactctctagtcaacagctgtcattctgtcatatcaacagatacccgtggctgctactccttgaggcatccacagaatcacagcattttccagtattgaaaggcctgaaagatcccggtgccttcatttcaactgtgagacatgaagtaattttcccaaatctacaacagtaagatatggtgcaataaggaccagattaaaggtcccctgatttgcaaccatgttccctccatctcctttactcctaagcacactcacacactcactcctgcaaacagttgtcttgtcaagtgggaaatgaatgctcttgcaaggctcaaacttgtgaacacatcactgaccagcacagagctggctcacaatagggacgcaattaaagtgttttacacgcaactggttcaaacctttcaagtactaaattaaaacaatcctttaaaggaggaaattgtttcagaagaggaccttcatacagcatctctgaccagcgactgatgatgctattgtaatcagatgctgattcgttctccaacactagattacccaatccacaagcaaggaaatcagtaacttcttccctataatttggaatgtgggtggagaggggtcatagttctccctgagtgagactcacctgctcctctggcccctggtcctgtcctgttctccagcatggtgtgtctgargytccctggaggytcctrcatgrcagykctgacagtgacactgatggtgctgagctccccactggctttggctggggacacccaacgtaagtgcacattgtgggtgctgagctactatggggtggggaaaaaagggagttttgttaacattgtgcccaggccatgtcccttaagaaagtgtgacattttcttcagggattgcccatctttattgtatggatcccaaattatttccaccacaaatggaacgtggctacttgccctcttcatgagactgtgtaaggggcctttgtataggccattttttttctttaaatctccaccaataaaacctttgtatcacatgtcctcagggtctttagaggatttagaaataaggatgctaaaataaattcctcatacagcacttccctttatca

SEQ ID NO: 10624 - DNA, 13271 bp, Homo sapiens
gagaggtagagtttgtaaggagtagaattctggagacactgctgccaggtgctaagcagccaggcacaattatgtaaactggagggaatcccgccagccttcctcctccaatggacaggagggatttgtgagacgctagtgatacttctgggtaagttttaggtacctttagagtgagtgctgatcattgtcactcaaggtaagagagggcatggctgtggaatttcctccttcaagaggcacttgtgagctgggcaccatggctcacgcctgtaatcccagcactttgggaggccaaggcgggcggatcacttgaggccaggagtttgagaccagccttaccaatatggtgaaaccttgtctctacaaaaaatacaaaaaaataattagccaggtgtggtggcgtgtgcctgtaatcccagctacttgagaggctgaggcaggagaatcgcttgaacccgggaggtggaggtgagccgagatagcaccactgcagcctaggtgacagagtgagactctgtctaaaaaaaaaacaccaaaaaacaaaaaaccagaaactatcactgggagcttaggagtaaagtctgaggacaaggcagacctcagtttgaatcctgactcttccacttactatgtgacccaggggagttcctccatccctctgagcctgtttcctgcaagagggggatgataatagaataatgaaaccaaccttataggttgtgcaggggattagctcatgatgatggtttcttttggtctccacaaaagacctgatcaggaaacaggctcagagatttagggatttccccaaggttggcagagagcagatgatggagccgaatagccaaagctcaggtggttcttcctttttttttttttttttttttttagcgttagggcctcactctgttacccaggcttgaatgcagtggcgtgatcatagctcactgtgaccttgaacacctgggctcaagcgatcctcttgccttagcctcctgagtagctaggactacaagcgggcaccaccatgtgcagctgttcttcattttttgtagagatggagtcttcctatgtggcccaggctggtctcaaacccctggcctcaagtgatcctcctgccttagcctcccaaagcttaggctgccaagggagcagtgctttggaagatgcaacagcctgcttgctctgttgttcccctcctgccatgtgacagatactcctttctaatacctgtggtccctacctgtccatggacatgctcacaggtctccagggagcagaactaaaatgcgttcaggagctcgggctggcccagtcaagtccttggttcaaggccaggttctcttaacactcagtgggtgtgaccagattctgtggtggtcacaaagctacgtgtccacagggcctccacattctagggtcaccctttcctttgatactcacatctaatggcctaagcctctattccacacagtctgcaaagcccagcagcttaccaaggattttgtgtaaatggcttagaattgttttttaaaaaattcagctgagagtctttacctttacaccagaacaatgtaattctaggcagggtgcagtggctcacgcctgtaatcccagcactttgggaggcccaggcaggcagatcacctgaggtcaggagttcgagaccagcctggccaatgtggtgaaaccccgtctctactaaaaatacaaaaattagccaggcattgtggtgcatgcctttaatcccagttactccagttactcaggaggctgaggcaggagaattgcttggacctgggaggcggaggttgcagtgagccgagatcacaccactgcactccagcctgggcaacaagagcaaaactccgtctcaaaaaaacaaaaaataatgtaattctgataccaatgtgggtctaaaaatttttgtgctgtttgttcccctaggtctgtttttctctcctttaccattgttttgttttcttcttgcttggaggttaaatgctgtctctatccttttaggggtttccctcttccctgagatttctcaagatgcccagggtgccttaagtctgcctgtcccttcttgttcctcattcttattcctattaattctccatcgtgcttacttcttgcctcctgtttgttgttctttccctcttttcttcatacattcaccattaacggtgcaccaaccttttacttaacatcaggtagataacatggtgggggagacaagttgctgagcttcttagagccccttggccatgaggagtccctgcccacatccctcctcaggtgctagctgggtaggctgtgtcagatcccctctataagccttccctcccagagccccaaccccacttcacacctccctggtccaccctactcaccctcctgctgtcactgtcccctcaccttgcccagttcttctccttgtatttctcattatctgaactcatatttaagttgtctgtctatcccattaagcctcacagtggtgtcttgttcaccaccatatctcaagagcatgaaaccatgcctggcacacaagcagtgaagacaagcagtggatatttgttgaacacatgggtgaattctggcattctaagtcttcagtgggaccatctacctgtcaatcccagtggaactggtgcaatgaagtggaaaaggggtctcctgggatcccactcccaccccaggtgctggggtatggactgcccacctctgggtcccaaagacccccacagctgaaaaactggactcaagggagcagatagagtaatgtactaacatttttaatacagtctgatcagatcaattcacatcacaaggtcaacctgggcttgctcacatgtgacacaactgaggtacacaatgtccctacctgccggctgtcccaccttcctggttcccaacagcattgaaaccccctacttccctgaccagactggcattttttaaaattttgcataaaactatttcttccatagacttcaaacaatcaactagccaagttaattatggtacatctaaacaaagtttaatactaaccctaatgtgtgactgcggtttacaaagagctctgtatcacctgggatagctttcagtagcaattcactacaactggtcctaaaaaataataacaataataataataattagagaattaaaacccaacagcatgttgaatggttaaaatcacgtaagaactgaaatttggggtgggggtgtcctcaacagctgagcttgtcctagcagtgaaaatgctcgcctccaagcagggctcagaaaggtctggagccctccaggcagagggctgagctcagggggctcttggaggacactcaccccatggtccatgggatgcttctggcttccttaaaaacagttgggcatccgcattgtataagtaggtggagaccctagtgtggttcttttgaaggatatgggaagggaggatgacgaactagagaagtgggaggggaccaaaatcactgaggtcccagaatatcatagatttgggtataggattggggtcactaagaattgagcaccaggaattccagcttcttcccattaaagaaactgggactggttttgccttggaggcctatgtagtgttttctgcccctgtcccataccaagtctcattgatatttctgcagaatatcagatgaaaatctatttctaaagaccattgggagaatgggtggtggagaaggagttggagtggggttggggggcagttaaaaatgaataaaaatctctcagctacagaacccaaacatcacttccctccgcattcacagcatttcccagcagtccccagatggttgtttccgtggggacacagcagctgcctcatttcccttcaggccccatgggctgctggtcaacctcaggatctactaaagatgacgcaaatgccgactgaacaatctgaaacccaaaggactcgaggagagacatgttctgctgaggagagaaaggtgagccaagggcagggcccaggtcccccagggggcccccgagagcccggacatgcaccttctggatgtgtttgttcaagtaggacttagagcggaagaagctcccacattcagggcatgggtacttcttctccccatcagactccattttgtttttggggactgccatgtcgcaggagaaagagccattggcactctgcttctctggcgtcttcaggtcgctggcatctgagaggtcaccataggagtcagagctctcaatcggatcctgatgtgagcatttctggccttctacgaaaaaacaaaatataggagagcgatgaggccaggctctggagatgccccctcctggaggggtcatgaggggccagctcacagacctgtggagggcagccattggccagccactgccctggcagaacccacggagggtcagctggtcagtctgggagcctggagtgcctacaggggtgaaacggcagggccctagggctgccagcctcccttgctgtggactcttcatgcagctgcacatgtactgctcaccgtcatctcagcctgcttcaaggaagggatacagagagggcaactctgctacagctgcccagaacaactcaaagacccccaactcctaggcgctcttttgggtgcctctgagggtaaaattggtattctgatgatgccgagccagtgtaatagtagcctcgcctcctgcaccagactagctgcaccctagcaagacaggcagaaccagagccattaggtcctcaacctgggtagaccccatcaatggctcagacagaagccaatccttttcctaatgctgcaaacatagccctgtccttaccgccttccttctgccaaaaccttttcagggccaagcagcccaagcacagagattgaaagcaactctgtactactcagtcggctgggtgtccccaccctaggccccagacaagctgggccaagagacaaccctggctgctctgccttgcccggcccacactggagtcctccaccaatcagcagcttcctgcctgggtccagagagccatgccgggaagggaggtctgtgatgggagcatggagcatgccatctctgctgtttctaccatctgccaagcccctggcctcatccccaaggcaacgacaacgtgacataccacaaaacaacctgaatcaacaagtgaaggtgggcctggggagctttctgcaaaccaactcccaagtcagaggagtcagatagctcattattgccatgcatctcacaaccatagccagaggctctccagaaagggccactcacagtaaccaaccactcctactgtgagagaagccagacattggctcccaccggcccactgggtcaaaagaggagaaagcattcagccgcagctccacaccatcctaaagggcagcaggcagtgacaggcccatagtgactcatcatgcagggctcttcttctgcccagggcccggggcatccctgcagggctccagacagtgggggctggccaggaggaaaggaggagggctggggaagaggaggcggaggctggatctcggcagtgccctaaagcctcactcactgccctggagtgagatacccactgtgacttttgtcctggaggccactgccactcagatctctgagtctcctcaaggcagccagaaagccggcagccttcccgcctccccacgcccagcccagcgcccccacaacacagtctgcgcagagaagcaaagtgcagagcaaggggtcgcttgcctttgttgccataggtcctggcgcagtggaacgctgctcccccattcaggatgggctcctggtgcctggagacctggggaaggggaacaccgtggtgggttttaacatggacctttaagtaggaggcagaggagaaacctaaacaagacaaaaggagatgagatcccgcggccagcaagagatacctctctccttcccccactcctctcctctggccgctctggctagcattcccaggtcagctgcacctagaaggggccccctcctggctcaaaaatggctgcaaccacatgagccatgtgactcaggatggagggtggcactgtccacaaatcggcttctctgcagagcccactctgcaaggctgcggtgaggggctgaggctggctgcctggtgggatggcctgagatcctgctcctgctagggccagaggccaactgcctctagggttgcttggtgcctcagtaacaggtggtttgagtggatgtctcctgcaggaaccatgactagaaatgtggttagacaagaatttgaggctccagggaagccacaggattctagccagcaggatgcctgcttaatcctcgtaaaaggaaactggacaacaaacgagatggaggtaaaatgaaatcccaaaggaacgcctccaaggatcccgtcttctacctgtcaggagatgttctatttttctaacttccccaccttcagcataacaggatttagtaactgtttagaccttttgaagaacaaagacaaaaataggaagttgtgtcagaggagtgcagtcatctcttattcatggtagtgttttggttcgattttggagcatccaccaggttcgcgtacaggagaagaaacasggatgatctctgtctttattttgggggaggacaatccggccttcttgggactgttccagcccacctcccagatgcttcggtcagtctgatccacgagatatctcaggctgggaagaacayatcttgggccaacttccacagcagccatgcgtccaaggatacagaatcaggcaggccgataaaaggattttgacttgggtttcacaggaaggaggtatgccatcaaaccccactgtagtcaaggatcagaaggtgcttttagcaggaactgaagctttttagtataaggcccacttagggtgccagcaccctgacagtgtccctttaatccacttcagatctggttgactcatcatcaggtgtttccattcactttcaaaattacacagtcacaggataacagtgagatccactgctaaagggtaaagggtcagaggctgaagagtactgtgtaatgtctgcatgagatttgttttaaaaaagtctgaattggcatggtattttgaatgctgctggaactgtaataaaggttcacctttaggaagtgctgatggcacaccagggcccagcacaccgcatgcactattctatagaatttgcccaacaccctttgtgctacagattactattatacccattttacagataaagaaataagaggctttgtgaggttagggaggctgaggtgggcagatcacgaggtcaggagatcgagaccatcctggctaacacagtgaaaccccgtctctactaaaaatataaaaaattagctgggcgtggtagcaggcacctgtaagctgagatcatgccactgcgctccagcctgggcaacagagcgagactccgtctcaaaaaaaaaagaggcttggtgaggttaagtaacctggtcacacgtacagctactgagtggcagagcctggactccaaccccaggatcatgtgccaccagaacttggcccttagctactgggcagatgctttaacccacttatgcctcatgttccattattgggacgctaaccttttaggaattatttgtatcctactgctcaagatcatcattaaagtctgatttttcacaaaaaagtttgtaacctccagcataaatgggttaattggttcctgtgtcttagccctgagccctagaaatatccagtggacttttacaataggtttcattattaccatttacactcatgtatttttcgaccataatggtatgttagaatggaagctgctggaaaaacagggctggcctgtgggaactttatttaacaagttctcctctgacagcagcagttagtggttctgaagggaaatgtgggattgggccaattttccttcctttcccaatacagctacttcaaagatctgtctagaccaggtgctggtgtcctgccctgcctggtagagcaagttgtcctgtgctatgaccgcagtggtctgcctgaggctgatcatgggtatagattggtgtaagagggtcccatgtagacatccctaagagggaggctgtagtcaggagtgaggagacaaggctaatgggaaagaggctgttagccctgccccttggggtggtactgtagagtcccctaaaacaaagcagaaccaggagacattggctcccaccaatcagtacaagatattagaactttctgataatatgatgataccactttagaaggtaattttttcctttttttttttttttgagacagagtctcactctcgctcaggctggagtgcagtggcaccatctcggctcactgcaagctccgcctccagggttcatgccattctcctgcctcagcctccctggtagctgggactacaggcgcccgccaccatacctggctaattttttttgtatttttagtagagacggggtttcaccatgttagccaggatggtctcggatctcctgacttcgcgatccacccgcctcggcctcccaaagtgctgggattacaggcgtgagccaccgtgcccggcctttccttagttttttaatcccttgtggggtctctaaaatagcatgaagctctctccctgtgatgaaccagagcaggtccactgcaatcaaaaggggacagaaaggagcgggagagcaccaggaattattatgtttactccttactgggagagctataccaagagaacacagcagatgctcaataaaaacttgctgagtttggctgggcgcagtggctcatgcactttgggaggccgaggcaggcagatcacctgaggttgggagttccggaccagcctgaccaacatggagaaaccctgtctctactaaaaatacaaaattagccgggcgtggtggtgcatgcctgtaatcccagctaactagggaggctgaggaaggagaatcgcttgaaccaaggaggtggaggttgtgatgagctgagatcgcgccattgcactccagtctgggcaacaacagcgaaactgtcttgctgagttttcctgaaaaacagtcttagaaacacgtggctgagtcctcttgactttaccccagctgcagactgtactatctatagcaaaaccacatggcggggtggtaggagtggatccacagctgccacttaaagcctagaatttaaacacagagcaactcagcagccaagtgttaggatgaaacagaagctgagcttctgagcagaatacgtctttgaagccagacatatttagccggaattctaaacttacccacccattcaccactgattaaccaagatccaaagaggcagcttgatccagccatccacgcaatggagatgctgagcacacatatgactgccactacaaccaacaagccaccggccctttcactccagagacgatggtcttattagcaaaaggccactgctcctcagttgcattttcttgcctggtgtgcctgcacttggcactccagaagcaaatcatcctttggcaggttccacatcaatgcaggggttggggactgctttctccttgtccaaaccctgaaggggccattcccaactgcactgtgttggagtgggcctacatagcttgatgtgagtccaggggaacagcaggttccctgcatccatccacttgtgtgcttacctctgactggggagaaggcttcctctacctttcaagcaatgatgtttgcattcaaatgtctctgtcaaaggcggattcctgataatctgttcctcttcaccataccagcacataggcatatatacaaagatcctgctacagaaactttaaaggaagaaaatcatggtgatcagccagggccttctcccttttccactgttcaactcaactgatttcctcaactcaaaaatgtgggaacaagcttttctagccataatactccctccactgcaaatgatcttcctgtacaaatagtatcatacacatcctgatatgtctgtatgacaaagccagagtcatctgtctcttcaacttgcatctgactcacgtgtgaggctgcaggagtcaggctgcctttcctctttgccattcttcacagccaggagtcatttttgtggcaaaaattgaaaaagacagatctataggtagatacttaagtcaactatttaagaattgttgggattgaaggatctgagggcacctggaagttcacctgattcaatcttaactgttctgacattcagcctttgtttgaacacatgcagagataagaacattcgtttattcgtgcaacccctcctgtaggtacaggcttggtggcagcagggcaaaggaggacacagagctctctgcattttgattccaatgtctcaatgtttttggtgctcagaaagaactttatcctcttcctttttttttttttttttttttgtctcttcctatttctgcccaaggaatgagtccaggagtagaatcctgctccttctcttctgataaaaactgcaattgttttctcttctttctgagtacccagcatgggttggaccagcaccttctttagtcttcttgcaggaaagggacttcccgctctggctctggaacccagagatgtttggcctgtgatccagacccagtcttggcttttctgagaaaaagtagactctggtttactcttctggattctccattccggtcatgtagcttatggctgttgcccaagttctctttactagcccttggaaaataaatcctgatgtacaatagttgttggctttgccacatcagctgcttccttactgggccaactttcccactgtccctgctgctctcagtttttctctcctcctgagctgggcttcaagggctgtagccctgggtctcctgtccagtttctgccctactccaccatctggtctgggctttctgagttttatcatgagcacccttctccactcagcagttttcaacctctggtctctgaccccagttctcagactgggaacttccatattgaaaacttgacaaaatgcctgctaacagcttgttacagcaggttttgagttatccgggggagctgtcaggaagccaggttaggatgaagcaagacaagaaacgatattatttctagggctggggcagccccagtcaagacagtcagccacagcctgataactctccctgcatgcgcaagcccaccgcttgcaacctggaggaagctcctgtcagcaatgggctctaatgacatgtcagaaaacagaacagacagcttaagagaccttcactactacttccctgctttcacagcaggtgtcctggtggtacaaaccccaggtatgaagctgcaaggagggacccagttccaggacaccaagaacacccagctactcagcaatctccttccaccgtggacctcggcacatgaacacagcacaggcacccaacgattccgccaaggcctgcaggagtgttgtgcctggtccaacccagagtgtcaacaagcatgtctttcccaacattgttacaaagtgcaaggatagagtctcccaagtgtgcggctcctttcacctaccttgtctcctgggatcctcataacagccctgtgaggtgggaaagggggctattcttaaccccatttgagagatgaagaaactcaagcttagagagggaatgggagaactcgaggccacctagtgagaggctgggactaaaccctgggtctcttgactcctggttcagtgctgcacccactaagcaggctttcggaagcattgggacaagcaagaatgccccaggagataaggacatcccagtgctccccactggccaaagcaaagcacaccatgcagaagcatcctcacgttcacagatagctgctccaacctcctttagcacagacacagtgcaagcctccactgatgctgtgcttgcaaaacacaaacatctagcacttccaacagccaactagacccggcagaaccttggggacaggcttgacttcacccaacacaacaccactgccacagagttagacactacttaggcccaccttgtcctcaagcatgctgccctgctcagagcaccttccactttcctctctcaaggccacaatctacctgagtttgggctctcttctgactacttgtgctacaaagtgtctgctccttgtttatctccagactcaacctccttccctggctgctgaatttcatatgccagtgaatcaaccagcaaaagctctcaagccggaccaacctctttttctctcactttgggacctactaactcccccaccaacctcagtggttcagtggtgtctgcaaaatgcatccatcctgccatctgagtagcaggtgagagttatgggcccaagcttgggaagaacctctctccttctgttttgacctgctggtctcctgggacttcccattctaagcaccccaagcttcttgggaaggaagaggtagcaaatagctagttgggtgatgaaggtgtttatcattcagtgggaagtagggggtggctgtgcaaagagtggagtctgaggcagggtgattgagacacccctaggcctcccatacacgctcaggcccatcctctggaagtgaggaaacagtgggcagattacctcggttacagatactgcagaagttgctgggcccctcgctgtgcttcttcaggtggtctgccatgtatgctgcccgcaagtacttcccacacacctggcagggcaccttgtcttcatgacaggccaggtgggagcgcagacggtctcgggtggcaaaagaagcattgcaggtctgaaggcagaaaagaaaatgggatgatgtgaaacccagcaccccacacctgactccccaccaagtgcaccatgaagcaaaggcaatttctggccatcacatgacctccctttataaagacagctttagagtttggctcaggctccctacccagaatgccaagaggctgctcttatttcccatggtacctccttacgggacacttgagtgggaatcactggtactaactaaatgactactggaaatgtacccaggacatggcaagctaagctctatacccctctacacaatgaagagttacacatttgctcatccttagacattaagaattgactttaggtgcattagctataatgcacagaattacatttacatgaatttacagatgagttattggcatataaaccagccttcctgttctgtatccctggg

SEQ ID NO: 10625 - DNA, 35330 bp, Homo sapiens
  misc_feature (1)...(35330): n = A,T,C or G, or insertion/deletion polymorphism (see Tables 1-2)
aaatatatataattttttgtcaattaaaacataaataaattaatttaaaaactataatccaagaagactttaaataatagaatacttgaatcaacatggcaaggtgtcaccatgtactagccacaatgatccagaatagcctcagaaatctgaagtttagtgccctttcactcagatacttacttctacattttaccatctgtcactaaaaattttcaagaagtgaactcttcccaagttaagacactggacacattaactgatgggtataattctaaagaatgtatatttaatgggagagttataagagacttcctctggatagaagactatctttgaatgcttcatgtcatagttattgcaactatatttttggctaatggacttttcttggtgatagatattgcacttagcacctaaacccaacccttgcatttcagataaccttctgtactgcatgatttaggcatcctaggtttgttaggatgaactagaggttgggtggggcacatattgctgatgacagcatcagttatggactcactatgagcatcagctgtggccaaagtatggaaatgatgcaggagctggccaataccatgacatcagaggtggggagtattcttttaggatcctcccatctgcattcgccatcttgaaggggcatgtctggagcataggaagagaacaaataatgcaaaagcagtgggaatcataagacttgcatttggtcaccaacaggccagacctcatctgtgattctctgatgactaggacttaacattttggagatccagattttggcagaataggcatttgattcctcctatatctccatgaggttcaaagtcttccaggattcctcaccaccctattgtaaataatatggaggtatacagatgcttccatataagacagagcacacagtcataaccaaatgggcaccctttccagctgcaatattctaggtgtagcctctgagttccctggggcagggtaggctgtctagagagctctctggaacataggtcaggacaccagtgattggagcaactgcttctagtaaaattcatagttcatggcacttgcaccagtgacaggaaatagagcagtttggaacccatagtgtgtttacatggcaaagtgctctggatttggacatggaagtttactctccatgtggccactggcaggtaactttgcttctcattgtttttctgtttgtttgtttattttgagatggagtctccctctgtcacccaggctggagtgcagtggtgcaatctcggctcactgcaacctctgcctcccaggttcaagcgattctcctgcctcagcctcctgagtagctgggactacaggtgtgcgccaccacacctggctaatttttatatttttagtagagatgaggtttcaccacattggccaggctggtctcaaactcctgacctcaggtgatccacctgcctcggcctcccaaaatgctggaattacaggcatgagccactgtgcctggctaactttgcctctcttaatgcagatatacgttagagatcaagtttggatccaactgccacaataaagagaatcacacatatttttggtttcctgctgcatataaaagttatgtttacactacaccataatctattaagtgtgcaatagtattatatgttaaaaacagtgtatataattaaaagtattttactgctaaaaatgctagtgatcatctgatcttcagtgagtcataattgttttgctggtagagagtcttgcctcaatgttgatggctgctgactgaccagggtggtggttactaaagtggctatggaaatttcttaaaataagacaacaataaagtttgctgcatcagttgactatttctttcatgaaagatttctctgtagcatgtgatgttgtttgaatttctttccacggaagaatttccttgaaaattggagtcaatcttctcaaatcccgctactgctttatcataagtttatgtaacattttaaatcctttgttgtcatttcaacagtctaatgatacaactttcatggatgaagagttgctattttttttttttaagagacagggtcttgtcttaacacccaggctagagtgcagtggcaaggatcatagctcactgcagcctcaaactcctgggttcaagtgatcctcctgccccagcctcccaagtagcaaaaatgttttcagcatccttaccaggagaagtttctaattcaagaagccactttcattgctcatccataagaagcaactccttgactgggtgccatggcttatgcctataataatctcagcacttcgggaggccgaggtaggaggggatcacttgaggccaggaacttgagatcagcctggggaacttagctagaccttgtctttccaaaaaaaaaaaaaaaaaaagccaagggcagtagtgcatgcctgtagttctagctaccagggaagctgaggtgggagcatagctcaagccaaggagttcaagactgcagtgagctctgatcatgccactgtactccagcctgggcaactgagtgagatcctatctcttaaaaaaaaaagaagtaacccttcatccattcaagttttatcatgagattccagcaattcaatcatgttttcaggctcaacttctaactctagttctcttgctatttctatcacatctgcagtgggctcctctatgaagtcttgaaactctcaaagtcagccatgagagttggaatcaatttcttccaaactcctgttagtgatgatattttcacctcctcctgtcgatcatgaatgttcttaatggcatctagaatggtgaatcatttccagaaggttttcaatttattttgcccagatccatcagaagaatcactatctatgtcacctatagccttataagatgtatttcttaaacaatgagacttgaaagtcaagatcacttcttgagccatgggctgtagaatgtatattgtgttagcaggcatgaaaacaatattaatctccttgtacatctccattggagctcttgggtgaccaggcacgttgtcaatgggagtagtattttgaatgagtattttttatttgagcagtaggtgtctaggtgtcaaaagtagactcaaaatgtgtctaggtgtgaaaagtagactcaaaatattcagtgaaccatgctgtaaatagatgtgctatcatcaagatggtgtcttatttataggcatagtagatttagcagaattctgaagggacttggaattttcagaatggtaaatgatcatcattacctttaacttaaagtcaccagctgcattagcccctaacaagagagtcagcctatcctttcaagtttcgaagccaggcattgacttttgctctctagttatgaaagtcttagatggcatcttcttcctacagaaggcttatttttccacactgaagatctattgtttaatttagacatcttcatcactttgcaagatcttctgggtaacttgctgcaacttctaccttagcacttgctgcttcactttgcacttttatattacggagatggcttctttctttaaacctcatgaaataatttctgctaacttccaacttttcttctgcagctttctcacctctttcagccttcataatattggagggagctagagcctttctctggttaggtttttggcttaagggaatgtggtggctagtttgatcttctgcccagaccactaaaattttctccatatcagcaataaggttgttttgctttcttatcatccatgtgttcactagagtagaacttttaatttccctcaacaacttttcctttgcattcatatcttggctaactggcacaagaggcctagcttttggcatatctttgctgttgacatgccttcctaactgtaatcatttccagcttttcatttaaagtgagagacatagaacccttcctatcacttgaacacgtagagaccattgtggagttattaattggcctaattttaatattgttatgtctcaggaaatagagaggcctgaggagagggagagagatggggaaatggccagttgttggagcagtcagaacacacacacaacatttatccattaatcattttttaggggcgcagttcatagtgtcccaaaacaattacaacagtaataaccaagattatggatgacagatcatcacaacagatatgataataaaacaagtttgaaattttttttttgagatggagtttcgctcttgttgcccaggctgcagtgctatggcaagatctcagctcactgcaaccttcacctcccaggttcaagcgattctcttgcctcagtctcccaagtaactgggattacaggcatgcgccaccacactcagctaattttgtatttttattaaagacggagtttcaccatgttggtcaggctggtctcgaactcctgacctcaggtgattcacctgccttggcctcccgagtgctgagattgcaggcatgagccactgcgcctagcaagtttgaaatattttgagaattaccaaaatgtgacacagagacatgaagtaagcacatgctgttagaaaaatggtgccagatgacttgctcgatgcagagttgccacaaaccttcaatttgtatgaaacgctatagctgtgaagtgcaatagagcaaggctcaataaaacaagatatgcctgtagtgtctagtaggcatgtttgggggtggcttgagaggatgcttggtaagggaggctatccaaggaaacaccaaataaggtctcttggagatcatgcccttacagcccacagagtacatctgatggtgtctgtgttgatggttgatcatgatctctttcctaagacctccttgtccaagggaagctcttgagaaaggtgaagacaagcctgagatacccagagcccggtgatgcctcagaggtggctcacagcctctggtctgatgaaggaagttttcttctctgatgtctctttcattgaatggcccagcaagaagcactagactggagcataacactgcacacctgcctctgggcatggcctatcctcctgaaacctcttcacatttggcttcatgtcccagttagctacatgtgacccaaccctggatctagccccaggatcatttcagaggagttgcgattgcagagtgggagattctgtaccacactgattaatttccaccaactcacagtaggacgacagggaagacccatagccactctgtgccaattactccttagcaacagcagcatgaaccacctgttccacatcccttagtgttcctcttgatctaaagaaaagagaatgaaccagcccctaaggaagagggcttgggaaagataaggactattcagttaatggaaggtgctggagtgtcagatcctgaggcccaaaatgggtcccatcagaggagtagccatattggtgggtgctggataggaggagctttggggttggtgcaggcactcactctcactaggatgcctctggtctcaggtaatggagagaagtgaggaaaaagtgatcctagaggaaacaccctcttccagtcacatcatatcctctcactctcttgtggccttgggcttgctggacttcctgggactcattatcctaatgatagacagtaatctgaaccttacagagagattggggagcataggatggcggtgcaccaaggctaaggagaccaaagcagtgcttgggggcctcccactctttatctcgggttctaactgccacccatctcatgcttaatgggtccttctgactccagggtgagaaatgttctccttagcatcaggagatgctgcacatgagcagttcctccccctgggagtactggttcagtgagcaaaacagcaaggggctgggcatcctgagggctggcagggatacgtgggccaaagagggagagggagggtagagaagcatagccagggagagaaattgaacaccaggacgcaagacaagtggggcatctgtaggggccacagtgagctctcaatgatcatctgtagtggcagcaaaagaggtaggatccctgggcatttgttctggtttatttgacagggacaaggggttcagacagtagagagggcggcattcctgttgatgttcttatgctggtgacttgaggtccttgtgcttcggatgtgggcacagtcttggatagaggagttgggaagcaggatgcacatccnagcccactctcccactcacaggatgctcatgcaaacattcccacagtaggtagaacagcatatgttatttgcttgacaatctcggtgagattcacataagtgtttgcatagatatagtttaggntgctgctggcagactttgatttctggggatagctgtgtttctgacaaggagaatagaanggtaaataaacgcagtttcctagagaacatttttctcaagctgaagcctcctccaagacccttgaacccaggtctcagtcatgatactcctggattccttcttcatagaactaccttcctgcccatcaccaaatcctagtgattggtcatattttaaatcctgtctctccactgtacaccttaccccattagaccacaatgcctgggcttcctggaccttctccacacaccagcaatcagaactccatctcccttactagtcatggccttggtgaagtcaccaccaaagaatctacagtctgatcctgagagctcaaagaagcatgagacatctttcaaactctctcctagtctctgaatagtagaattcagagatgaggatcaacwtgcctcttgtctctccctctcttctgctcactgtcactgtctctagtcttcctgccccttctttagttccctttccaccaccactctccttgcccctttgatgataaccttaanttggctctgtgtaccccaacttttgcttgtcttatgtcctatttccctacacttatacccattctacacctacacctaccgtcataaccacttctgaatctttactcctcacaaatgtgcataaatcaaataataattgtcttgctttccccactggattctcagccctggtgcgcctttcactatgggatgtgccatttctctctaagtattgagaaggaacagcaaaatatgcaggtttcttcntcattcccattactattcccagggccagctaaggggctggagggccatggtttagggacagtccagagtctacacaacattgtggtcagagctggatatgcagagagtttccaactcctaggtcctactcagactggacacaggccctccattccccctacccaattccccctcacccatccagcagcccatcacctactctgcatcctcttcttgtcacggtatcctccctgggcctgcagcagcagcacacagagaaccaggacaggcagcagagtctggggtgccatgactctgatcagatcgtgagccctatgtctggccaggttgtcacagacttccctgcagagctgtctacggagagtgaaggaaggaaagaaggaatgatctttagctcctcactgcctctactggccaagtcggagcagagcaagagagtccttcctctttttgcttgcccctggccttgtcgttcgtcatgtgggatagggcttccgcaggaatgacgcctcctcctttcacatarccagtcttgtgttcttgccgatagaatgaaagatatcatttatttctgctttctaattacaaaatgttttatggaaaaaagaaaagaaaaaatatattgttaaaaagagttgcttagaattaactgatgtttcattgcattatcttttagtttctctccatatttaatataaacaatccttttaatataaacaacttttgttatctatttttgccacccttatttaatcatgtaagtatttctcaaaatgtggattttcataattgcacagctctcaaatgctaataatcaagtatttgtattgtactaattactaataatctagagaatgtcatattatttttatttataaatctttgatttctttagactaagagagctagaattcctgagtgaaagagtaagtagctgtttcatatataaatgtatataaacacatacacacatatacatatacaaatttaaacacacataaacacacagaaagagagactattgtagggcatgggacagaagggctagtggagaaacatagtaaatatcttagagctcagacagggggagrgrcctatcagtcaaaggcttggcaggctgtccaggaggaggtggtcactgaccttgaatatcatgaaggaaatgaactctcagaagtgaagatgtttcttcttccctaacaggagaaagaggggacaacctagggtcactggactcccagtaggcatgcaagctgggaagaagatcaccctcttcctctgatgatgataatcttctaaagatttgaacctctttctgacattctgaactcctaatgcagactccttcagtccacagttgtaatttacattcaaaggaagctctctagcctttcccccatatctcaccttatgcaccttcctctgtatcctttgcgatatcctttataattcaaaaattctgatatttgtacctatagtttacagagtggtatttgacccttcccaaaggctctctctttcctagtttttctttttgtccactcataaatgaacaatttagagactggacactgtcataactatcctagcaaagaggggttatatagaggagaatcatcatctcaaatagaagctgcattttccttacccaagcatcttgcagccagtgccacaatgtaaatattttggctaacagacttgtcactactaggtcaagaccctaagaagatggcaagtctctttcacactctttttcttttccaccagctcagtatagatgacaacaaggttctagagcctagtgaagccaaaaggtgaaaggagcctgggtcsttgacttcttttatcacatgaaaaaaggatacccattgttttagaatactcattttgaattattatttgagcaagaaataaaaagtatattgtatttcagttattatgtgatggaggctttctgttaaagcagtctagtcaacattgtggcaggctcaagtactgacatttataaggggaaagatttatgggtatatagaaggtctatactttatacattcaaattattgatagagtagtaaatttagtaaagagatgggtaatttgaacattatgattaataagcttgacttaattaaaatatacagaagtctgcatrgaaaaactagaggaayacatttttctcaagcacaaataaaacatgtacaaaaagtgactatacattaggctataaaaaaagtctgaacaaaattttaaagaattacatcacaaaggacatagtttcagactataatggaaataattagaaattagtctaaaaaaagacaattactcaaaactgaacagaaatttcaaattaaaatatataagtcagagcttccaggtggctaccactgaacacttagaggttgttggagagcagcatgctcatggagggcatggaagctctctagcctttccccatatctcaccttatgcacctcttcctctgtatcctttgtgatatcctttataattcaaaaacctagaggaaatggataaattcttgaacacatacaacctaccacactgaaccaaaaagaaacagaagaacctgaacagacgaataacaagtaaggagattgaatcagtaataaaaagtctcccctgaaacaaaagtccagaaccatatggctttaccaccaaattctatgaccctttaaatataaattaataccaattcttctcaaactattccaaaaaattgatgcggcaggaattcttcttagctcamttttatgaggcccrcataaccttaataccaaaaccagacaataacaagacagcataaagaaacccacaggccaatattcctgatgaaaataggtgcaaaaatcctcaacaaaatactaacaaacccaattcaacaacacatcaaaaagataatgtggcatgatcaartgggatttatcatacgaatgcaagaatggctcaatgtacacaaatcaataaatgtgatacttcacatcaacagaatcagggacaaaaccatacggtaatctcagtagatacagaaaaagcatttgataaaattcaacaccactttatgataaaaactttcaataaattatgtatgaaaggaaagcacctccacataataaagatcatatatgacaaacccacagctaacaatatacttaacggtgaaaagctgaaaacttttcctctaagaactgaaacaagatatagaggaaaggctagggagcctccatgcccctccatgagcatgctgctcactttacccactcttattcaacgtagtactggaagtcctagttagatcaatcatgaaagagaaaacaataaaggacatcaaaattggaaaagaggaagtcacatttaccctgtttgcagacaagctcttatgtagagaaaaacttagactctaccaagaaacctgtagaactcataaagaaattcagtaaagttacaggatacaaaataaacatacaagtcagtggtgtttctatgcacaatgaactagttaaaaaaagagaccaagagggcaatcccatttataacagctacaaataaatacctaggaataaatttaaccaaggagataaaagacttctacattgaaaactacaaaacactgataaaagaaattgaagaggatacaaacaaatggaaaaacttcccatgctcatggatggaaygagttaatattgttaaaattaccatactaccctaaaccatctacagagtcaatgtccctattaaaataccagtgacattcttcacagtaatataaaataaatcctaaaatatgtatggaaccacaaacatcctagaatagccaaagcaatccttaacaaaaagaacaaagctggagggaacaggtttcaagacttctaaatatactaccaagctctagtaaccaaaatagcatagcactggcataaaaacagacacgtagactaatggaatagaatagagaacttagggccaggtgcagtggctcatgcctataatcccagcactttgggagaccgaggcaggtggatcacatgaggtcaggtgttcgagatcagcctggccaacatagcaaaaccccatctctactaaaagtacaaaaattagacgaacatggtggtgcatacctgtagtcccagctactctactctggaggctgaggcaggagaatcacttgaacctgggaggcagaggttgcagtgagccaagattgtgccactgcactccagcctgggcaacaagagcaagactctgtctcaaaaaaaaaaaaaaaaaaaaaaaaaaaaagaatagagaacctagaaataaatccatgcgtcgatagccaactgctttttgacaaagatgccaagaacattcactggggaaaggatagtctcttcagtaaatggtgctaggaaaactggatatycatatgcagaataatgaaattagaccttcgcctctcaccctatacaaaaatcagctaaaaatggattaaagatctaaaggtaaaacctgaaactgtaaaactactagaagaaaacacaggggaaatacttcaggacattttcatgatcttacaaaaagatttttaatataagatctcacaaccatgggcaacaaaagcaaaaataggtaaattggattatatcaaactaaaaagctgctgcacagcaaaggaaacaatcgacacattgaaaagacaatctacagaatgagagaaaatattttcaaagtatttgatgtggtttggctctgtgtctccacccaaatctcatcttgaactctaatccccatgtgtggagtgagggacctggcaggaggtgattggatcgtaagggcagtttcccccatgctgttcttatgatagcgagggagttgtcatgagatatgattgtttaaaaggtgcagtttcccctgcatgagctctctctcctgccaccatgtaggacgtgccttgcttccccttcgccttctgacatgatttaaagtctcctgaggcctccccagccatgtggaactgtgagtaaattaaacctcttttgtttataaattacccagtctcaggtagtatcttcatagcaatctgagaacagactaatacattattcatttgacaggggattaatatccagaatatacaagaaactcaaacatctcaacagcaaaaacacaaacaatccaatttaaaaaatgggcaaatgatctgaacagacaattcacaaaagaagacatacaaatgaccaacaaatatatgaaaaaaatgacttcattgttctctcaacatcactaatcatcggggaaatgcaagtgagaactataatgaggtatcatctcactccagtcaggatcgctacaataacaacaaaatgacaaaaaataacaagtgctgttgaccttgtggagaaaggggaactgttatacactgttggtgggaatataaattagtacagtcactatggagaatggtattgcaatttctcaaaagcctacacatagaactccactaccatatgacccagcaatcccactactaggtatttatccaaaggaaagkaaatcagcatatcaacatatgtacccccatgtttattgcagcactattcacaatagccgagatacagactcaacctaggtgtctaacaaccgaggaatggagaaagaaactatgatacaaatatacaacacaatcctattcagccacaaaaaggaataaaatcccgtggttcatggcaccatggctgaaactggaggacattatgttctgtgaaatagccaggaacagaaaattaaacaacacatagtctcactcatatctggagaaaagtcgacctcatggaagtaaaaagtagaacagcaggtactagaagctaggaagcatagtgggaaggggaagatagggagagatttttttgttttttgagacagagtcttgctctgtcgcctaggctggagtgcggtgggacgatctcgactcactgcaacttccgcctcccaggttcaagccattctcctgcctcagcctcctgagtagctgggactacaggcacgtgccaccatgcctggctaatttttgtatttttagtagagacgggtgtttcaccatgctggccaggctggtcttgaactcctgaccttgtgatccacctgcctcagcctcccaatgtgctgggataacaggcgtgagccactgtgcccagtgggagagatttgttaaaggatacaacgtcatagctagacaggaggaataagttctagtgttctatagcactgtaggatgagcatacataagaataatataatttcaaatagctagaaggaagatattgaatgttcccaacacaaagaaatgataaatgtttgagatgacgggtatgctaattaccctgatctgatcactatacattatacatattgaaacatcactatgtatcacataaatatgtaaaattactacttgtcaatttaaaaacttttttttttttgagatggagtttctctcttgttgcccaggctggagtgaagtggcatgatctcggctcactgcaacctccgccccctgagttaaagtgattctcctgcctcaacctcctgagtagctgggattacaggtgcccgccaccacacctggctaacttttgtattttcagtagagacggatttttaccatgttggccactcctgacctcaggtggtccacctgcctcggcctcccaaagtgttaggattacaggcatgagccaccacgcctggcctaaaaacatccaaaacctacaccacagatctggtttttctgcacaaacagaaaagaataagaggagttgcttgatgtgccatctgaaataaagatgcaacaacatccagattaattytgggatctttgtaacaatccccaaatccttgaagcttccatctgtttgctattttcctggcctaattttgtttttcttggtgaataacygtatgaccattataatgaaatgtgtcagcttgggctcctctgaatttctctctgggtgttttacccagatcttcatagctagattatcagctggtcccatccattagtttccccctcactcctgagccatttctcaaacatgcacacttagcttaacttaacctaaactgttttaggtttgacaatacaaatctgtttaggtttgcatcacctcccccatcaagttgagctggttaatgggatgagaataacaaacctatgcttccttttggccttcaaatcaaacctagcagtgaacatcacatttacataaaatgtttctgcactcacactgaatgactgatagcaaataatacagaattaattaaaatcatgcataaaatagacataattaatatatgtaaatagattagagtagatattggcatcatttatttccagattttgatggctatgttgtgtttatgtagaagaacttgtctttctttagagaaaatgtacatgacagcattgggggtgattgggcaccattaagtaactgactctcaaatgtttcagggaaaagaagttatttttactgtactttcagtttttctgctactttaagattgtttcaaaataaaaaggaagattaaggtatgtggaagcgagaggtataagtgtaaacatccaaatagtagttctaaaagaaaaagatttagcaggttaaaaaatatttaatgaaacaatgcattgaagttgccccaaatgaaagaactattaaagatctcagactggaaatgatcataaaagaatagagaaagaaaacttgcatatctagccacattataaaatgtaggaacatcaaatacaaataaattttaaaatattctatagagaaagattagatcacccaaagaagaagaataatcagactgagattagactttcaaatagtgacaataggacaagaaatcaatagagtagcattttcaagatgtttaaggtaaaaacttttcaagtgaaaatttacatcctgaactatgagggcacaataaaattgttctaagacatatgaaacatcagaatgcttaccacacaaagaccctttttgaaagcctgcttgaaggatgtgctccactaggaaaataaatctagaaccactatacaaaagtatatgggcaatataagtgaatatgctggggattcccaacgctatccccaggttcagtgctttactaggaggactcacaggactcagcacatggtttttcttgcagctatgatttattacagtgaaagactacaaagcaaagtcaacaaagggaaaaggtgcaaggggcaaagtccagaggaaatcaggtgcatgcttccaagtgtcttttcccaatgaccagtggagccacacagggcatgctgaattcccccatcgatcagttgtgacaacatgtgtgaagtgttgtctaccagggaagctcatgagagacaaacacagtgtccaaggtttctattgggggctggtcatatagcagcttctgcctagcatgtaccaaaattccagactcccaaaataaaagcagatatctaccataaaccaagttgtttgtacaaatggttgaggcacagtgagccatacttgtttgttctgagaacaatgggaactttctcaaaattcaggcttatggatgccaaccaagagccaaccttgtaagcaggacttttaaagatagcaactgcaggcctgccatgtcaacaattttgcatagtgagaagtcaattcataaagtttggtgttgtctaaaaatttagggattaagaagaaagtggaaggaagagatagaataagagaacaccaatatctattataatcatgaactaaaaactgtctagaatatatcaaggtcagaaggtaaactaaagggaacagttagcatactgaaagagctgtcttgttttaggaaaacttagaagttttagaaatctttaagtctatgtggaaaagtaatgtgggcttaaataaaaaatcctctaagggatcagaatacaataatggcttttaaaatagtagaagatatttcattcatccaatagatgtctgaagagagaaataaaaacaaatatttaaaaagcatgataaattaaaaatatgaaataagatgccagagataggccctaacataagattgttttctataagaatatttattaaaggtaaatgggttagagacatttattaaaagacagagattctcagattaaaatttttaaatgattcaacaatgtgtaatttcccaaaagtaaacaagtaatttaaaataaaggaataaaaaaggatgccccaccaaatatgaattaaaaagaaagatgatataacaatttaaatatcataatataattaacattcaacatagaggacatgacacaatttagacaagaatattttatactggtaaagaaaaacagatcaagaaaccttaacaattgtatatatgtgtacacacacacatacacacaaaatggcctcaataaatgaaaataaattatctatacaaagttgtagattgagcagttttttttgtttgagacagagtatcactctatcacccaggctggagtacagcggtgctctcttggctcactgcaatctctgcctcctgggttcaagtgattctcatgcctcagcctcccgaatagctgggattacaggtgtgtgccaccgcacccagctaatttttgtaattttagtggagacggggtttctccatgttggccaggctggtcttgaactcctggcctcaagcaatccacccacctctgcctccaaaagtgctggtgtgagccatcacacccggcccaattgagcaggtttgagtacttagttacaatgacttagattacaaagaaagcctaaaaaattccaaatgactaatgccatacaatattttcttttgaaaatgcaggaaaatagaaaatcaataccaaaagcaaatcccatatgtctgaaaaacaaataacgctacttaataatccatggctctcatacttaaaaatacttacaaagtatttaaactggatgatcataactatacttacatgcctgycttcctccctcttttgtgctatttttctttccttttcttttttgttgagacagagtctcgctctgtgacccaggctatagtgcaatggcatgatctcgactcactgcaacctccgcctcctgggttcaagtaattctcctgcctcagcctcctgagtagctgggattataggcacccaccaccacggctggctaatttttcgtatttttggtagagacgaggtttcaccatgttggtcaggctgttctcaaactcctgacctctggtaatccaccygcttcagcctcccaaagtgctgggattacaggcatgagccaccacgcccagctgtgctatttttcatgcatgttacatctttatgttttaagcctatcaatacaattgaatgattataatcattgttttatacagttgtcattccaatctgttaaaaattattaatatcagattttatatttacctacataattacttttatctgttctctttgtttcttaatgtagatctcattactacctgatgtcttttctttttagctttaaagcttttctctagtatttcttgaaaggcagacctggtagcaacaaattctctcagtctttgtttttctgggaatgtctttattttaccttcatcaggaaaggatagctttgctngatatagaattattggatacagtatttcagatactgcactgggaaattcttaactaaaatagaagagtntacagattgtcctaaattctgcatagcttgatccagaatcatgagtggcaggagtccttggcactcctgggctactcattagtgactgtgctcctcagctctccagcagctgggccacacagagcaaaagactatgatcgtcatgcatggaacatcattttgctgccatataaataaatatcttagaaatccataattcaatcactctaggtttggcaccattttcagtccctgtcaaaatttccttcagtttgttcccacacctttttaccttggttccaaagctctttgtntctgtactggtccaccttcctcagccaagtccctggagtccagacatatacttcctgcccctcagtgcactcaacatacaggcatatctcattttattacactttgctttattaattaatttttgctttatggatgttgcatgtttyacaaattgaaggtttgcagcaaccctgcattgagcaaatcttttggcactatttttccaacagcatgttctcacttatgtctttgtgtcacattttagtaattctcaaaatgtttcaaactttattattattattcttatcattatatctgtaaggtgatctgtgatcaatgatttttgttgttactattgtaattgctttggagtgccaccagctgtgcccataggacatggcgaacaataaatgtgtgtgtgctctgactggtcatttgccagtcttgctccctcttctcagcccctttattccctgagacacaacaatattgaaattgggccaattaataaccccgcaacagactctaaatgttcaagtgaaaggaagagtcccacatttctcactttaaataaaaaactagaaaaataattaatcttagtgaggaaggcatgttaacagctgagataggctgaaagctaggcctcttgtaccaaacagccaagttgtgaatgcaaaggaaaagttattgatggaaattaaaagttctactccgggaacacaggaacgataagaaagcaaaacagctctattgctgatatggagaaggttttagtgatctagacagaagatcaaaccagccacaacattcccttaagccaaaacctcatccagagaaagaccccaactcttcaattttatgaangctgagagaggtgaggaagctgcagcagaaaagtttgaagctagcagaggttggttcatgagggttaaggaaagaagccctctctaaaacacaaaagggcaatgtgaagtagcaagtgctgatggagaagctacacagcaagttatccagaagatctagctaagatactgttggccctttaacaacacagatttgaactgtgcgggttcattatacatcctcaaggaactttatgatgatccacttccatttaataaatagtaaatatgtttttcttccttatgattttcttaataacattttttctctagcttactttctggtaagagtaaatggtacacaaaatacatatagcatacaaaatatgtgttaatcaaatgtttatgttattagtaaggcttctggtcaacagtaggctattagtcaggcatgatggtgcacacctatactttcagctactcaggaggttgagtgggggaagattgtttgagccagtagtttgagaccagcctggggaacatagtgagaccccatctcaataaaaagaatatttcaggcatggtggtgtgtgtctgtagtcctagctactcgggaggatgaggaaggaggatcgcttggagcggggagtttgagacaagcctagggaacatagcaagaccctgtctctaaaattaaaaataaaacagtgggctattagtagttgggtttttgaggagtcaaaagttatacatggattttctttttaaattttttttgagatggagtctcgctctgtcacccaggctagagtgcagtggcacaatctgtgctcactgcaacctctgccacctgggtccaagtgattctcctgcctcagccttctgagtagctgggcctactggtgcctgccaccatgccaggctaatttttgtatttttagtasagatggggtttcaccatattggccaggctggtctcgaaattctgaccttgtgatctgcctgctttggcctcccaaagtgctgggattacaggcgtgagccactgcacttggcctatacatagatttttaactgtgcaggagttcagtacccctaactcccattttgttcaagggtcaactgtaattgatgaaggtggctacaatagacatcagattttcaatgaagacacaacagccttatattggaagaagatgccatctagaactttcatagatagaagtcaatgcctggcttcaaaacttcaaaagacagactgactttcttgctaggggccaatgcagctggtgacttaaagtaataatgagccaaagctcatttatcatttcaaaaatcttagagcccttacaaactatgctaactctgctcttgctctgctctataaatgaaacagcaaagactgtgtgacagcatggtatactgaatattttaagcccactgttgaggcctacggctcagaaaaaaagattttggtcactcaagagctctgatggagctatatgaagagatcaatgttttcatgcctgctaacaacattcattcttcagcccatggaccaagagataattttgactttcaagtcaaaattatttaaaacatacattttggaaggctatagctaccatagatagtaatttccctgatggatctgggcaaagtaaattaaaaaattcctggaaaggattcactattctacataccatgattcatggaaggaggtcaacatggcagtattaacaggagtctggaagaagttgattccaatccttataaatgactgagggtttcaagacttcagtggaggaagtcactgcaaatgtgatgaaaatagcaacagtgagaattagaagtgcagcctgaagatctgactgaattgctgcaatctcatgagaaaacttgagtggatgaggagttgcttcttatagatgancaaagaaagtggtttctttgaatggaatctgctcctggtgaagatgctgtgaacattgttggaatgatgacaaaggattcagaatattgcataaacttagataaaccagcagcacagtttgagaggattgaccgaaattttgaaagaaattctattgtgtataaaatgctatcaagcagcgttgcatgctatggagaaatctttcttgaaaggatcaatcaattgatgtggcaaacatcattgttcttattttaataaattgccacagctaccccaaccctcagcaaccaccaccctgatcagtcaacaaccatcaacattgagggaagaccctccaccagcaaaaagatgatgacttgttgaaggctcagataatcattagcaatttttagtagtaaagtattttaaaattatggtatgcacattnttttttatacataatgctattgaacacttgacagactacagcatagtgtaaacatacctttttaatattttaataagtaataatgaaattcatcataagaaaactattagaaactgtttagaatatgaaagaggtacagttgtatactgaaacatatacagatttgtatcagaagtttgcaaattttactagctttttcagagaaacaactttcaactattaaatatttcattttctagtttaaataaatatataaataaaagacttcaggaaaacatacttttcatatgcactgggaaaccaaaaaagtgcacttggctcactttattgcaatattaccttttttatggtagcctgaaactgaacctgcaatatctccgaggtatgcctgtatcctaggaagaattttatattgacatctcctgtcactgcgtataatattcctgcagacaggctttgagagaaggtttaccccttggaagtccctgcctcctgcccacttgactgttctcttttctcatgagctagtgatctccaaatcatgtgtattgtgtgcccaatataatgcccttccctgacatttggtgaacaaatccctctgcacctcaaccaacaagctcatggcaagaacttggtgctggatttggtcacgtcgcttccttcatttgntaggtggtcatctactttttctaaaattcttcctattcagtctctttttagctacataaaagtcagagggcatttggtgggagatcttgttatgattttattggtaaaagagaatcaatactgagaaagatagaatgttaaataggacagacaagaggtcaaaggtcaatgtagactgttcccaacttcctacatatgaatggactgagatgtatttgagagactttgggaacatgtactttgggtctgctgggggtggcctgagctgcaatccaggtacacaatgttcttcccagcttwtcagaggatcccacctgcaccttagaaaattgagtacatctggatgggtgaatatcaaaggaaagaatctgtgatacagccaacatgtagtttctgggtagaaattaaaaatnggtcacaaccaaaatcaccattaagttcctggcctttgaacattgtttttctnctcttctgcccccagttcgagccccacttcaaacaacttcataataaaaggccagacaaaagagctgtcagccagttactacagacactcaatgcagacaccttcagaggtaggtggggataaaggtcttgagacatgagcttctatttgtggcttgcttggattaattcctagcccagatggtgtcactattcctgtgaggtkgggattattgtttcttttgttcaaataagaaaattgagagggggtgacatgagctgtctgaggttccataggtaaaagggacagaaactaaagatttcagcattcctgacactaaatccagcactctgtcctctttaacattatctggaaagccagattggtggagagcagtagttctgtgtctttctgatcctgggggatctttgaattgtcctgcagtttgtctcaggatgaccaaaaaattcacagcactctgtatatgagaagttgagaagtacccagcctgggcataatgatgtttcttttgtctgggatcatttagtacacttgagggtgtgcaaaacaggagactaggcatcctcagattcctgaacacctttaargggcaaggggaaagaaagaaagaaagaaaactagagtaagaatgaggccgtgtgaatgaacagatttcaaagctctggaaaacttgggtctagggtggtattttggaatacaaagaaacagcctcatggaatccaatgctttggatttatggtgttcctgtcactgtatatcagtattcctccttctttatgcaaagggttggtaccnggaatccagaggcctnctgcaatctatgcccactttcacccacttacctcatccctcacatccctggctgtaagcagataacagagtatcttcatggttcacctgtcttgccatgtgctggtatattcacataatcagaagaacactctgaggttctcaaggactcaggctcaaggaatgagtatcttgccattgctagctagcaagagcaggagattagggagagaaacgaaaggagaagagaagcccttaaattgtagatcagatcagatatttgtgtgtgtgggggttctactcttagatgcttattcctgctctccaagcttctccattaagaacctgtgtctctgccagcttacctaagcatgacttgatgaagttgccaagctaagatgttgctgcttttgcctctgctcgaatctcttaaaagtgatttgtctaaaagtcaatacatctaatgacatgtgcctaaaacttgtatttttcaccttccaaatttcacagaagctaagaggagaatacattttcaaagtctcctctgaaaaatttggcagctttaaaatttttctagtattacctctgcttttgagcagagtcattttggtggattcatctagagcagcattgttcagtagaactttctgtgatgatggaaaggctccgcgcctgagaaataaggaatgttaaataggacacacaagaagtcaaaggttgatgtagactattcccatcgtcctatgtataaatggaatgagaagcatcagagaaagactttggggacaatagccactaactacatgtgaccattgaatacttgaaatgactggaaactgaattttgatttaatttaatgagtttgaacagtcataagtggctagtggctaccacattggacagcacaaagaaatctcttttgcttcattgaaaatttctgaacaaatataaagactttcaggcagagggaaaatcactgccttgttcatgcaatgatgcaattcatgtcagaattttatccttttctttgactcttattttccttcctatttggttctagaaaagtagagcaatagagaatgaggggggtagatgggagaaggctgggaagtttccattgtaattaggttcctcttccactcttctattatttatagttcaaatttttctcttttctaattatagtggcttaaacacttgaaaataatgttaaaaagtagtcttaatagtgcatatctttttttcctatttctaattttaatgggagtactttcagttttataatgtggaatgctggattttggattgcaatagttaaatttttacagtgttaagaaaatgtctatctattcctttttattaagatttttctgctgttcccatactctagtttcccttacccctcagctgtcactcagctgaaggctattttattttcttccatttccttatttttctccttaccactgattaccatctatgcatttccttatcttgtttaactagaatgccagctgtataaatgggaggatttttgtctgttttgttcaccactatattccaatacccagaacttggaatatattccaatacccagaacttggaatatagttaggcacttaataagtacttattgagtgaatgaactccccctgtctccctccacacacagaggcatagaatctaaacagattaaaatgctaagtgtaaaaaaaaaagtaaaaagaaaaaaattgtaattgaaaatagttttcaaatatccagaggaggatattctgagcttaatgctgacagttaacatttatgaagtatatactatattccaggtcctatgcttagtgtttcatacatattatttaatcttcccagtgaccctatgagatgagatgagtattgatatttttttctgtaatatggatggggaaaaccaggctctggggattatgtggctggcccaggctccacggctaggagttggtggggttgggattytaattcaagcctatctgactctggggcccatgttctttcctcttaaaatacccatcagcaaatagtgtggtgatgaaaattacctttgtatagcctagagtagaacaaggggtggagggacatgcatttgatatccggtaggtggaaatgtaacctaacccttagtgagagaaatgtggcggcaattatccaaagcctgggaaagacaatgtcttttgcctagaaatctttcttcattaactcatgctataaaaataacaatatatgtaccaaagctttaactataaggaggttcatcaggacatttttataacgagaagaaattgaaactattcaggtcttgatgatatgaggaaatgatagtaatatgtatgactgaattcttgtcatgacttgtatgatgtgagcatatttttgcctcccctgtatatttcattcagaattgttagtttatttccttgcttcttcaggaaaatttaggtaggtctccacaaattttatgtgattctccagtcatgaaacatcttctcaatataataagtaaaatgtgcaggcccatgaaattagtcacaactacataaattgttcagaactatggattcctccctccctcagaagctccagttatggaacaggatgtggtgaatctctctcccccgcctcccaccacccccactctggctctttgtaattctattcctccacccactctggactaaagcaagtttctgtctcctagggagtagagggaggacggaccaataagagtagtaggaaagttcttgtgtaatagatactatcatgagctggttctgtgcttctggtcttgactctttcgtgggagatttcaagggttcattggaaacatgaaatgtcgtctggccatttgcagttcagatacttcacaaattagagccctcttctctgctactacaggccgctttggccagatttaaagtcaccctttaaagtcttcagtcatgattcaagtctactgtgttcccatagacttctaggatcacatagcaagctcaatgagtcgtattcataaaaccttttctctcaacttggaattaggaggcagcattccggctttcacgagcaaagctttttaccaataaaatttccttcaaaatcttctctacaattcctccaactttggaccatcttagtgcattaaagttttgagtcccctaacagttcttggccatcatcttttctcaagtcctgttatctatctgtaattccctcttaaattgctttagtgccttttgtcttaggatcttcactaaaacttctttacatcatcatgtttcatatgcttcaaaataaaatatcaggacacttgatgtgtccaatttcataaaaataatgactacaacataaaagtatagacatatattgattawctctagatggtggaattgctaatgcttgtttatttcctctttgtatttttaattttacatattatataatctgaggatttattgtttttaatcagacaggagaaattcattttaataagaaataattttgcaaaggaaggggtatgtaatatgagatgagaagaaacctggggaagtcactggctagcctgggagttggttggtatgctactgggtactagaaagggaaagaataacatgatagtcataagcactttacccctgttgcttaccctgttctcctcaatccattttctacgtctagcagtattgggaaaagacttgccttctgccagaacttaacccaaatacacacagasagcaccatgaagccctggattcttctactcgtcatgttcayctctggagttgtgatgcttctgcctgtgctgggaagcttctggamcaaagatccctgtgggtggtgtgaaaagggacggggtgctctgcccagtcctgggatgtctattgtagctgatccagggcctgcatgtcaagaatcaggctttaaaggatctctccttaagtagagatattcaagcaagattaggttagatattcccaattcctttaagttttctctttcagctctgaaagcaacrctaggtatgtgaaaagggaacgtatcttttgtctatattccatcagctagcaggaaataatattttccaatatcagaccagtagaggaaaaaccaacacagagcttccctccaagcccatattttcagaacctttgtgcctcagttgggtgagcctttgatgaatgccaaaagggtaatatttaacacgttaatttagttggaggggaagagtcttttagaacatgaaaaatggaaaagacaaatcaaggctccttagtgggtcaaagtttgggttcatatgataagaaaatgtggacaacaaagacactgagcaggagggttgtgggccagggaaataaaatttatggagagactgacttcttaggtggcatcatcagggaaacaaatagaaggggagaaaaatggctgggcacggcgtcttacacctgtaatcccagcactttgggaggctgaggtgggcggatcacgaggtcaggggttcgagactgcccaaccaacatggtgaaaccccgtctctattaagatacaaaaaattagccaggcatggtggtgtgctcctgtaatcccagctactcaggaggctgaggcaggagaatcgcttgaacccgggaagtggaggttgcagtgagctgagatcgtgccgttgcactccagcctgggcgacagggcaagactctgtctcaaaaaaaaaaaaaagagaaggggaaaaaaagtaagtttctattctcccttggctcagtttcccactctgcaaattggctttggaaattggagttagaggatattgcaggccctgaaatctaaggttacatgagaataaatttggtggttggtgtcatatatggtcagggtgtcccaggtcctatctttagagtctgaaatgctgtagggacatgtagatggaggaacacaggccatgcaaggatggtcttgtgacaagacactggttataatttgaggaagggattttcttggaaggcagagaaatactttgtggcttggagctcaagtttcagaagggattgttaagcttagaaaaggtttcttgtctgagttgtgaatagacggaccctgctaacttcttccatctcagttctagatatgataagagaaactgagcagtgctgggtacagcctccatataagtactgtgagaaaaggtgtactaaaataatgacttgtgtacgtccaaatcatacatgctgctggacctactgtggaaayatctgcttagacaacgagtgagttggttggggtgggaaggctagggcctgggcatgcttcatcactggtccttaccgactattcaaaagaccgcagccacccaaatcctggttaaagaaataggcagcaaaagacaatgtcctcctatctccaaacctaggctgctcctcactgcaaaataaaccaagacaccaacatgaggtcctctacttttttcttcactcttattcagttccctttgcttccctcaacatatcacccaacagttcatacatccctcctttatccaaagttccaattactaaccccttagttgggcgtctccatgggcsctctactctcagccaggcccaaggagacctggtatctatctgtctgttcagttggcaaacttcttgggggaaattgcttaaaagtgggtaacttctgatttagcagaagaattgctgtcctttttcatctggggcctaggatgctattaattttagaaatggatttatcccaggattcttgacttttgactaacttttctcttctagagagccccttaaatcaatgctaaacccctagattctattggccgatcactactgtgggctgaaggatgaccatctggtctaagaagagtgctgcctacttccttcttgggacacccactggctctagctggtaacctttctgctatttccttgacctctttaccctgaagcttttgtcaaataaactgctacatcaacctgagggctctgcatatttttttttaacttcctccctatgacttaatttctctcattgcaatcctcagcagtcccaacagttgtttccactcaatcatgggcagaggtgcccagttctgccttcccagttagacccatgtatgaaccagtttggttaattgctggagcaaatattcaagcagatttttacaaacctcatggggtaatacagttaacccatgaaaggttattctcattcacaatgcatttcactgagggtggtcagtgggcagtcatccctgccatgattcaaggaatgtagctccttaaatctgtagctctgtcatctcgcaggggcttctctactggttcctctacattcaaccagcaatagggaaagaaaggtatcatgggggctcacacagaagcttttaaagggctaggcctagaagcaaagtttattattttaatccacattccattgaccataatacagtcatatggtcccacatatttgcaaaggagattgggaaatgtaatctagctgttttctcaagaagaacagaaaatgggatttggcaagtacttggcaatctgtgacctgtctactcatgcaaagccagactcctcaacacagacccaagaccctggcctccatatcaccctgtccaatgaaatacatttaatcaaattgttaaaagcctaggttaaggaaggaattctgaaagcagcaagagaaaagcaactcatcacatataagggaacccccatacaattatcagtggatttctcagcagataacttgcaggccaggagggagtaagacaacataatcaaagtagtgtgagaaaaaacttgccaactaagattactatacctagcaaaattatcctttaaaaataaagtactgataaaacatttcctagacaaaaactgggggagtttgtcaccactagcctgccttataagaaatctttagagggttcttgaaattgaaatgaaaggttgggcacagtggctcacacctacagtcccagcactttgggaggctgaggtgggaggattacttgaggttaggagtttgagaccagcctggccaacatggtgaaacctcatctctactaaaaaaaacacaaaagttagctgggtatgatggtgggtgcctgtaatctcagctactctggaggctgaggcaaaagaatcacttgaacccaggaaacagagtttgcagtgagctgagatcgcaccactgcagtccagcctgggcgacagagcaagactttgtctcagaaaacaaacaaacaaacaaaaacaaattaaatgaaaaagcactgaatagcaatgcaaaagcataaggaagcataaaccttattgagaaaggtaaatatataaatacagaataatgtaaaactgtgaaggtgatgcatgaattactttgaaccttaatatgaaagtaaaagataaaaatttgttaataaacacacaatataaaaagaagcaaaccctgactacaggtactcaaagtgggtggttatgggagaagtcaaagtaaagttttcgtttgcagttgaagttaccaacttaaaataggtggttataactacaagatattttacacaagctgggagctaaccacaaaggaaatatcctacaatagatataaaagataaagagaaatgagtcaaagcaaatcactacaggaaatcatcaaataacaatggaagacagaaagagagggaaaagaataaaacaaccacaacacaggcagaataagttctcacctttcagtaattaacttgaatgtaaatgcattaaattctccaaccaaaaacagagtggctgaacaattatctaaaaaagatccatcaatatgctgtctaaaatagactcacttcaaattggctagaagtaaagggacggaaaaatatatttcatgtaaatgataatcaaatgaaagtaagggtggatatacttatatcagacaaaaaagactttaataaaaaactatccctagagacaaaggaagtcattatataatgataaaagggtcaattcaacaggaataaacaattgttaagacatgtgcactcaacatcagcttaaatataaatatataaatatataaagcagatattgacagatttcaaaggagaaattgatagcaatcctgtaataggccacttcaatgctcactttcaatgatgaataggatttccagacaggtaatcaataaagaaagagctaactggagcaacactgtttaccagatggacctaacagacatatacagaacattctacccaacaacagcagaatacatattcttctcaagagcaaacagatctttctccaagattgattacgtgttagattagaaaacaaattttgacaaatttaagaagatttaaattatgtcaagtgtcttttcagaccacagtagaatgaaactagaaaccaacagcagaaacaaaactagaaaacttttaaagatgtgaaaattaaataacattctcttgaacaaccattgcttcaaggaggaataataaatacaattagaatataccttaagacaaatgaaaaggaaaacacagcataccaaaacttatggaatacagcaaaagcagtaccaagagggaaattcatagtaataaacatctacatttaaaaaagtacaaagaggccgggcgcggtggctcatgcctgtaatcccagcactttgggaggccgaggtgggtggatcacgaggtcaggagatcgagaccatcctggctaacatggcgaaaccctgtctctactaaaaatacaaaaagttagctgggcgtggtggcaggtgcctgtagtcctagctactcaggaggctgaggcaggagaatggtgtgaacctgggaggcggagcttgcagtgagctgagatcacgccactgcaccccagtctgggtgacagaccaagactctgtcccaaaaaaaaaaaaaagtacaaagagctcaaatcaataacctaactttatacctcaaagaactagaaaaagaagaaaaactaagcccacagttagcaaaaatgataaaatcagaacagacataaacaaaatagagaatagaaaaatagtaaacatgaagtcaataaaactaagaattggatttttgaaaagataaacaaaatggacaaatccttggccagcctaaaaaagaaaaaagtagagaacattcaaataagtgagaaatgaaagaggagacattacaactggtgccacagaaatttttatttaaattggctaacctagaagaaatgaataaattcttagaaacatacaatctcccaacaaagaaaaaaattctcaacaaagaaaaacccagaaccagatggttttactgaataatcctaccaaacatttaaagaatagggaatatgaatccttctcaacttcttccaaaaaaacagaatcagagaaaacttccaaattcattatatgaggccagcattaccctgataccaatgccagacaaagatactacaagaaaagaagactacaacccatatccctggtgagtattgatgcaaaagtccttaccaaaatactagtaaaccgattttaacagcacattaaaaggattatatgccacaaccaagtgggatttatcactgggttgcaaagatagttcaatacacacaagtcaataaatgtaatacaccatattaatagaatgaagaaaaaaatcatgactatcataatagacataggaaaagtatttgacaaaattaaataacctttccatgataaaaacattcaacaatatattaataagaatagaaagaatttcctcaacatcataaatttcatacatgaaaagccataactaatatcatatgccatagtgaaaaactgaaagtttttttttctaagatcagcaataaggcaaggatgtccaaactcagcacttttattctacatagtactggaagtcttatccagagcaattagacaaggaaaataaatagaatgcatctgaattggaaaagaagaagtagtaaaattatctctgcagatgacatggtcttatatgtagaaaactgtatataaaaagactccatcaaaaattattagactagcaaattcagtaaagttgcagaatagaacaaaataaacactcaaaagtcagttgcatttatatagtaacaatggacaatccaaatagattttttttaaaatcgcatttacaatagttaggaataaacttaaccaatgacttgtacactgaaaactacaaaacattgctgaacaaaattaagagagaaaaacaattggaaagatatcttgtgttcaaggattggtagacttaatattgttaaaaatatttacactacccgaaataatgtacgaacttaatgcaaaccctatcaaaatccaaatggcatttattgtagaaataggaaaaaaattctaaagttcatgtgaaatcttaaaagactccaaatagccaaaacaatcttgagaaagaagaataaagctagaggcatcacacttcttgatttcaaaacatatttccaaagtcacagtaatcaaaacagtataacactgacataaaaacagatacgtagactgatagaacagaatatagagtccagaaataagccctcatatacaaggtctaatgatctttaataagagtttcaaaactgtacattggggaaagggtagtttcttcaataaatgttgttagtatggacccttataccatacacaaaaattaactcaaaaagaagttaattttttataaacatctataaaactcccagaagaaagcaattaaaaaatcatgacattgaaaagggaaatggctttttagatatgataccaaagcacaggcaacaaaagcagaaatagagaaatagggtgacgtcaaactaaaaaacttatgaaattggagaaaatatttgcaagagagatattagataagaggttaatatctagaatatattttaaaactcctttaactcaataacagccccctgaataataaataatcaaattttaaaaatgagcaaaggattaaacagacatttctccaaagaagatacacaaatggccatttatttggaaaaatgcttaaaattattaatcatcaggaaaatgctaatcacaaccaccatgagatatcatctcatacattaggactaccactatttacacacacacacacacacacacacacacacacacacacacacacacctcccataaaacaaaaacaaaacagaagataacaagtgttggcaaggacatggggaaatgggaaccttgtgcactgttggtgggaatgaaaatggtgtagtggctctggaaaacagcatagaggttccaaacaaaattaaacatagaactaccatgtgattcagcagtcctacttcttgatatatatcgatgagaattgaaaacaggatcttgaagagatatttgcatgcccatgttcatttaagcattatgcagaaacgccaagatgtggaagcaaactaaatgtccattgatggatgcatggattttaaaaaatatggtaaacacacacccacatacatacacactagactattattcagctttcaccaagatagaaataacagctctatcaggtgacacaacaagaatgaacctggaggacattgtgctaagtaaaacaaaccagatgcagaaagacaaatgccgcatgatctcacttatttgtgggatctaatatagtcaaacccgttgaaacagatagtagagtggtgataaccaggagctggagggaggaagaagtggggagaagttgtcaaaggggtacgaagttttagttgtgcataatcaatatttttttgagatctgatgaatagcaatgtgactataattaacaatactttattgtatagttgaactttggtaagataatgtatcttaagcattctcaccaaaaaaaaaggaaaaaaagcaagaaaggaataaaggggagaaagaaaatggtaactatctgagatgatagacaaattattgtggt

SEQ ID NO: 10626 - DNA, 780759 bp, Homo sapiens
  misc_feature (1)...(780759): n = A,T,C or G, or insertion/deletion polymorphism (see Tables 1-2)
tggagtggggtcctcagaagccccgagcttcctctgaagagcctcttagatccaggctttggggcacacacttggagaatctctgctttagcaggaggtgagacacaggctgcccccagaggcctgggactgagatgacagctcctgggggtcattcctgggatctgagccttccttctcctttgctctcccttggcgtttggagatgcctttgtgcacactccagcttgccttatctgacctttgcagggttctaaggaaggaatgaaccttgttggactccagggggtcaaggggaatcctggatgttagcatgagagccccagatgagcctgagcttctgttcagtcctgccacccatcctgcctggagagcctgggtccaggaaagagacctctggaggtccttgcttttgcaaaggaagcagtttttcacacaggtaactttttggactagttgattctaagcagactgaagacccagtcctgagtcccagtttcctgactgtataatgggggtaaagaggtccttgccctggaaagatgaggcattcctatctagggtggacacacggtgtgtaatttcctttctcctcattggcccatggggcacggctccggcccgcagaagccctccctcacctgggctgcccaccatgggtgtctgcaccatgccacgggaagggtgcaaaggggcataacagtgggtcttgccctggtggctgaggcaagctggtgctggaattttccttctccctaacctcgggaaaaccaaggaatgaatcaatagaagtctcgaattaatagaatgagcaatgcaaaagattgctggcctgggaaatttaaagtaacaacccacgaggctaccaagagtaaaagtaaactaaaaaatacagtaatataaaagaacatcacataaaataaatacaagctgagaaacagtaaaaataagatgaaagaggttggcaagaaagggtagtaaggaagacaaagtagagacagagaattcacattcaactgaagagccaacacagcgctgggagaacagacgaaataagcaataaacaagggtgttttaaaaaaaaaccaaaaaacaaatctggcgtggtggctcacacctgtaatctcagcactttgggaggcgaggcaggaggattgcttgagtccaggagttcaagacagcctgggaaacatggtgaaaccccatctctacaaaaaatgaagaaaattatctgggcatggtaacatgtgcctgtggtctcagctactcaggaggctgaggtgggaggattgcttgagcccaggaggtctaggctacagtgagccatgatcacatcagtgtcctccggcttgggtgacagaacaagaccctgtctccaagaaaaaattgaaaacaggaaaaacccaatgggttaagagaggaaggcagcagtgagattttctgagcttggatcttggcagaaagtgggttccctggagcctgtagtgacggatgaggctggcagcaagaccccttcccagatgcctacagactcttccctgggggcttgaccttaagacctgggttggcctccaccctgtgtacacgggacagctgggttccatgccaaagcctgcagagaattccccaggcttggacttgatctttctttgcaggcagggcctgggccgaattgtcttccatatcactggtgggctctgtgctgaggagggaatgaggaagatagagtttttgggccctccctggagacgcatggttcaggaggggcacttctgcaggggttgggcactggtggttccacatcaggcaggcagctcctcaggattgtgcccaggaggcaggtcacttggagggccaggactccagctggcttttccttagtccagcttttggatggggtgagaaagaaggcaatggagaaaggaaaggtctgcatttctggaatgacaaagctttaagtcacaatgattgtagcttccaagtagaccactgaggcctctctctgccttgacatttcatctacagcttctgtggccaactactagcgtccagtgttgtttcagttgagattcctgatgagcccagttttatctttttgcaccctccttcaatttccttgtgtgtaaaatgggatgaccatctcctcggtaagatgtcaggtggtgagcacagtgcctgcatgtggtaagtgctaaagaaaagtaattagaatcagtaaaactgaagaactctttagaaaaagcagtcacctgtgctggctgagcttgtgtaaaagaaagatttactgactcagttttaatttctgtgaatacacctttgtgtagtgaggagcaaaccaagaggactgagccttgggcctgccagcaactcacctgatgcctttctctgggcctcagtttttctctctctgaagtggatgtgtgtcatatgacccagagatttctaatctatcttctccagctagattcttgcattaggggtgaacttgttcattgggtagagttgcttcccctggtttggagaggcagcatttgcagccccagaggctatcagggataagggtgttgggccaagaatagctgggccaggagcaataaactgttaagggcttgatgagtctgagcaactgaccaataacatccaatgcccctggaacctggcaactccaactttaggtggcagaggattaaacacattttgcctcaaggtgagtctgtacaggtccccagtggtctctgggcctgccttccagctctgtgaggaacaggagctgagcaagtgcctacagtcaccacgctgcctacagtgtccaggggattctagcctggataggaaaactggcttggctgagtggactgtcccagggtgaggatctgggaatgagcatatggggatggcagactaccacacgccctggaagctggagaggaaggaggcacccaggacagaaggtgaggttgccccaggtcaacaacttccagatgagatccaccttgagtcatgatcctcagatgccaagccacaggaacctcatcacccacctcatcatccaaactggaacttgatggaaatcattccacaactatgtgttggtgggttgtcttcttaatacttggaaggaggtcttaatacttatcccactgaaatcatgctacctacacctagcaaaacatacatcaaagaaaaacttctaactgggtatatcacatgcccactgtactaacacactggagaacccccaacaacaggaggcccggggagagtccctgacccacagggacttcaggtcaagaccacacccaccatcctttcaaggtggagacagtccccgtaggaaccaaactgatgtataataaaactcatcatttatttctcttctccctacagcatttcagccagtgaatggtagaattttgcaggaataagaattagaggtgtagagggttttgagatgcggggtgggtcaggtttcactactcaaggaccctaagacaggtttttggaagaagtgtgtgtgtgtgtgtgtgtgtgtgtgtgtgtgtgtgtaggaccacattcagccactcccatgggcaagtatgacatatgaccactcctctcttcttgccccctggcctccttaacctagaagtcaccttgctggctcatgggattccttgatacttctgcaatccagcttctccgctccaacaggctgtccctgcccagctgagctggcccagccagggttccctcacagtgctatgggcctccactggccccctctgcacagcccatcctctccaatctttctttccaaagtgaaatctaccaatgcttactctttggctctggccacatgagagacagacagacatacagacacacacttctttctttttgccttggctcaccactattcaatgcctggaagccttattttctcccttgggaacctccactcagtctttacaactgtcatctcctccaggaagtcatccctgctcttcttcccaggctggttcagagcccaggcatctgagcatacacagctcattcatagccccccccaacatttaaaagatgacttggttgggtgtctgcctcgcccactgcgctgggagctctgggcaagggctgtggtgggagcctctccccctggtgcgtggcgggagtcctggggcccctccgcggacaacagggcccggggacgttcccaggcttgctggaggagcagcttttgaacgaggctctgccaggtcccagaccccaggaagctcagctgtctcctcgaaatcttgggggtgccacatggagcccagtccctttcaggcacgagcccacaacagcttaacgctctctttggtggtggccggcccgaggcaggcaccggaggcggagggagccctgttccgctgtggccgcgaggagcgggctcttcgcccgggctcgcacatgaaagctccgtgcagggtcggagtctgagcccgccggccgcttggaaggctcctcacgtccaggcgccgcggtcacggctgcgctggtttccggccatgaattgggcttcagagtccgagcctcttgcccgactcccggctgagcgcgctgcccatggagcgggggatgggcgcccgccgaggtccgcgcggccagccagggttcgagcccacggccygggctctactctgagatgcttgckgcggccggccccctctggctccccagctgtcctggggcctggcccggcgccccgccccggtctctcttcttgctccccaggtcccactccacgaggaacggtctgtttcggccggggacatgacccgagacgcgcggctgctgaggtcgccagggcgcttcgggagcccctcgagggcagttagcggccggccctcctccattctcccgcccctggcgaaccggagaaggaggcccgaaccgtcagagctcggcgcgccgcagcccaggccggtccccgccgctgtgccggtctccgagcgtcccccgagccgggagcgtggagcacccggcgccccctccgagccgcgagcgggcgagagccgcgcggcgaggctgaggctccgcagtcccgcgacaccagcacgcgcctacccccatacccgccccccatccccagccccacaccgcctgccgccctccacgtccccagccccacttcccacccaaacaaccccccatatacatccatccattcatatccttcacctcatttactcaccaccacctacccctcaccacacctcctcacccttcctttctctcacctctccactctcacccacactacctcgacatctacactctcccttctctcaaccatcactacttcacttctaccacactacaacttcctcactcgaccacaccctccgtatcccttcctacattctccctctccccaccacaataattcacctaatcatcttatcaaaccccccagctactcctaatcccaatgactacatcaatcaaccaacaacacaaacacaaaaaactcaacacacaatccacaatacacctaccaccactacacccacactactccaaaaactaatcaacactccacaaaagtaccacacacgcctcaacacccacacaccacatacccnnnnnnnnnnnnnnnnnnnntgggggcgggggggaggggtggggctcggggggaatggtggggagttagagaagcgcggggggcagggtggagaggtcagtgcgggggggggcgtgcgactcagaagctgtgggtggagctacgggtggcggaggggttgagtgggggggtgtgggggggtgggaggggtggtgtacgtagcgtgtgcagtggtggtgtgcgtggtcatagtgagtagagtcgccgacgcaggcggcacgaccgtaggcatgtgggacggccggtgcgccttgttgtaggccccggcagtagcgacgtccctgtgcctcgtaattgcgtgcgctcctgcagctggtgtagagaagaaaaactgaagggtagggtgaggggagggggcgtcctccgcagttcgctcctcgccggggctcagacacacagccagcccagagccgccacgccggcccggccgccgccgccaccgcctcagcctcccccgaagccgctctagccgcgggaagcgccgctgccacagccgcgggccgcccccgccgcgccggcctgggctcaagctgccagcaccgccgcagccgccaccggagccggagcgggagcccgaccgcgctgggctgggctgggctgggctggggcgggcgcagggcgcaggggcgggcgcgcgggggaagacgcacgggcgggctcggctctcccggggagcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtaagcgcggctggaggccgggccgaggctgggcgggggccccaacggggcagggggtgcgcggcgtccaaacttggcgtttccctgggccgaggggctcggcgggcggtgctcccccgaagggccgcgccgcgccgcccggcggaggagctgtgcaccggccgcgccgcgctcccgctggctgcttgccgctccccggggctccgatctccgcgcggggccccgcggcctctaccgacacttagggccgacgcttcggggaacaccgggatggacgcgcgtcgagacccgcgcccttagcggggccgtcggcgggtcgggagggcccttctgcgcagctcagagcagcggggggcagggggaggtacagcggggggctcgccaagttggcagggcaagatcaaagaggccggaccggaaccgtgtgtgaatgtgtgtgggtgcgtgttgtcagcgtgtgtcgctgtgtgcgcctggcacggtgtcggtgttactgtgagagggtgttggggtgtgtggggccatctgagcgtgtgttggtgcgtgcacgactgtctgtcagcctgttagagtggacacagtgtctgcctgcttctccggtgtgtgtctgtgtagcccttggtgtatgtgtgagtgcgtgtgtatctggttgtggcgactgcatccccatcctggacagtcctagagttttgcgtggtccaagtcttgggggcccagacggtctgggtggtgggagccgagggaagaagcgtgggcagcggggggtagggggatgctgagcgggaagagatggatagagagagagaaccgggagagaagatgaaagcgcagaggaggagggggcgcgccgagggggagtgggcgcgccgagggggagtgggtgggagttgggagcaacacgggaggaatctcgggaagttgggccgagttggggggctgacagcggtcgctttgggggagtccctccgcagtcgtctttccggaagttgggaaagaccagcgagcacagggaaactgggggttgggaggtgttgaaggcgaggaggacgggacaaggcgggagggtgggtggtggagtggggtggtgaggactaggcctgggctcggagagctacgattcctcctcaggggcccgtgaccaaacctgcttcccgccctggaggggtgcgggtctcgcggtcagcattgcggcgccggctccgggtgtagtgaggaatccgggcctccctcctcctacccagcccccagctcgagggatcactgggcctagctccgggacctcagggaccctcgaggcttggtgaggcgggatgtgggtggctgactccagagctgtccaggttgcaggactaggctcgggctggtcgcactgatctcggctggaagcgcagggtccgtggaagctgtgctaggcgcacaaagcgccagccggagggcgccctggaggagctgtccgcggttctagaaagcccttcaagagcagctccttctgggacccccagctccgctagatctgaacgtggaggcgcctaggacacaagtccccttcccccactcccctcgacagacgtacaggaaatgggagtggggaaggatggagagtaggaggctgagctcagggcgccaggccgggcagcgtcacagtcatccaagctgcaggccatccgaagcccctgcctaaggaagacccctctgcgcaggaaagccaactgtagacctgcttcgctcagctccactcagcaggggacgtgcatggagaaggacccatcattctgtcctgggatttgggtgggggacaccaccctcccggggaacttcctggctcctgggatgggatttatggaaccatgtcaaggcatttgggcgctgcctggggccaccccagcttggcttagtcccttgtgtggagcatggctaggacatgtggtgccttggttgtgagacacgtgtgtgacctggtggcagcctgtgggatgtgcatgtgtaactcatgtcaactgtgtgcacgtgtgcgctgagggctggtggggggaggggaacatattcctgtgcaggtggagatcggagagccttaatctaccccgccaagctgaaatcccagttcagacttcccaccacccggcaatcatcggtctgcgagtgccttgaccctcgggccaagggaagcggggagagggttcttgtccaggtccggtcttgatcccttctctcctccaggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaaggtgagtgaccgctgtgcccagggcccwctgggacacggcctgcgaggcgtcgcagcagtgggcaccggaggggttgggacgagctgggctgcgcagggcaccctctgttcctcggcagccgcggtgccatgcgcggtggcgcgccttccccggcccacctaggcagcggcgccgggactgctctgcgctgcgggccggcacggagagcctgcgagcgcggggagctggtgttcttgcgggttgcgtggcgcccttcgggctgtgtgggcgcgggtgtgcgcccagcgctggccgcgcaggcgtgcgtggctcggggcagtctttgtttctcggtgtttgggggtgggcgtgtctgcgtgccgggtacctgtatcgggcgcacctcccctgatctcagtggcccggtgttttcctcgcttcgaggtgaggagcgcccagcggctggagcccgacctgtctccttctcccgggcataacctggtaggcgcggcgtttcgcgccccgcggcccccagagcctcagcccggcgcttctctgcagcgctcctccaccaggtttggaggagccggtttctctctcgctgtccgcgccgcgggcggaggcgccgccgcctgggccggaggtgggcgctgttcgcccaggaaaggagcggagctgggccggtccggctgcggggaaatcctggcctacgccggggccgcccttgtccacagccactgcctccggtcgggccccgcggcaggcgccacaggtgcgaggcgagggcgttcacgacagcaaccccctctgctttccctcctctctgctagtccctccccttcaacctttcagctcgggaaccctggttccttctccaagcctccagattcctggttaaggcctaaggctccgcctctgacacttacccggcttaagtcccttctccttccctctgccttgctccccgcaaccatggggactctggggccagcgcccctcagtgctgaggcaagttagtggcgcaggatgcagggattccttgctggaggaactggtagagaagtgtagagggggcagtgggtgtagtgggaggtgggctggctaagagctcctggctggtgttttctcctcaagcccgttgagccgagagtcctcctgctgctttggtacacatgggttgctagtctccccggtgcctgcaaggacaggatgcctcgatgatggctctggcctgggtctggggggtcagagctggtgttggggaggtcgttgtgttggaaggaggaattctgggggtctcctattcttgggtgcagcagaggaaggaaaggggccagctctgggggcagggaccggggactacttctggggactgaaggtccaaggatttcttgaggtggttttacaaaccgggagtcccaagtgttttcttttagggggggtgaggctaacactgcctattatgggagctgctgcttccagctgtgacagatgtccattgtcagatgtctgttgaggtacagggaagaggaattcctgcccttctttggtgtctggtcgtgtcccaccagcagtctctatctccagacaccccctgcctctggacttcttttcagtgtgcccttatcacagctccttgcaggtgcttggggtgggctccagccaggggagggcagggccttcttagcggaaggaaccctaaatggggtggggacctggggtgacaagctacaactttcayagtgccacctgttcccttgacactggttccacaaaccccatctctgttgacattcattctttgtgcttgggagctgaagccacagtttggaagcacatatttcctggacccaggagctcacagtgtggtggggaccctgcctgtgttccatgtctggtgacacacctctgttggctcccctctgcagtgttgagtatccaagctcattcattttgcctctgaatgatgcccgtccgctcccatcagcagttccccagggactaaacatgatgctcttgcacaaggttgccacctcatgcaggtaacacacaaggatgaaccgggcagctggttcctgtggcacctggagtacagggtctgaagaggtcatctccattaaaaggagaagctgtcacacagctttaacagattttgccattgggcgtgaaaatcctactgttgtagatgtgctgatttatttttttaagaggagccccaaatctggaccttaatgtaaattttgatttaaagctattgccaactaataaaataatgtaaacaacacagtacaagccaaacaaaacatagctatgggtgattcaacctgtaagcgccccaaagcaactttgtcctggggacaaaggttccacccaggggccttttctgggtcttggtttctctgtttgtatagctggaaaaatgtgtcaggctccaaggatggcagactgacacagtctctgtggggtgtgagagtgagtgtttctgcatgtctggaactagggagttagattcttggttgacagttgtctagggagagagacactggccaggtattgttggtgggctgcctgctgcccagagagtttgtgctggtgaaagctggcatgtactttcattttatgagtctggtggactgaaatccattgttatcttgtgaccttgcatagcccttggatgcctacaagggatgggaggagcctgccctggaaggcctctgtgaggggcagagcagtgctcagcagcctccttttcccttgcctggggctctgctgcaggtgctcagctctctggatgtccttccttggatgtactctgtggggtgcttttccatcactgggcttgatccctgcttgatgaatgccttatatctcactgctgggcctggacatccattgcagcaggacatgggttgtcgatacaggttgagtaggaaagaaaaagacttttagtagcggagtggtcagggatggagagcaaaggcagatgggggcttgatctccatcattgactggacaagcccacagtgacctctcagtggagtggtgctgtcgctgttttggtctgagaggcagtgccatgcagtgataagagcttggtggagcttaaagagtttcagttcccatcttgcttgtcttcactcrtggtgtgaccctggagctctgctctgagcttctgtttccagatctgttcaaagggaataatcataggatttgcctcatgggattgtgaggattaaatgagatgagacatgtgtaaatcatctacataaggcctgcggtgggtgttctgtaaacagtaattccctttccgttccttgacccaactgtgaatccatctcagcttctcttgaggccgttgatattttcagctacattatttttttaagctagtgaattccttgagagaggacctaaactgaccttttcatttttagctcttacttttttccctgattrtaaaagaaatgcattgctgcaatgagcatgtattaatataaaaatataaaaaagaaaaagggcaatgtgtgcttattatataaaatgtggaaggtacaggaaagtgtcaagaggcagaacaaaatcactctgaattgcactagtgttatttccttccagtcttcccyccaccactgtattttatacattttgagagctcccattctgttcagttttatatcctgttattttttcctatttaacatcattggccttttctgaaatcactatgaactatttgtaaacattacttctagtaactgcatacatttctcaatattcaaaactttttttttwataaaagggaactatttatgctgagatatgcagaatcaaatattcctgaacaaaacaagaaactcggcctggatatgttggtcctaagatttatacttacaatttcttcaggatgacttttaacaagctccttacaagcactgccttttaggacatttggtcaatgtatggaaaacaatggatcacacaataaaatatccatttgataaggattgaaagttagcaaataacacagaaaggacatttaaatctctaaaatgttgcatcttagatttagctggcaaagtccatattaacaaatagtgtgaaaatttgtcttctaggtactaaaagagatcctaatttgttaaataaaaaaatttcagattgttgtaaagtgcttgctcaagtaggagtttatataaatgcatataatttatataaaagaactggctgagcacgagtcttctcatttcccagcattactttttactgtgagtaaaagacgagagttattagatatgctgtagatatacctgtcgcagtgtggaaggataacagtttaggaaagaggcagaaaaaaggaatgcatgcaagtgaggcaatattccttttagttatcataagcacaaaaggattctaggaagacataaaaattaccaagaatagcttgtggttcacagaatgaaacaatgaaataaaataaaaatgaaacacagagagcttgttggtgcccatctggaggccttgctcagtttatatccgttacctcctaggtggtcaccctgcccctcactggccacactggtatctagacattctgctagaggctccccatccctagctctgatggcttccggcatcttcgttggctccattcagaattatagagaattgtaggtcccatcgaggccacgctcttgcagtcctcccggcagcctcaccagacaccatcagaggctctctgagtgtgatgtccgtgtcttcctaaagatgcctgtagaccccttattcccatcctctcagctgtgttagttttcttgtggtgcggaaacaaattttaccccaaatttagttggttagatcaacacacatttattctcttgcagttctgcaggtcagaagcctaacatgggtctcactgggctaaaatctgggtccttctggaggctggaggaaagatttgtttcctggccttctccagcttccaaagactgctggattcctcagcccctggccctttcctccattttcaaggccagcaatggcgggtcaaggccttctcacatcctctcatgctgacctggcttctgtcatcacatctccttctctgactcttctgcttggctccctctttcaaggacctttgtggttatattgggcccatctggataatcccagataatctccctattatttatttattcttttttgagacagagtctctctctgtcacccaggttggagtgcagtggtatgatcttggctcactgcaagctctgcctcccggattcacactattctcccgcctcagcctcccgagtagctgggactacaggcgcccgccaccatgcccggctaattttttgtatttttagtagagacgggatttcactgtgttagccaggatggtctcaatctcctgacctcgtgatccgcctgcctttgcctcccaaagtgctgggattacagatgtgagccaccgtgcccggccctccctattttaaggatagctggtttgcaagcttaatgctgtctgctacctgtgccatgtagcctaacatattcacagatctggggattaggatgtagacatctttgagggccattattctcctaccatgttggcacacctgtctgtgcccaatatgcattgtccacctccactttccttccaccctgataatcttttgcatgcttgactgcactcttgcttactgcggggcatcctcttttgttcgctgggcctgctatagtcacttgggatggatggctatgtttcctttctgtttctacaaagctcaccctggaagcatcacactgtaagcctgtggagcctccacagacttgcctgtgttctccaatgacatgtcagcttcttttcctgggcttggctgctgcttgtgcataaggaagttcctggaggaaactgctgttcgaatagtcagactgtaagttggtgctgccgcttggacccagggcctcttttctgcctgagcaggttgttcttcagaacctcaccgtctaggcccatgcctacctacaccccaagggacggccctcgttgaagtcaatcttgctttgccgcccggggtcccacagagagctgctgttcctggtcccctcaagggctactgccagtgataacagctgtggatgaggctgcaggcattgatagtctggagttaggccctgggtcccctctctggattccccacaagcccgtgctgaactcacggtgtcagggtgctgaactcacaggtgtcagggttctccttcattctggagtcactcctgtgcaggtgcacacacaggcatgtgcaacacacacacacatgcatgcatatactcaggcacacacacatccacctgtactcaagagcacacacacgtgcacatatgcatgagggcacacacactttctcattttatagactacactccagcaccacccacttcctcaaattttgggttcaagaggctcccttcattccttattgccatggcttagccctctagattgggaggttggacttaactggcagtgagcagatggataccttatgccaggcgtgtgggagaggccacgggtcatactgcctctgagctgctgctgttcctagtcctgggctggcctgtgacagccccttcctctgggatactgtcctttctgacaggcattgggcccaggaaggcagctgggtctgtgtccaacatctcagctaggctctctgagccctccctcccagcctggaaacagccagtttcctggccaatggccatggttgagaaagaagaacccagagttccccttctggacctgaggtgtgggcagggtggactggaggggatgaggtggccccttttgtttctaggtctaggacatgagtactttgacaattttcctcctggagccatttctccaggtttctcttgggggccagctaaggctgtccctcagcactcacagtcacctcttgtaatggcagacagactctctttcccaattcttgtagctgcgaggttgaaatcctctagctttgtcctcatagcagctgtcttccctcttcactgagccttctactgcccaggaaatgctgtcgcctaacaactcagagcatcccttctgccctgcctcttcccagataatttctaacccattccatccctggatgtgattctttttacacttggttacccatggctgtgcctgtgggtctccaccctttggttttgttctgtgtttccygttgtatgagtcaggggagactaagttatgctgcagtaacaaacaatccaaaactcccagcagctttcatgacacagtatttcctcctcctgctgtgtgtccattgccggtcagtggggagcttggtccctcatggtcacttcacttggttgttgccagttgctgtgccagagggaaagagagctctggggggctcagcctggatgtgctcacatcacttctgcttatgactygttggccacaaccagccatgtggccacagccagtcacaagggatccaggaagcacagccctactatgtgcctggaagcagagagaactggaaacaactggtgagcaacagaattgcctctttaccattcatggctaaacagccctcctatttccttggcgtttcattaaaataacagcaacaaacaaaaagcaaaaaacagttttgggtacgggatgctagttgggcagaatctgtggctcccattgataccccactgtgtactcagcgacttgtccctcctctgcagacctctgggcagcccttccatgtgctgggaagttaggaagcctgggtccccagcctaggctggggttgcacctctgcttttctccatgtctgccaatcttgtgctctgtaaactagtgcctggacaagcccagctctcaggaccattgrgctagtcatgaggtaaagattgggttctctgcccagccaccgacaggaccagcacccatgacctccccctgtccccgtagctggactttggcaagtctgcactttccacggcttcagccctgtggccctgtccctcatatagactcccacgtcttgcccctgctgccccaygaagtggcagccctctcctgctaatggcagtgggctggggcagagaccacgcatctctctgccattgctggcctgtgacagcccctttctctggggtgctgccctctctgacaggcactgggcccaggaagacagctgggtctgtgtccaacaactcagctagactctctgagcccttcctcccagcctgtaaacagccagtttcctggcagatggccacggttgaagaaaggagaacccagagttcccctttctgggcctgaggtgtgggcagagtggtctggagggtatgagatgccccttccgtttctaggtccaagctgtaggcagtgtaggttaccagtgggtgaggtggggggtgttagctgggggactagggtggtcctgagcccaggctgccccttctcctccacccaggtgtgggacatgtggccctgatggccccatctttccagttttccctcacactcatccctcaacagaccctagatgaggcagctgggctctgagactgcatctccacctggcccaccctggtcccccactgtgctcagcctggcccttccccatgcctccactggagcatccgtggggtgtccaggagctgaagaggcgggagtgtggtggctgtctcacacagactggggctcccacccctgctctgctttctgactctgggtgggcaacctcggtttccctgactgtaaaatggaatagaggacagctgagaggatcagttgaggaaatgcactagaatagcccagcccagggtgagcacagggcagtggctgggtgaagaggtggaggtggctgtgatcttactagcctgagtggtctgtggtggagacttgtcctcctctcacttcctgttctgggctgggcagtgtgagcaggttcccacagccttggccccacttagggcgggggagatgtgcagcttggagttgagccccagccattctgggtgtctcaagagagcagggaaggaggttagtgttgacgacatggctcatatggaggctgctcggagccatctgtataggctggggctctgggaacctgtggcctgtcacggcacggtatttccatcttactgtggycttgtctgctctgagtgcatagagtggccagaatcccactggcctgcccctscctccccgggacctggccatagggcaggcctaccttgctctatttggtggaaaggggtcaggtggaaaggtgtgggttcagttcccaaatctgattgattatctgtgtggtcttgaacagatcgcattccctctctgaccctcagtctcaacatctgtgaaatgggcctgccttggggttgtggtggtggatctagagaggacgtatggccagcaggagggaggctgtggtgagcaacagtccaccatggcgcccgagagaggggtgcttagcgccttggggctcattctcccattgagggcgtgggtgccggcacatagtatgctcagcaggcattcgttcttgttgtgtcccggccaccatgttttccatcctcctgggaccctgccaaggtacacgacacctcttggtctctgggtcctgtctgggtgctagcaacccccaggtccgggctgagacaccggccttgctgcctggagctctgggcccagcccacccatggtctggctctgctgtggcctgtgcccctataaactgggtcctggcctggcctggaaggctgtcttcttgctgtctgtcccccatggcgctcttccttctcagtccaaggtggagacttgaggtcctgccatgggtccgctcctggcctggggccgtgggccttctgccttttcatctgagtgcccagaggtgtggtgagccatggagtggccccactctggcctctggtctgggctctgggctcaaagctctgagacctgacctgagctctgggccgagcccccctcccaacagtgccccatctccagtggccagtgtcagatgctgaggtggccttgatttggctgggctctagggctcctaactcctwccctgccatggctgtaacatccaatgctggtcctcctgtgtcccaggaggctcccagggtacctgccctcactcacctctcccacagggctctygtaactaaaacaaccccgtgggccgtccccaagtcctgcagtttgccagcctgggcctggagagctgagggtgggtctctccttatcacagaaccccaactggagctggcccaaggcttgctgctggggcccagctctgtgaagggacctgagcctcagctcagggcatatctactgtgcacctgataaaggctttggagggctgagccatcacactgctggaacgggaggaacatggccataggtgccctggacagtccagcagtgtgatggctcagccctccaaagggcttctgggggctctggtgtggtgggcagtgctgagcagatgtgtatgtacacamatgcatacatacacaaggagactgttgcagacacccatgctgcctgggcatgtttagcagaaagagccaagacttccagctgctgctcagagctccgctggccccctcagactcctcctggactcacgtgaggtcccagttgggaggtggcatcctcagggtgcatcccagcacccacaggagactggcctggtcatgtgctccccttgccttgtgtttcctttgacttgtcggtgaygtcttctggaggttgtgggctgtggggagggagggacttggtcgcttttgttccctgtggtatcctcagctctaagggcagtttgtagtgcacactcaataaacacattttcctttccctcctggggcacgttcctggcctcagatgtgtaggcctgacctcagggctctcagagatcatccaatgggatggtcattgcagtggtggtcacttaacttggccaaggtcaggaggaggctgtggacagcaccttaggtgttttttcattgtcagtgtcccctgtagcatctcagcatcatgctagtgggatgagagggagccagtctgcctgcccaccccagggagtggccctcttggggtctcagctatacaggtcagcagatgccagagttcttgtgtccagagctgagggggccatgcaaaaccaaggccagactgggggaaggtctagaagtgttatggactgaatgtttgttttccctaatatgatgtcaaagcccttaacccccaatgtgatggcattgcaggcagggccttgggaggtaattaggtttagatggggtcataagggtggggccctcatgatgggattagtggccttataagaagagacacyggagagcttgctgtgtctctctgctgtgtgaggatgcagcaagaaggcagccatctgcaagccaggaagacagccctcatcaggaaccaaccatgctggcaccctgatcttggactttcagcttccagaactgtctgttgagaaaataaattcgtctgttgtttaatccacctgtctatggtgttttgttttagcagccagagcagactaagacaggaggggaagggctgtgagcaaaccctggcctggggctagacctggccaggcactgactgcctgagggagcgtggaccagccctgccttcttagggctacagtgcccaaatttctcaaatccagccttggaccacatgagctgaagatccatgtacctctgaggatgggtgactctcatctcraaccagtctttatgctgagctgtatttttagtagagacggggtttcaccatgttggtcaggctggtctctaactcctgaccttgtgatccgctcgcctcggcctcctaaagtgctgggattacaggcgtgagccatcacgcctggccccttttgtcactgcccctctttacacacagggtccctggtgtacctaaacaagggacgtaattcacagagcctcagtgttccttcctgtacacttgggatactggtgcccccacttaatgggctgacttcgggaacaaatgaagtaaygattacagaggacttagcatgtgcctggcaccaaggaggtgctcagtaaagaacagctacagttattgttctcatgatgtcacctggccagtgcagagggatggggatggtcactgcttgttctggatgctctgctgatgttgatgaagcccaagaggacactggcttcccaaatcactgcttgctgtggctgtgggtgagcctctgatcctcaggccctgggatcttctcccaagagaagggggtgcatcagacacccctgccaatgctcatgcagctggctatttgactccaaatgcggtctgtacactggctcctttagtcctgtgtgctcagagctctgcgaatctcatgcctactttctagagggctggctgtctttcccagccccagccaccttgtaggggggcctgtgctgccctcaccracctcagaaatgtccagcaggctggacccattgatccctcagcccacctccccagcctgccctgtggcttgaccctgggtcacagaccagctcctacgtgtgctgcaagaatcccagaaatcccattagcccgtgtgtgtctgtacctgactcagtcctgcgcactttttctatccacatacaccgtcttgtgcatgtttcacggagccacaggatgccggagtcggctggggtcctggagccatttcagctgatcctcctttcattgtagaagcctsatggacagtcacctgagtggcgcttgcagctggcccaggaatctcactgggtaaaggaatgcagtgagcttggcagcatctgctgtactgcaggctcctggtgattgcctgttcaaaagcagaggcatctgcrtgttctcactcatgtgggagctaaacacattgaactcatagaagtrgagagtggaatacaggttactagagactggggagggcagggggagggaagatagggagaagatggttaagggacacaaagttacagctggttagaaggcataagttctagtggtccagagcactgcagggtgactataattaacaacaatttattgtatattttcaaacagctagaagagaggaatttggatgttctcaacacaaagaaatgatgaatgtttgaggtgatggatatgctaattacctgatgtgatcattacacattgtacgcatgtattgaaatatcactctgtaccccataaatatgtacaattactaaacatcaattttaaaaaaggcagaggtgtctaccaatacattacaaactgcccagagctgtctgggcatcatctcaggacaatcctgggcagtacagggaatgacacagaaagcaaagtgaagcagggattgcttagggaatgtgaaggactggcagccaagccggtgctctccttgtaygtgctgggcctcccactacgcacctggcttttgtgtggttctctccacctccagtgccatctccccagccccagcctggacacttgaggtcacttccccgtgtcccyctgcctctgcccttccctccaggccattgtccatgtagcagccagagttatctgaaaaatcaacctaaccacctccctctcctgctgaaacccttcaatggctccccattgcactaagaatcaaatccagaccccttgccagggctgcaagtccccaaggaccccgacaaaagctgaacttacctgtgtcttagccgccacttctcttgacctcactgctctggccacattggccttttccccatctctccaacaasccaagcatgcatctaccctggggcctttgcacatgctgttcctactatctggaaggctctttgcatgctgggccccttcttggcctttggctatgcctctgatcttacctcctcagagaagctccccttggctccaagtagggcccctattactctaccaaaatgttcttttccttctttgtaggcgtcctcgtcggcaatgatgttattaatttatttgtgagggccatcaggtttgtgagggcagagaagtgtctgtcttgtttactgccaagtccccagagccaagcctggtatgtggctggttggaggtgttcagtaaaagtccttggatgggcaacaggatggagggactcatgggaactctgctctctgcaacctctgcatgctgctgctccttgtccggtgttctttctcaggaccacttggggtcgcacagctgcatgtatagcagccctgtcctgccccctgtaggtctgcctgtgctagcccttccctcctggtcagcttctgcactgaagatctttctggcaagaaaagatgagagctgatggcactgcctctccctggtaatggctatttatatgagggcttccaaggccatgtgcaaaggggagaaccacgctggagatgtttccaacactcactggctggagtgggaaagttctggaggccccatgcctctgtatgcctgaggtgtgcctgtgtgggcgggagagggtagttgggggtgagtggagaagtcgtgcagaagaaatagaagctcacccgggctccaggtgctggcggtataagcttgtgcaccagaacttgggtttctcttctcttctcccacctgggaattttctggtggcttaggagcccctcttcccccagcagcctccatgggtgaaatggggctgacatggtcctggccactgcctctttctggccagggcaggggaaagggtccctggccgggaaggggaggagctgttgcaggtctagggcagtgagcctgacagccgtgagcttggcagggaggtattgcccaccagctcccaccagtgcctccctccgcactccaggagctgctgaccattgcctgtctgtgaggacatagccagcagccactgctgccaccacgcgggcctctgaggaagcaggagctggacccttcctggtgagcaggggctagaagggctttgaagctctgtagttgtacatgctcaagctttcttaggagaagcctgcatgagtgcagccaggatgggatccactgctttaggctacttagctcctgccaagaaaattaacattgttaaaggcaggacagcgaggtctgtgatgagtctcagtacgcactgatcggcactggtgaatgcttccgggagctcctggatgtcaggtgcagccagcaggggcatgcatgtggctctgccttggccttgccctgggacgctgtcacgtggacgtgctacgtgcgtggatgtgctggggctcttgcatgccagtccaggcactggcacatagcagatgggcccccactcagccttgcccctcagagctccccagggcatcttcccgacaccaggcccctgtggctgctggcctgcagggtcacacctgtgctcagcattcaagtcctcgtggtctggcctctggcctggcatccagtctgctctctcctggttgcctccacccatccaccctgtgccgcagagccccgtctcatcccagtctcagttctgtacgctcttcaggaggcctttcctggccgctctgcttcctctgcccgggccggggccgcctcattgctgtcatgccattcattgtgtctttggtgtctggcttctacatgcacctttgaagtctgtgagcaccagcaccatgaactcctcatcttgggactcccaggcctgtacaggcctaggcacatgcaggggtggagcaaatgtttgttgagtggctgcctgactggacctctgacaagtacacacgaggacctgcacacacatactgcatgcacacttgtgtgtcccagagagctcacagtgcacaccggctgttggactgagaccccagtgataggtggtccaggggtcatcttcccagagagtcccttcctgggggagcctgtctagatatgctgggaggtccccactgggaccatggggaaggtggccgggcctcgcaccctgtggcacataggggtttctgcctctcatggcctgtggggaagttgtggcccacgtgtgtgtttgtcagaatgctaaagcggaccatctgagactatcacctccagggaaacctgctgtgggtctgaaatcaccctccatgtgagtcataataatcatgctggtgtcagaaactctcatttgggcctaagcaaaacagggatcattattaggccatgtaatagaaaaggccagaggctgcatcgcttcaggcatggctggatccaaggcccaaatggtatccacaggactctgcctccgtctccacacccctygtccctgctctctcctgtgtggtttccttcctgggcagcctcctgcctgttgcaggctgatgtctaatgagcccagccccctggccacttgcccctggaagagggggattatttaacaagagtctcacaggagtcccaggacttcagctcactgggctggtatggggctgaatcacttcctccccgaatcaatccyggtgcccaaggagtagaacaccctgattgtcagactggtgggggctgcccagtccctggactgagagtgaaagaggcacggtagatgggggtggggtcacttggagaggaagagaaaggatgccgagactgcagcagtgtccagctgggggcttctctgccacaggcacttggaatgtggcctgtcacgttaaggggggattggactgggagcctcagggcaacacctggtgacagttgttccggagagctccaggagacccaaacagtgctggctggaaagctctttggggacaggagagtaaggaggggaagggccaggctttgagctctgtggtatgtccatgggtgggtggggcagggcaggagggtggggctgggcagttagggtaggctttctggggtaagggacatgtgccagcccgcaggatgacacctgtgctcagcgttcacgcagggtaccgggcctgggcctctcacacatagccctcactatgtagctgccatgtatgctcttgtacctggtttcagtcttccccagccgggaggcctctccttaccccatgcatacattgtgggtggggatctctgctttattcctcccaataggcacatttgtggggaaccctgagagctccctccaggttccaagggacaaggaggagtcctgggccagcagccttgccccatcctcctggccagcctctgtttatccttctgcctagtggggccaatgcctggggctgccgtggacttcgggaagctgggctgctgctgggaggtggctgccttatcagcaaaggcctggctcctgcctcctgggcagcgtctgctccgctctgaacgattaattgaatagaaatcctagcactgtgaggcaaagctagggccctgcctaatctcattaagaagtcccctgacagtctcattaggcggctggctactcagagacgtttatctctgctacaggatggtcagggcctggagggggtggacctggggccaggccccacccagctgccctccaaacacaggcctgggcagagataaggctatggcagctctgccagccagcaccagtccctacttaatcggttatggtttgctggacttaattactttaaaattattaatttcagctggagaaagcaggtggtggtggtccaagaagaaacgtgagccttcttaaggggtgtaaggtgggctggggcggagacggtgtttccagctggcagaacccatgtgctggagttgccctggcaggccacacccagcagcgtgtctggacactctgcatactatggccactagctgggtgtggcagggacagacgagtggcctaagaatgtgaagcatgctacaagagaatgaagcctgcccaggggtgtgggagcacaggggtggtgcctaacctagcctgggcttggggttaaccaggggaggcttcctggaagaagtgacttctgagctgagtcttaagtgtggaacagtggttggtcaggygaagaaagggaggcaggcactccaggcagtggcatagctggagctagggctcagaggtgagctgtccagggtccctgggcatagatggaggaggtgctgacatcctggcaaagtctgcaggggccttagggcttccctctggtacaggcagaagtggctcaggactgaacccctgagcatcaaaggatctaggatgtgggccactggaggggacatcgctggggctcagagccatgtgcctccatctaggcccttaagctgtgaggagagaggcctgtggggatggcagaattgcacaggctagtcagctcccccaacccctgcctctgcaggcatctgtgctctggattcagggccgctccctgaggatcccaggtgcagcgcgtaccattcttggaggtttcaggacttctacatggctgaggcccatccctaagcctggcttctgcctcccatggccacagatgcctggtctgccacagagaggggaraggaggaccaggctgctaggctagctggcttctccctggatgggaagcagggcttagacccccaaatttgcccaaggcctggtggtaggtctgatagccccaggcctctctcttttccaccccagggtcccctgttcctgtccacccaagctgcaccactctgagtgactttattacatatactgttgagatggtgctggcttatgacaagggtacctgcatttcataacatatggcagctcgaggcccctccatgcagacatgaagatgaagatgtctcatgtcagacatctgagatgaaggctcatgcaccagcagtggactttggaacatgtgccaagggaagaggaagtgtgaatcagggcrggagggaaggccagtctgattggtcactgccgtgggccactggagctcattcctgctggggccctccagggaaccacaaaaaaatgcatctggattgtccatccgggcagggaaagtgggagcatttatccaccagcccactcctcactggtcagagggacccggtgctgctcccttcccaggtattccaggtttgtgcagcagcttggctgggcagttcccgcctggtgccagcagagagccccctgctgagcagagatgagggctgcccagggatgcccgtatgcagccagtcaccacagcaacaggargagaggtggctgagaggatgtgacatgggccacaagagttgtctagagacccaaattctgctagacttcttagaatgacctaatggtaaaattcaggtgtcaagacagggctttcctggtgtgtgtaaattatatcctacaagtgtactttggctccaaaagaggctggtataggaggggctgtgctccatttctccccagcacctggtggcattgctagaccaccacggcctcagaggcagcacctggctcttgctggtccctgctcctcccctagcttctggtccagtgtggggcacatgtgggccagtcttggctggggggaaggcaggtgggatagggcgaagtctctgaatcatctttgacactggacagtgctgtggctgggctgagtccctcttctgcctcttattggctgtgcgagtcagtgcatgttcctctacatatctgagcctcagtttcctcatctgtaggatggggatactcacatctaccttgaagaattgttttgagagtctgaagacatggtgtgcatacagtgggtgcccatttgttccctgcccacatgtctcttgagggttgacccagtgccagccactgtgggcacagcagacccaggccccaggaattcagtcaagtgtcagtgcccaggctccaccccagagagcctgatttaacaagctgggcaagggcccaggcactggtattctctaagagcttcctgggtggtgccaaggggcggccagggccagccaatgaacggtggcccttcatgacgcagagatggaacgccaagggccaggcgtggccacgtgctttcccaccccagctcccagcaggtgattggctagtgggggtgctctcactgttgatttccttcatcacagctctggacattctcccccagttcagactgaaatacacacttgtgctgcacaaggcggggtccctggctgggccatgactgtcattctgtccatccccctgcatgacagcgattctctctcatcagacacagggtgccatggttcactagggaggtgtggggattcacgcctcattaacttcaaggctgggatctccagaaaggataccctctcacactggctgaccacctcctttcccaccttgggggcctcagccaccagaggctgtgtatgcccagcagagctctgagccaacaatggcttatgttctctgcaaggaatatttctctgcaaggaatatttcatctcattttatcagtaatacagagcagtggagcgatggtacctatgtgttctaattcataattttacagtaattttagaaaactcaagatattgggtttctttccattagtgagatggtggcaggcagtaaagcccactgtcttcttataattggatttaaattgttttaattatacagcccatattctcccagtaacataccatctctgtgagttaatgggctttgaaatcttcttttgttccatacactgtagatacagatttttttgttaaatgatttattttatatatagaaatccagaaaatttgctgtgaggtagcttaagatgagaactgggaggttctgttctgttagaagaaggtgaataaccctctgcagaaaacccaaccctaattcctggatggaattctgaacatctccaaaacaaggttttaagagcacaagtgatggagagtgctatcagcagagagaacattcgtgtggctgaaaggctgctgcataaagtcctctgttgatccttcagtggggatagtataaaggaaatgtccattcatttcctgagtgcctactgtggactggccctggccttgggcatatacagcaaggaacgccaggatctttatctttaaagagcctgtgcttttcacaggaacaaacatttgtatttatgacaaataagacctttcaatggtcagcccttctccggaatgggctgtcgggccggggctcacagcgcacagggtttgcccactgctggggctccctcaatgctgaggggtatgctgccatggagggggtagctcgctacccgactcaggctgctcctgggcagggaagcagcgtgggctccctagggcttcctggaggatgggcccagctgggccaaacttcctgttctctggatgtccctcaggcctgcccttcccactccgtcctgggggcatggccagcccgtgggtctcagtcccccttgggtatataacagggcccagccagccccttaactgggttgggctatcccagttaggccagccaagttgcccaaaagacttctgaggcttgacagaccttgggtgaggacatagtggagtgtgtgtgtactgggaaaggagctgggttcatcttgatttccacctcacttccttcttggttctctggacctggggtagaggcatcactgggacctggacttggacctgctggctggcccagcactgctgtgtggcctttgtgagctacagccctctctggtttctgacactggctgtgtgcagcagtgcccgcagcatgagggccgtgtgacctgcctatttgagtactcccctctcatccctgctcctgaacacatggggcacttggtttggagcccccactgactgagggtccttcaacagtgtgggaagtctctgcaaaaactagggagtaagcagaggtggatgaggcccggaaggtcacaccagcccctcagttggaggggcccagggtgactcttctttaaaagctcccagatgagaacctcaagctcaggacttgctccccatctcacgatagaacttctagaattagtgccctaaaaatcccaatccctgggctgggcttggaaactctggcacagaatccaaggcaaagatgctccctggaaagtccctgaggccagatccctaaattggggctccacagactaagaactgcaggcgcacagctcttgagcctggaaaccccatttggaagccactcggtccaggccctttgagcccagggcccctctctgggcagacagggctgggaagaggggcagagctgtgcgtctaccccactgcccgaggcaccaactccgcagatgtaaatgccaggctcatagcaagagactacgtgttgtgaaatgtgtcygtggttttgtgacatgttctctcggtgtgtctgttatttacagctggtgaggagggcctagctctgggagccgcaggagagggagtgctcaggctgagggaaagccgtggccgggagccctgtgggggaggatgctcaccctcactggctgctgaaaagccacctttaaggtccttggttaagcatttccctaagcgggcccttctggaaacgtgtgagggaggggcacccgcgtaagtacccagggtcccaccagggcctcatcctagtcccatcttctcctccatcctccgggactgtttagtgggcagtgcaggctctggggcatccagagctccctgtcggtggtagggttttcttgctatctctagaagcactctgctccctttgtttttgtgttttaggggactaagttgaaaggatggacctgggggatcagggacagtccctggagcagggggtttcttaaatgaaacctgaacaataaggaggagggaggatacacagcatatgcaaacgccagaggccaaaggacaagtgcccaggaggaggtaaagacagaagggcgagtgggggtcggggaaggcagggctccctctgagagccaggggattacagtagctagcctggatctgtctgctgtagggactggacagacaggcccactgtcaagggggacagggttgggggctgcctgtggtccttgactaggaggaggcctgagcaggagtaggctcctgagaggcagagtgaaggcctttctcttcctcccttgacaccctccaggtgtttgtccagggccaccgcctccaggcagcttcccgctccagtcctcatccagttgctctsctccctctttgtaggccctggctgccatggggacttcagcaggcagggccatcttgcctttttccttcttccctcctccccttctagtttttggttgtatcaaagttattcatgcagatagtttcaagagcccgtgacttctatggtctagagaaacagtgactcccctcccctgccttactcccccggaggcccctgtgcccctggagtattcacctgcagagttcccaagtgcatgcttggctccaccccttgatattccccttgtggacgtctgtattggcttcttgcctcagaggaggggaattgtgggctctctctccctctgtgccctgcatcctgccctctgggtggcaggtcatgacggtgctctgcagtctggtcagatccgtggtgcacgttttctgcattaggcctgtgtcaacacacagcacagcccagttagggaagcgytgccttagcctttcctgtccgatattttgcttcccctggagttgctgactgactttttggtggttcggggctttgcttgctatgcatctctcctcatttcatccccgcactctcagctgggygtctgagtgtccccttgctctgatccttgctcagcaactcctgggctttccattccgctgcttggctgcttgaccttctcccctggagcctcccaactgctgcaaggggcactctccctcatctgtgaggctcactctcccctcctccagtccctgctgtctccgcctctgtgagttcttccctgggatccatgcagaatttcaccctgctccccaccccactgccgcccctcccgtcctcctggtgctgcctgtctttctccgtagttctcatctccttttaataggccacttggctggacgatgggttaacyttgttgttgctcgttcacctctatcccaagtggaagcgttaggagggcagggattgctgtcttttgggtcctcatctctagcgccgtgccttgcatacagcaggtgttccatcaatgcaggttgcatggaggactaaatacctctgagctggctgccagaccccagaccttgacacctcctcttgaggtcactttggtctgctgactcccagcctccccactctgctcgttccctcctttgctgtcgtgggttcctcagaaaggtgcagctggcctcctcactgcctgtgaggctgctcacatggccatgcctgagggccggctctaggttctcctccccagcaggaggcaaaggcctaagctttcttcctcggtgtgcatcctgcagtgtggttctgcctgcctagcccagccacagggtgcagtgggaactaccacatccctgggagctgcaagttaattagtgtaggtggagccagcactgggtaatcaccgaatccactccccatgggcaggcccgtgccaatccccaggcttcccgcatggggctttgaggtgccctggcctggcctctgccagccttggtggcttctctcaccccatacctcctcctcctcctcccctgccttcccttgcagctcaggagatgtttctcgaaagtgcaggattcctgggaggctcctaggagatgtccaggtgtggcagggcagagagcatttgttcacttcacagatgttcactggtgtcttgtttgggccaggcaccaggcactgtgttgggtgctggggttcagggtggacatggtacgtggagcttgcctttgaattgagagaggaggtgagagatagcactttggaggcagaccagctggatctgaaccccagctctgtcaccgactagtttttgaccttgagcaacttactgaagctctctgagcttcactttcctcatctataaaatggggataaacataggccctgccacccagggtatttgtgtgaattaaatacccagggtatttgtgtgaattaaaatgggagccaggcgcggtgggtcacacctgtaatcctagcactttgggaggccgaggcaggcggatcacttgaggtcaggagttcaagatcagcctgaccaacatggcgaaaccctgtctctactaaaaacacaaaaattatctgggtgtggtggtgtgcacctgtaatctcagctactcgggaggctgaggcaggagaactgtttgaacccgggaggcggaggttgcattgagccgagattgcgccactgaactccagcctgggggatagagcgagactcccccctcccctggggggctgttactgtggactcttaggtgggagggaccagcaagtttcccaaatgaattccagctgtggtttcttcggttgtacaggacaaagatccaattcaccctggcctttgccaaaaggggattcagggcaggctggattcggggctgtagagtatctctttgtggctctgcttgacttcattttgtacaggctccttccacgtcatccactattcgggcttagcaaaaatggcagagaaaagaccacattccctttccactcgaggggaaagaggtcttcagaggactctgattggcccaccctggttcatgtgcttatccatgaaccaatcagtgcaacaagggaatggatatcctgattggcccagcctgggtcatgtgcctatccatgaaccaatgagtgttaccagggatgggagtatcctgacgggcacagcctgggtcatgtgcccatccaagagccaatcagtgttatcagggaggagtattttcattggccagcccaagccacgtgtctcacttctttcyaaaaccaggtggaattagaaagaagttccaggccaggtacggtggctcacgcctgtaatcccagcacttcgggaggccgaggcagatggatcacctgaggtcaggggtttgagaccagcctggccaacatggcgaaaccctgtctctactaataatacaaaaattagcygggtgtggtggcgggcgcctgtaatcccagctactcgggaggctgaggcaggagaatcgcttgaacctgggagaccgaggtttcagtaagccgagatcatgtcactgcactccagcctgggggatagagcaagactccatctcaaaaaaaaaaaaaaaaaaaaaaaaaaagttcccaaagggaagagaaaggctgttagcaggataaggtgagcaaataaactgcgctggacattcagaactgtaacttccaggccaccacgaggagcagttcttccttggtggctgtagacattgacctctggggttctcccttgtggttttcaggctgtctaggccacccctactgatgggagttccccgatttcaggacgtgggagggtcagtgcctccccgagtgctggctttctgtggtgktgtagctggggcccagtgtggttggaagctgtctgccccttacaggatggtgtccctgtgggaaggcccgggctacagactcctgagcgcacaaagtcaaggatcaaagcctcccagctcctgcctggggcggcacagccactctcccaggcagcctttggtcctgtcctgcctacatgcaggttggagtggccggtgggctcgtggggggcctccctaacaggggatgggctgcgttcctgctggctggcttgtggttagtgttgttcgatgagtcggtcagatagagagtgggccaggctggccgggcaccgtggcttatgcctgtaatcccagcattttgggaggcygagacgggcggatcacgaggtcaggagatcgagaccatcctggctaacacggtgaaaccccgcctctactaaaaaaaaaaaactgcaaaaaactagccatcctggtggcgggcgcctgtagtcccagctactcgggaggctgaggcaggagaatggcgtgaacccaggaggcagagcttgcagtgagccgagatcgcgccactgcactcyagcctgggcgacagagcgagactccgtctcaaaaaaaaaaaaaaaatagtgggccaggcagtcagcagggctcagggtctttctggaaatgcctacagatgagtgggcgacgcttacatgaaataacacaactgtcagaaacaatttatagccatgttcccatggagccaggtctggttatgactctgcgtgttgccttctggcaaatgaggtttgtcacctaatcattgcgctttagtacctgatatgaaaaccagccctggagcctactgggtggggacaccacggggttccaggcacccagaggacggcaggggtatggggaggtgtggaccgggtgatggtgggaaacagcgttaattgtcaccgtggaggaggccgggttgtggacatacacttgtatttcttcttcagctgcctgcttgggctctagaggagacccggagcccagggtgccactgctgcaaggagcactgacatccttagaggcccccactcccagccttctgtttcctggatgtcacggttcttccattccatcatgaaatcctgtccaattcctaagtgtgtgcttggccaggggctggggattacagtgatcagcstttagcctctgcctctgccattgtgcatcctattagtgtttctatgtgttattgtgtacattttaytgcaaacactgtgaaacaatctccttcttagacacaacactggacaagtaagtccagtgatcagactcctaggagagcaacctggagttgtctgtgatagagacacagccttcagaaaggtggagtggagcagcccctgccgcccttctgtcttcaatgtttgggatcaacaggtgtgatgttcatgtgactcctggattcctgccccttcactggctggttaggccccatggaaaccatactcagctggactagggtgagagggcccctctaagggtttaccctgtgttgggaccaggccaggttcctgcatacccagtcccttcacagtctacccagttgtggggcaggttggagaggggttctttcatgagctttagagaagtggccatgggaagtgtgaggagtttgaaagagtcagatactttcagagtgttgtcccagctctcccctccatggccattggctgggcatctcttcatatagctctcagctgtttgtcaagggcctgctgtgtggaggtctccatgctggatgcaggggatatagcagtgaatgagagagacctcatgagtgtgtttcttcatatctaaaatagggacagcaatggccactttccaggctggggaagaatagagcagtatgtcccagattgaattctgtacaactgattttactgaatattgcaggagaaaacagcctctgtggccaaatacatatgacccagccagatgcttctcttgaggacatcaccacatacatcagcatatttaaggctctgagaagtcctgcagtaaagaagcccattaacttttgtgagctcagtgtttgcaggctcagttgaacatggaactttatttggcagagcacctattaacatcctgtgtaattagtgctttgcaaagcccattttggaaatgccaaggcagcataggtaaaataccccacagagtgcccagcacctgggaggtactcaataactgtgagtctttcccccacctggcatcctggaggaggcagagggataaggcagccctggctggctgcaaatcaactcggaggagccgacagtagctaacactctggttttaatggttatagcaatgaaagtctaagtgagtttaattttaaaaggcaaggagtgatttcccctatgctctgccaaaatgggacttcataaatattacagcaggatgtgctaggtggtgggcatatctcctggttgagcaaaatctctgcaaagcaccatgcagcagcaaatggctcctcccaaaccacactcctattcttgtttagcaggacatgccacttgacaggtttacctgccagcaccgctggctggccaggagatggcagtggatttaacaggcctgtgttctggaagtggggagggactgaggctgtgggagggctctgcagacccggccacatcctcagcctcccaaccatggtccattatcagggagcctcggtttcctcctctggaacatggggatgattatgcccagcattgtgtgtgccttgaagtagggactgcatttttctcccctatgtccccagaacccagcacagatgaaagtcagaattgggttttgaaggatgagtaggagtttcttatgcatacagtagaagaagggcatttagacagatagccctaaatgcctttcttctacttcaggtaaaaaggtgtggaggcctgaaaaagtctgacatgtgacacgaaccataaccaggcaaggagcgttagtcataattgagcaagtgacagaaaacccttttcacttgggttgcttagggcaaccttggggatctgctttctgtgccagaagagacacctggaaggaaagcatggtgcatgcggagacaaaggcgatccccacccccatccactctgggaactgcttcacttcatctagacagccagcagcagcagtaaatgagggagatggaacgtgttattttaattatatactctcaccacctaattataattttaattgatatgtgagcaggtgctatgctcttcaaagcagtttaaggcaggcatagtccccggaaatggaacacagtttgttctattcattagtcaagcagatggataggccaggggactagggggccaggtgtggggagacagcctttgccatgagtgatgtaggaggtgaggggcttcccctggccaggcagcgcacagcttgagggaagaggagagaagggagggggtggcggctggcatctagtgctagtgggttgattcatttattcattcagctatgcagttgacccttaaacagcattggtttgaactgtgtaggtccatttacacaaggattttctttctcctctcccaaccctgagatagcataaccagcccctcttattcctccccctcagcctactcaatgtgaagacaacaagaatgatgatctttatgatgatccacttccacttaatagtggaatagtaaatatactttccctcttccttatgattcttttctctagtttattgtaagaatacagtatataatacattcaacatgcacaaatatgtgttaatagactgtttatggtatcagtaaggcttccggtcaacagtgggttattagtagttaagtttttagggartcaaaagttgtactcaaatttttgactgcatgaggggtcagcgccccaacctctcattgttcaagtgtcaactgtactttcaacaaacatttgttcacagcttgctgcaaggcaggctctctgctaaatgcaggggattccaggatggctccagcacaactcctttcctcaaaatgttcccagtctagtggggaaagtatagatatggaaacaaatatttatagttcatggaataaatgggaaattatcctagaagcagcatagactggcaggaaagttttgctctctagtgaagttagggaaggcttcctgaaagacactttagttggggttttgaaatgtrgataggagttgaccaggttgcctaagatgagggataagagatggtggtgggagatggcattctaagcagagatgagaaacctccatctgtggggtgtgcagggagtgcctggtggtttgctggagcactggcctgatgggagatttggtagaagatgaggctggaggtttgagtggtaggtgggtctcccaggagcaggagctggacctcatactgatagcagagaggagctggaaggatttgaagctgggggtgatgtgattggtttgtgtttctgggaggccaccctggtggaaggtgggctggacaggctgatggtgcagccaggcggagaagcgaggaggggctgtgtgaaggtcagagcaggagcttggaggttggcttctgggtattggagtgagggaaggggaagatcagggtgaaggtcacgtctacgcttgggcctcagggaggccatctttgagatgaggagtcagggaggagcaggggaagatgtgaggtcggtgtagaccatggagtttggggtacttgggggacctgggtgaagcctcaggaggagaggggtgtgctggaggcatcacttcgggagtcactgtgggaaggcagggaaggaagccccagaggggatgaggcaggggcctgggacacagtgtcaattccagggagctgagttcaagtgggagtttggcttttaggaggcttattgggggtgacattgggatcttcacctggggaaggcagggaaaggagtcaggccaggcaggacacaagccaaggggtgagaggccatcccaggggaagccccagcagacccctgggagctctgaggctgagtggcccttcagaggcgttctgagctgcagggagagggttggacccttcatacctcatgccgctgaatcctagggggtccgtctagaattctccttcaggaatgcatcctcttcctctccaggggctgttcttgccctcccttcaccgtcctggggcagccccctcctccagcaggaagttggcctggattctggaggggtcaaggaggggctgttaggaagccaatccagccatgggggtggagaggccagggacggcccctctgggccccaccctgccattggccagctgcatgacctcggggaagtcacccctggcctggactccgggtttcccatctctgaaatgaatggtctcacattggcaggtgctgtggtgttgcaggcgtgccctgagccctgcagcctccgtctggtctgtcctgactgtcggtttctgctttctgtgtcattcctgtccaacaggatggccagtgtctcaggcagtaggcccgtgtctgatacatctctgcacaccatacagttcccagtctgacctggcagagacagcggctggatgctcatcactggagaataggcagtggctttgcttttactgagcgcttgttctgtgccagaccagttactagcagtaggtgtatgtttctcatggcaacttgtctgcagatgaggaaatggaaactcagacacttggtacctgccccagggaccagaactgggatagaagtgactgctgagctggggacccaggcttggtgaccccaaagtctgaactctttctgttccccctgctcctggggtcccaagtcagtgttttggggagactaggagtctctgtctctccagccctgtccagtggagggcactggtggaatgtctggcactgtgttgactccagccctccagcttccaatggggttgtgggcactttgtacaccttgtggagagggtgggggcatcacaattgctaccaagcccacatactgctctgggccacccccttggctgcacacggagctgctcaggctcagcaggtagtggcctccctgggtagttggggaaggggggctctgcaggctgggaggccctgtcaggacggctctgtgtgcctcctgccccagccagggctgtctagcatgggagtccaaggctggaatgcccagtgagaacctaggagccacttaaagaggccatgatactctgggcggctggcagagaggtgagggatgggggaaaggtggaattagcaacacatcccgtgagccaggccaagccagcagctctacatgggtgacgatgatcagcgatgggcttccagatgcctcctgcatgtgccatccctgccacagcctccctggattgtttatggtgggaccctggtggcccttctctcatggtgttcctggggaggcctggggcatgcagcctgcccttcctgttccttccttgctcactagtcctggcctccaggccctcctgccccttggctgcgggaacttgctgtggtcccctagctctctgaggctaagctcctgcaaggtgacgtctgtgagatgagccatcacctgccagggcagttgtaccaggtctgtggtgtgcccatgtgcagcgggcttcctggacgtgctgctcctgtcttatgtggcttgtatttgccaggaaacctacttccctcggcatctggcctcacctgagatttgctgtgagccacaccaggattattttctagcttctcctcttcctggctatgtggcctcacacaaagtatgaaggtgatcttggcctctacttgctgctcggcgctgtggggacggatcctgatggcagcctgtggttggggcaagaacggggtgagatgctgttcccggtgcttggtcagggcttggaaatgggcgcatccaccatcaatgtgactgtgcagtctccaggggtctgctcctggccatctgtcttgagccctgggctgtgggtgggcttgctggaggggaactgaaagagggaaacgtgtccagccctggtggcattgccagcctgctggacccagcgtccaaacttgtggggtggccaggacctcctgccttctgcagaggcctcctttgcctgcctgaggagcttgaggggagaggagccccaaggaaggctggtaagaaggtagggaggaagggaaattggcgcactgcaagagggaagggtgtgaaccacccccgagatgggaatggtgagtctggggtcagcaggaagggctgaggccctccccggggctggggatgcagaggaaacagagatgcgctcctgccctgggggagtcacggtctcgtccatgatacaggccctgatgcctgacgctactgggatgggggaggggaaggactttgtggggaggcaatgaggggaggaaagtcctgctggctagctcagcatgcagggagggagcccatcctcragatcagagtgtgggaagtggcacaggagctgaggagagggcygtggtggtcagtatctggggtgggtcatgcttggcctcacaggctggcctggaagggcaccagtgatgccaaactgtgatgtggcctggtttgcttcaagggaggtggccacctccaacttcataaggaagatccaggctctgggtccttggggttggattctgagttgtccagagcatgagcaggggtagactggcaggccaatttgagcagagacccccagcagggcscttctgctgagactttgtgtctgggacctctgggttctgccagttggctggttgggggtcaggggtcagtcagtgagtgtggaccaggggatggtcacagaaggtagcatatatgttcagaaaggtcatttgggtcattctctcattgccagctgagggagtctgcacactcggcccacccctatcctttcaccagtaggcagggggctccttgccaaagcccttctcaggctctggtccatggacatcagcgggcccccttcctcctggcttccatggaggcatattggggtattcacccagtaaccacatgggctgtagacatctggctagttggggttggcggttgtttgtaaccacagcatgttcacttgccttggagggccctagaggagggcccatggtatgacagctggggagaggcagcctggccaaggcaacctggtggaccctgcagcaggcagcatgcatgtctgtggtcagcggggctggccagggcaagggaaccaggcagccgctttatcactttacattagagggctcrggagggatgccctgaagctgtccctgcatgtgggaggcaatgctggcggatatttgtctcacacccctgcttctttctctgagccagggctttgctttcctcctggccttcttggatatggtcacccagcccatagtgacagggcttttgggcttgaaagacactcagtccttatagccttgggtgtccccagttcagccctcaaaatcccaggtcttggacttactctcttgtcaagtgctatacagggaggtagaggctgggggtggggtgacccgggggtcctgggagggccttagagctaaagggcctcatgcagagtccccaagtcctgggagtctcacagcttacaggaaaggtgagtctgagcatgttggtgggggtggaggggggaacggggttcttgccaagcacacatagagttccaaggctcactcttgacctgtgaatcatttctggggatgtgagataatctatagggaacctctccttaatggagagtggggcaccagccagctgcacataaaagtgcttcctgaatttttctgattgtaaaagcaatatgcgaggatcacggaaaaatgaggacatgcggaaaagcccatgaaagtgcttcggtacctggcaagataaatgctgccaggaacccagccatgcagagcaccrctgctcatggcttccagcctctcctcttgcagacttcttcacatggctgagcgcatascattcactcaattttgtcttcagccttcaactttaacacttttatttctttaaatgtcacaaataatacacaaacacatctcattatgaaagactgaagaaataattaaaagaaacaaaaggcccgtttcctgcctcagagggaaaactgaaatcagcttgctctatattccagcagaactttccctctgtgtttacatttagagaaatgtaacctacacacataacagaataaagagttttgctttctttttgtgtgttttgtatatataaataatgctgactacacctatttactgcacttgcttcttttcatgcaccaatgtcttggtgagcttgctgtgctatttcatataaatccaccacatttcaaacagagtttcatgacatacatgaaactgtgaatacatatttaacagataccccccttaatagatagttaggttgtttttaatttgcacaataacaaaccatattgtcatggaaatccttatatatgcctatgtatctaggtggactctaagttgtggaattgcttgtctgaataacatgcacatttaatttaaaaatggcttctgccaaattgtcttccagaaagtggaatcaatttgcacacccagcgacagggtaagaagagcacccactttttcacattcttgccarcacttgatattatcagtcttaatttttgtcagtccaatggctgataggcggtacctcattgttattttcttttccatttccctaattactgtgagccttctcttctacctaacacatgcagttctagcagatcttgttaacagaaatatcatcttgtttaatttatttatcctaagagttcactgcaaacacaattaacaatggcattcttctccagtaagatacagcatttaatgagctcagtgataaaacttccgaaagagcagtatataggtgtccatgactcaatattggcattgattgattgtgagtgctattgttctcatgtgggtttgctctgctttttggctgcttggggaaattctttaagatgctgttgtccaatggtggggtctctggcagtgggcagagtaaagtctgccgtcctgatgagggcatgctgggtagagataactaatatataaccagtgttacagcaagacccttggatcctctaagcagtgggattttaggctccatatctaactcaaaataacaacagcagtaaactatagcataaatgtaaggatgtccaacaaaggtgttcattttcgcaggatgacttactttgaaatcaaattctttttgttgttgtttttgagatggagtgttgctctgtcgcccaggctggaatgcagtggtgcaatctcggctcactgcaacctctgcctcctgggttccagtgattctcctgcctcaccctcccaagtagctggaattacagtcgctgccaccatgtctggctaatttttgtttttttaagtaaacacagggtttcaccatgttggccaggctggtctcgaactcctgacctcaggtcatccacccgcctcggcctcctgaagtactgggattacaggtgcgaaccattgcgcctggccaaaataaaattcttttaaaaatgtgttcttgttttagggccccacttggctggtttcctcctgggtaacctggcacctgctccactctcgtctccaatttaccacgtgatgtgcccacagctgtggcccacacctccgacattatgtgcatccatgggacttcagctccctgattattgcaacctggcaccatttgcttggtccaacagtactccattgcttctcttccaatggcaaattgttcttctctttatttgatgctctttggtctctctatggctttaaattttaattttggtcttatggacgatttgagctgccttctactttttcattaaagtttccctcygatttttcagaatttgttcatgtggttcagaccgttttacccttcttcaaactttcatacatttgattaggtaaataagtgctcagtaaacacatgcaattcttgtgagtagacactagctacttctcatccactactgttggcaattatacatgaaaatatatgtctgtcagtgggtgctttgaatacatagataaggcaggagctcccatcttcataatatgaacagttaccaacccggggcatagtgtgtctccccatttattttgggtctctttaatgcttttagtaaagttgtatgtttttctttgtgtaggtcctgcccatttcttactaggtttatccccagggattttattgattttatttctaatacaaatgagctttcttttagattacattttctaattgggagtgctcccatacacgaaagctattgatttttgcatattgattttatatccttgagttttgctgaactcttgtatgagttccaatagtttattagttaattctcttggagttcataggtagatacctatatttrctacaaattatgtcaattttgtctgtcctttttcaacacttgtccatatttctttttcaggtgctgtcacgttgtctgggacaatgctaaatatttttagtggtagaacattctacagtttcccagttaagtgtgatgcttgttgtaggtttctaggagatgtcctttatcaggttagggttgttacttttgatccctagtttaccaagaattttacaaagagtatgattttagccacattccaataggtgctcaattcaaattaatttctgaatagtttgaaatttctcttgttatgttcttttaagccagcaggtataaaaaagaatgttttaagtgttctaagtagatagattgggaaggaggtttcttttattgttaattcctggtcttattgcattggacttcattaatgcacaatgaatttttgaatacctttttcttaaggattttactgagatttatactgtggaaagttgggtgtacatggaagactgtgctgtctcttttgggtctcgagagggagcataagtggaggttgagtgtacgggctttggggccagttcctgactggaaccctagccctgcctcctgctggccgcaggatggtgagtgagttgctggaaatcagtttcattgtgtacaatgcgtgggacagtagtgcctacttcatggtagtgtgtaaggatgatattagttaatatatgcagaactttaaaccagaacttagaatgtaagtatttaatacaatattgttaggtaaacgtatacaagtgagatgtgcaaatctttcatattattttttgctcactgaatctgaaagaaaaatgttaaaatcatctttaagattgtggattggttggtttccccttcaattattgttaattttgccttatctattttgaagctgtgttgcaaggttcatatagtgtcatgacttatatttttggtgtagatggtgtcttttatcaaaatgaactctccctgttcctttgagtgcttccaccttgaattctattttgtctgataaacagcccctttttctggttattttttgctaggtgttgtttttctcatcctattatcttgaaccttcctgggtgtttgttttgtatcttttgtaaaaagttatgtcaaaaaaaaaagttatgtcatgatgaaaaaaatytcatttttttttgaagattttattagcataacttaatctatttacttttattgagatgattgatatgcctggacttttcyttgccattttattttgtgtttcttgtttgctatgctttcttgtgctacttttgccctttcctgccttttattgaatcaactgtgttttctttgtccaggtttttgttccttaaagcagttttctcaacagcggccctgtgtcctttgggtgggactgttccttgggctgtgggagtctttgctgcaccacagggcgtttggcatccctcaccctggacactaagctacagcagactccaaccgtcttgtgacaaccaaaaagtcccctccccctttctcccagtggagagccatccactaagggttcaataatacattacatgtttgtttttctagtgactgcttatatgttaaagatacctttatgtttacacgtgtctctcaacgtataatcagtgtctcctggaacaaattgagacctttctatgcctcaatgtccttctgccccgagctgtatcactacctaacatgaggccagctgggattttagttccaaattttaatagttaataaaaaccaattttttttttttgagatgagtctcactctgtcacccaggctggagtgcagtggcacaatttcggctcactgcaatctctgcgtcctgggttcaagcgattctcctgcctaagcctcctgagtagctgggaccacaggtgtgcaccaccatgcccagctaatttttgtaattttagtagagatggggtttcaccatgttggctgggctggtctcaaactcctgacctcaagtgactcgcccaccttggcctcccraagtgctgggattacaggtgtgagccaccatgctgggcctcaataaagttttaatgataagttttagttttttctcactactgcttttgcattccacattatgttctttgattcatttttaaaaattgtggtaaaatgcacatcacatgattttaaccattttaaagtatacacttcagtgacttccagtacattccgatgttgtgcaaccattgccactacctaattccagaacattttcattatcctgagaagagaccctgtacccattgagcagtcactccaatttccactcccccggccgctggcagccactcacttctctgctctctggattcatttttgtggttgctggagcataccgtttggtaattctttccaagagggtttgtggtggtgaattttctgtatcttcacatttctgaaaatgcctgtttccttcctaaaagctgagtagagaatttaaggtttatgccatttctctcctaagctctttggagatattgtttcattgacttgtatgcatccatgtcctcaggaacagtgactgctaagtcaaatacagtgtgtgctctgcaccagtgctttatacatagtaagtcatttaattctgctgacaactctgtgaggtcggggctgctccccacttaacaggcagagaaagtgaggctgagtgaagagaagccccacatcccttcagctaggaaagaggccaccccggctctcgagaagttgccatctactgctgcagcttctgctcctctgtaggcaggctgtgttgttttctgggataatttggcatttttcctttctccctttgatttttatgttttctttttcatatagagtcttgctctgtaacccaggttggagtgcagtggtgcgatctcagctcactgcaacttctgcacctcccaggttcaagtgattctcctgcctcggcatcccaaggagctgggattacaggtgtgcggcaccacacctagctttttttttttgtatttttagtagagacggggtttcaccatgttggtcaggctggtcttgaactcctggcctgaagtgatctgcctgccttggcctcccaaagtgctgggattacagtcatgagccaccgtgcctggctgtcccttggattttgaaatttcaccactctgtgcccaatatttatttttattatttatttatttatttatttatttttatttaaaaaaaaataattcaaggccgggcaaggtggctcacacctgtaatacgatcacttttggaggcaaaggtggctggttcaccgggtgggggggactcggtgaacaaccttccacaattggggaatattccagttgtacaaatggcatgaacgcttccggagcaaatccttggaacgtcttactgtgtggagccccgtgcaagccctccaacaaaaaaattaaggtgggggggcagagcgcgtagatgacatggcccagaggtataaaaacaaaaatgtctgcgcggccgttgtggatcatctaagccctacggccacttaagctgggtgctgtttaccaggaaccgaacgacggggcgcctttcttttgaagctgaggtcaaggaacactaacgtcaatatgggtgtaaggatagcgttactcattattagggaaggttacgatcctatacatgctgtagtacggaggaggctatcgacgtattgatcttgaaagagaggcaacgcgaacaggttatctcagctgtcgctgagcgcgatatacaccgcttatggatagggacttacggaatgtgggatctagaatgaatatagccacagttctggagcgcatgttgaagtagtgatgatagagaacccatcataactcaacattcggctatacatattagtgtgagtctcaatgttgggtaatgtcgcagactattctcgtgagtannnnnnnnnnnnnnnnnnnntatatgaactaccttggacaggaagtaaacccacaatcacaaacgtttgtggagtgaaatgatcacagtcttcatagctacacacgcatcacacttaagagtatcacgcaaagttagccaaggactacaaagcattgccagtactctagcactcactttccttttacggatgcaggccaaaagacgctacagaagtctgtgtacattttggatcctattaaaagcttttaatgtgtccaggcatggtagctcatgcctctagtcccagctgcttgggaggctgaggcaggagaatcacttgaaccaggaggtggaggttgcagtgacccgagatcatgccactgcactccagcctgtgcaacagaacaagaatctgtcacaacaacaacaacaacgacaacaacaacaacaacaaaacataattctactttgcatgtggtaggttctgtcaatctgaggacttgtgtgtttctgcattttcttttctaatttcccatattctctcaggtctctttttggaattccttttaggtggtggttggagcttatatccttcatgtcttttaatttacttttatccttccatctctgggtttttgtgccatctgggagagttcctgtttcagccctctaggtgactaatttgatcttcatctgttccatgctgctattcagcccctttttaaactttaatgatgaaatgtttggttcccagatctagttcattygttttaaatggatgtgatagcctctcccctctctctgttttctcgttcaaagtgtcattctgcttgtcctagtacccaagtcctcaggggtgcgttcgtttagcagatgagtttggtgtgcctctttcgacgtgtaatcttcttaataaggtgggtgattctgggttgcctgcttgtctttgtgtttgaaggtttctgttgtcctatctgtgaggctgaactcacatactggatgggaagagctctgcactgtggtgccagctggagcagatcccagtctttgggtatgggctccactgacctcctgtgtgttgttgccactcgagggctgtctcccctactccctgcttctgcctgcgggcagttgcttttgcaggtcactgcttggcatcatggccctgccagccaccctcacatttgatttggggcttcttctgggtcctcacttgctgggcttcccagattggagctgccagcttcatggcagccctctcccggatatgctttgccctgtggtaccatttccaatccgaacccatcaaccttctgccttgcaagcattcttcatgattcctgccctagtaagaacctcattcttcttcttttttaaaaaatccagctcctgcaggaaagaaccccattctggtttttcagcactgctatggatttttaaaaaagtgtttatgttacttttagggttttgtattgggaagaggcagaatgtgaccccaggccaccattttggcccgatctctattcatttttactgggtgaccttgttgcagaagagatttataatgtggcacatcatttcatataattaccatgccatggtaattatttcctgggtcattaaaatttcttcataatcactattttaatgactgcataatatttctgctggtgggtacatctgaattgactttgctgtttcctttttcttcccaacatttttttttttkctttttttcttttttttttttgagatggagtctcactctgtcgcccaggctggagtgcagtggcgcgatcttggctcactgcaagctccgcctcccaggttcacggcattctcctgcctcagcctcccaagcagctgggaccacaggagcccaccaccacgcccagccaattttttgtgttttttagtagagacggggtttcaccgtgttagccaggatggtcttgatctcctgacctcgtgatccacccacctcagcctcccaaagtgcwgggattacaggcgtgagccaccgcgcccggctctctccracattttactataataataataataacaagccacaatgaacatcttgtgcttgaaattttgtccrtatttggaacattttcctaaggtagagtcctaaggatgtgtgtgtgtttgttaaaatgtacataacatttaccattttagccatttttaagtgtacakttcaatagcattaattcacattctgtgcagccatcaccaccatccatctccagaactttttcattttcccaaacagaaatactatagcmcttaaacagtgactccccattccttcttcctccagccccgcaaaaccaccattctcctttctctccttctgactttgactactccagatatttcatacaagtggaatcatatagtacttttgtgacgtgcttacttcacttagcatgaggttttcaaggttcatccgtggtgcaagtgtgtgtttgaaatgcccattctgtcacccctacctcctggctgccctccctgagatccaccctctacaatgtttgggaatgcacagtaatctctcaggaggtggcctgggtgtccctcttcattcctgtgcaaaaggattcttcctggagactctgccatcctcattcgcttagtgattcatctcagagctagagccaaatgaaatggatttcgttcccagcagggctagtttgaaagtttgtgctcataaacttgctttaccgtaatctataaattgagttttcgcgctctgccggctctatttctcccacctctgccagatgtattgccacattgggcctctgggcccaggcacgaggggaggccccaggatgctctgtgcttatggaggtgcagcagggattggtgattggtttgaacatgtaattgcatttcattacttgattactgctgctgctgtcaccgagggagctagggagctcctggtacagctgcttgtcactgcagttcatgttctaatatctgatcctaggagggaatttgatagagtagaaggaggagaggaggaggggcagcccctgggcaccctggacagcagatcctcctgaaagccatcagcagtgctttcaccaygctccctgtcctcgtcagcaacttctgcagacaccaggattgcccacctcccagattatctcatggaagcctctgaggcagctgctactatttattggaacctctttgcctaaagtcatagctggagtgtgctccccatggtgggatgggtgctttacccacaggagttggggggagaggggagggtagctggagttttcccggggcctggggcagggggaggggatcccaccccttcatcccatgccaggcagaaaagggtggaggcaacagctggagacctggattgcattcctggctctgcaatcctggctgagtgagctgggatgagctgcttaacctctctgaccttggccctctcactgtaacacccctaggttgtggccaggttgggtgaagctagcacttcaggctggtctccatacttctattcccaacacaattgtcagagtgagcctttgaaaataaagggaggctgtgactcttgcttacaacccaccatagctccccatttccctcagagtcgaagcccaagagaccctcatgatcttgtctcattttggcctcatctactccctttctccctgggtgcctccccttcagccacagtggcctactccttgctcctgcagcaccccaggtatggtccagcctcaggacctcagagtcgttgcactcccagttccccccaccctgaacgccctttctgggacattcatatggcttcccttctaccttcactgtctccgtgagacctatcttaagccccatcttaaaacccatgacaagccccaatttcctatttcctgatctgtttttccatagagcttctcacctggcactcatgatgtatatgtatttacttgtttagtttttagtgctttctctcctgctagaatggagctccatgagaacaggttctaagtctggttctcaggtgaatcttaagsgcttggtgaccagtaggtgcttagttgaatgaatggatgaatgaatgaatgaatgagggagtgaatgagtgaatgagtatctagcagattgccctgcctatggtagggtctcagcaagggtgagttcctcttccctgctgtccctcaccctgccatgtcctcaggctcaacttctggctccagggaacggacagggaggatgccaggcctagcctgtgtgggttctcttgtcctcaggccctggggcatccccaggacatcagaagtgggcttttcatagcaggagggggctgcaatctgagctttactcccaacctgtcagcctgtgtggacccctggtgtgggctggccctggcaggcagagggcaggaccttcggagtagccactgcagcagagcacggagcttgactggtgacagaaggtgtttttcagctctggcatggcttctgtgtggcagcagtggccatgactaggtctgagttacatgcgatgtgcagaattaaagccaaggtggggccatgacttctggggtccactgtgttctagcagctgcagcaggttagacagccactcctggcaccagcactcaggtgctgagtcattgccttttcctgcctgcctggagggggccttggcctttctcatgcctctgaagaggaggcaggcagtggggtgaggctccccaagcacctgggcctttttttctgcttggggagcccagcccagcccttcagtctatataagtcaaaggatgcaggtcaggggcagtggcttgtgccagtaatcctagtgctttgggagaccaaggtgggaggattgcttgaggccaggagttcaagaccagcctgggcaacggcaataccctgtctttacaaaaaaaattaaaaaattatctgggtgtagtggcttttgctggtggtcccagctactcaggaggctggggtgggaggatcgcttgaacttaggaggtcaaggctgcaatgagctatgattgttccacttcactccagcctggatgacagagtgcgaccatgtctaaaaataaaaataaaaattaaaattaaaaaatgacacagtttggtggaggatcccttgacctcctgctctttaagtcagtcaggaatggggaccctcttgctttcatggcccagccagaagcactggctgagagaatcgagtgtagggtccttgctgcccgaggcctgcccacctcttcttcttcctgccatcccagcagaagtggggtgcaaggatgccagatgtgtgttcccaagaaatgtggcagtatggagratccacactttcagcaggtgagatgtaattgtgggtaattgaaaaacaccatcaaagctatttgtcataatttttacaaatgctttcttcctgggtcattcataacacttctagaaactcacaggtccacagaacacccactcacatgctttcctttactctgcaggagtctgtcttgctcagagtggggaagggggcttgtggatgagccagccaggcctggaggtgcggcctccctcccaggagggagctgcaagccaagtatctagaatcagagtatgaggaggtcaggacaaaggggcggctatgcagacttgggatgagccctgaagctctgagcagatgcccagggtgggcaggtccggggggagttctgccttctgcagagaggcaaggggtggggagctaggcagctctcttctgaggggattcagatgtgtgttgttctgtactgagtggtcctagggccacgtggatcagaattgccaaggccgtacttttatacagattcctgtcccaacacccccaccagctggactgaatctcttggggaaggggctgagcatatgcattttagtgggggtgattcttgtgattcttgtgcacactcagggtgagaagcactagcttgtaataatgtgcttctgaatgccagcctgtccatgtctcatggaaaatcatataaaagcaagacagccatctcatctggcagctgaatgggagggaggctgaacaggtcagttggggtttgtgggtctggtgagcagcgcccaggagtgacctcggaggatgcaaggctggtgctcaggagccctggggctttaaattcacagtgctggcttattctaggctaggtaccccttgctgtctcaggagctggctccatctccaccctgtgtcccatcttccactggrgctctgccctccygagcctggaggctttgcctgggctgttccacctaggctggggcagctttgaggggcctctgggtccagcactggagaaaggctctttgtctggtttcaggcatgtgcagagcttcaggggccaggctgtgcctgatgggggggattgttgtatctctggagactctggagaacactggcttagactgggttcccttgcaagtcagggctgcaaagcccctgacatgaaggagctgtcagtcctggctgtgagggtgtgtgggagggtggacagtgagcgtgatgtgatctctgccttactggccaaatgtgcagaatgtattggcagctcaaagtctgcctgggggattctggggcacacctggtggcatgtcccagagtgcagcaccagaaggtcatggggagtgttggtcgagtggaggtccccagtgtggaccagagtggttgctgtgctgtctgtgaccagttctagttccctggctatctagtcttatattttgtgatggtcttgctctgtctcatcaaagtgggggatgggtgtgtaggtaggtgaataggtgatggatgggtgtatgtgtagatggatagatggatgagtggatgggttgacagataggagttagaaaaatgggtaaatggatggatggatagatgaaaacctggctgagtttatagctgcctgggtgggtgggtggccagtgggatgatgtgtagatggatggattattggggattggagctggataggtggctggatgaattggaggttggggatggttggatagatggttgggttgatagwgtgtgagtgggagtagatagatggatgggtggatggttggaggcagatgtatatgggtggctgaaggaaaatatggggrcatatgaatggatgggtgggaggatggatggatgaaggggagggtgagtgcatggatgggtcacaggtggatgggttaatgtggctggaaggaggcattgtggggcaggaagcagatcaggtgggtgaccaggttcactgatacaaaattaaactgtggccagatatgccaaaatccagttccttgtgtgactcagaggctgtagtagttctgagaggagttccccagccctggactcattagaggaagcagccccagcccccttcctgggccacatagaccatgttcctgccctgggcttttctctgctccatgtgctgatgcctcagccctccttgcctggggtccaggagtgctggctggcgtgtggctatgcctggccagggtgacaaattgcaagaaccttgcagtggctattgggggcgggggctggaggacaaaggctgaggaaaatgggcctttgctttayggggtctccacaaggcaatgtgctaagtgctttcatcatgttgctgtttcatgtttgtgacagctggggaggtrtgggccccacagatgaggagtctgaaggtgacttgctcaaggtcatgctgtttgacagaggcagagcctggaagcttgatggaagcagggcggctctgaactaggtgcggcacaacaggatcggatgccagcagtgggcagaaggtcagtcctgggaaggacaggttacatggaggtcctgactgcaggcccaagcaggggagggcttcagggagggttcccatgggatggactaacacaaagccttggtggctctgtgatggatcctgggggctctggctctgcaccatgtggcctttctgatgctcctgcagtaggtctcagggcactgggcagagctccaaatggcagcctcagattccgggccctgcctagagggctaggacagctggcacacatctgaggagtgctgggaaaggggactgttggcccaagagctgaggttgacttcataagaggtgccaccttcagagagcagcctcctcagggggtcttgttctggtgagcagcaggcacctcttgcagcccactgaccctgtccttctaagggcacctgtgccaccatttcccaggcctggcaggaaatgcccccagaacacctgaagcttccttgcccatctctgagctaggccagggattcctctgatatttccccaggccaggctctgtaagcacagctgatcccaccctgaggggtcagggaggcagatggccactgatcaccagagcccaaggagtgggaggagcccttgtctcagggatctgagccacctttatgccacctaccatcatctggagtttctgacttcatggttgggacaacccttgggacctgtcccatccatgctcatgtggggctcattctatggtgggttgcaggcaggagtcagccctcagcagctcaggccctgagcaccagctgaaagcagccagttccacctcttggctacagtatctgaggggcaaggaagtggagcttcaggagtgaagagctggaagccactcatgttcaggaggaagaagagaggaagctggacctgatctgcccttaacaaagaaagataaagcaggaaaaaccgaaaactaattttagtgcattaggctagagatgggagagtgtttatggatcatttagtttatggatggtgataggttagtggttagattagcaggaagccagtcagcttgaaaggagggaattaatttatgagattgcgaaggggaaaattgtttgcaagaaatacaggggttttgttgtaatagcatggagtttggcagaaacaacaagcgccgacaggcccagctgtccctcagggagccagccaccaggagcgccagtctgggggctggggatgtgtgggaagagtgggacgccccagcgcagggtgcagcccagctctcacttgctcctcagctggggagaaggctgttcctctcccacgaatttcctgggctttgacattgaggttttggattggaagagggtttggtgataggcgggcaagttcccggacgtcattatatcttgtgccaaggacctactgaactgagcctaaagagggagayttccctgccacggagactcccctggtggctcttcctgcccctgtgccacacttcaagttctggggagtggggatctgaggaggggagctcagaggcctggagagtcctctgttcattacactaacatttcctatgcatgacagggccagagggactgggttccaattccagacccataaattagtggctgagtgatttggacaagttgttgagcctctaggaacctctgtatccttatctgtcaacatctcagggttgttgtgaagatgacctgagaagatatgtgtgaggagcttggcctggtgcctggcacatggttagtgctgggtaatgatcgctgttagtattttcatggttattttaatggcagaggaattaaacagagcttgccaagttccagcttctgatccccctttccccacygcatagtctcaaccccagttccctccacaggactttcctcttgcccaggctcctcccccagccctgactggcggctctgtccaacccacctggcctctctcagccctagagcctgtgctagctgagctgtggctaaaggcttggggcctcctgaggctgcctgtgctctgctctgttgtttcgttgccacagctctgcaagatgctaggcatccttgaggcgtgcctgagtttgggatcctctgtcctggtttcctgtgctgcagagcctcttgggtgtcctgttgctcctccctcagtgggtgggccaccgctaatgtggccactggggtttgtccactgacacccccctactgcagaagacacactccaggctctgttcactgcagtctatgtggatggcatcccctggggtggtgcaggtcacagccctgatagctcctaatagtttataaaaggctcagtctcccaagtcaccttgtgagatgtgatcgacagtgatttgaagaaaggtggaacatcttgcccaagtcgcaggactagtgagtgttggaaccaagatcggaaccttccttccatggcacccactgcttcctatttcactggcccttggggtctaagatgggcctctccatggacttcggggaggcagaaccaaggcttttgaatccactgccagaggcagatgggaagaaatccttttggaggagcggattggaaggaaagcagtcccctccctttgctgactaatgaagggtgaacttgctccttgggaggcgatgggtgagtgctcttgtcattagctccagcaaagaaagggacggtgtgtttagggtggggtgggagaccaaagagtgcatttcctccagctacttcttggcaccactgtggaaagtcatttttccagcatgggggaatttgttttgaaagtgaaatgactctgatgtcatctgggcttgaaggagctaagccatctagaaacatttggagataggtttgccttgttttcacccacatttaacttcacagtagctgaggcagcctgaactttacagaagtgccctgtcagcagaaagagcctgtgcrgtggcagtcagccacaaggcactttgcacaaattacaagtgctgggaaacaaaggccagcccccaatgcagaagtgggctccccagttctgtttacattggtggataccctggtttgaataatctgtgagaatctcagacctatagatcaagggtttcaaaatcagctaattaaaacagattgtgaggctgccaatttgtcttttcttttaagacaaggtctcactctgttgcccaggctggagttcagtggttcagtcacatagctcactgcagcctagaacttctgggctcaagtggtcctcccacgtcagcctcccaaagtgctgggattacaggcgtgagccaccatgcctaaactgccagtagttttttgagttaagttttgaactctcaggttggatggatggaagggcagagggagagagagagagcaagagaaaaagaaaggcagcagtgcattttttttttccactctggcagcccagtgttctcaggagcccctgcacctctctaggcatttatcatacaagtgtggtctaggcatttgccctgcctggctagagaggcccaaatgggaaccagtaactccctcaggctttggtggagrcaagttttgttgtggagccacaccccatgatacagcaaagcattatgggagcaagtatatgggtgacacccatctgctgtcctgattaggtctcccagctgccccgactaggtctcccagctgccccaggatatcctcctcctgcttgctgaagctgcaccgtgcagtggaaagagcatggcctttcacgtctgacagtctgagtctgtacttgctggctatgtgatttaaggacatttcttaatatctctgagccctccttttgtcaatggtaatgagggaataactccggctcagtaggctcttggaggattgaacaaggtaccactatatggtgtcttagttctgtggctggcacagaggagagtctcagaaaatatcagtctacctttcctccctctctcctttctccttgtcctcactgcccctcctcttcctcctgcccatgtcctcctcactctgctcctcctccatcttgacccacgaggctctttcaggatggattgcctggaaatctgtcatgctcaccttcctgtaccctctgctgtctgggatggagagatctgagctgagagataacaggctattactgaacagactgctgcatggtgttaccaaagacagccaagttgtaaattcctctgactttggctttttggatgctccaaaaataaatgtgggggcatttcagtctccagcagactggggtgctccagcagatgtggagtctctgggctgaggtgacagaggggcagcaggcatgtctgtctaggtttgagggccatcagctgccttttctggagtctccatcctctttgcagaaaccatgygtggcgcagtgggaagcctggagaccaggtagatatatgcctttctccccaacactcaggtacctgctcctcagcaagggcactggctggctgatgcacccaattgtgattggggtcctgagggctcaaggcatattggtggtgtcagacacaagttggaagctgatggggtcttgctgcccacccatctaccccacacagggctggggaccaccatgacagatgctggtctggtgaaagtgctggggatggagaggcacaatggccaagtatataaagaatctcagtgtggctctgtcctgagcagccccttgaggtacagtccattgagaagagcatgatggagaaagctttgggggcattgggctatgtctgttcaccatgagacccactagtggctatgggcctggttagaagaatctgggcttggggatggggccaggaaggtatgagggctgcctcaaaatttctcagggtcaggtcagagccagcaggagagccaggtgagggtgagggcactgccctgggcacaggattctggctcagcaaacagcagaagtgattcaagcagtgcaggtggtggagctgaggctgctgaccctagcaggtggcctcaggccagccggcttggacataaaggggtggtagtgggcttgaagctgtgagttctggaaaggtggtgagggagagatggagaagagccagctgtgtcctggctggaggaaacacagttcagaggctgaaatcattgaggcactggcatcctctcttaggatgtctctcccagcagtgaggctttgtaggaggagggacttcagtacaacctttgtgtrctaattggacaaatatacttcagaaggaaggacattgaaggctattgatcccattctacttattggacsttccttagatggttctttgacggcagtgaccatggaggtcagaggccacactgctagcaattcaagtccccyataaagatcactgggagaacaaaagctgccatctctagttcagagttcctcccacgcggtgctgccaggacaggatgctgccaggtagaacagagaaggccatgtggacttctccgattctttactgtgttgaaacaatgcctgcgggagccacaacagctgtgtactgtgcccaggacacatgagcatgcaggcatgatcccttttatgtatgaccgctttcttggcccaccatttaactccctgcaaactatgccagtacttcttccagggtagttctgacaagacccaacactgctcagttactttatctactatggttttgttaattattgtatcattagtataaggaggggggcccttaatggatgaccgaggatgctgtctgtaggctcttgtctcatctggaccccatttttcactttgtcaaactccagctgtgtctttgggactcaccttactctgttgtcttaagaaaattaatgctctgaagcttcctagccccttatctctattgtgactttataaaccctaagtactaagacaagttttcctaaattcactagtttactctattgtcttcctactgacatagagtataggctatatccaaacataaattactagataaatatatttttagaaaccatctgctatggtttgagtgtcctctccaaaacgcatgttgaaatttaatttccattatgatggtgttaagaagtgagaccattaaaaggcgagtaggtcgtgagggctctgctctcatgaatggattaatgtcattgagggagtgggttcattattgagagtgagttgttaccgaagtgaggtaggccctctcgtgctctctygtgctctcctgcccttgtgccttccgccttctgctatgagatgatgtggcaagaaagccctcagcagatgtgggcccctcaaccttggacttcccagcctccagaagtgtaaggaataaatctctgtttttttaataaattacccagtctcgagcattccgttacagcaacatgagatggattaagagatcctctaaccaagtgtatttaacatacttcccattggacctaatacatttccttctgcagcatagtagatttctcttttgaacaataccaccccatgggagagtctgtggcttgtgaacagtgacccacagtcactctgaggctgggtgtttggtgtttgtatttcaccagttcctttgggcatagacttccttgcctctccaatctgtcaggatgtacagaagcaatgacctgtttcaaccaaatatccacagaytctggaagtggctctggggctgggaccaggggctagggcctcatcccaatgtctggtgggccctagttcaggtctggaggtagacggacccagctggccactcagaggtgggctcagtttgcacatccatgaggataaagaggaactgcttctggaggtggggcaggctggaaagtgagtgtctagggtggcacrgtcaagatgggcaggatggcagggagtgagagcagaattctggactgcagaattcacactgaggtggaagccaggagtggggatgaagaatggtggtccttgggggaggggatgtagggggctgttgttcaatgggtataaacctacagttgtatgagatgagtaagttccggggatcccctgcacagcatggtgcctgtagttaaaaacaggagattgtatatgtagaaatttgttcagagcgtagatctcatgtttagtgcacaaacatatgcacaaaaacatcaacaaaaacaaaggaacaaaggacattttgtttttacttgattttcctccagctttattagatataatggacaataaaaatatttaaggtgtacaacatggtgttttgatatgcattgtaaagtgatcaccagaatcaggctaatgaacatatcatcacctcatatagttaacatttttcttttttgtggtgaggaaacttaagaaattctctcttagtaaatttgaagtatacagtacattattattaactataatcttcgtgctgtgcattagatctttagaacttattcatcttgcaactaagtttgtaccttttggccaaaatctccccattcccccccacagcagctcctggcaaccacctttctatgctctgcttttttgagttctacttctttagatttccacatataagtgagattgtgcagtatttgtctttatatgtctggcttataacaaagcataacgttctctaggttcacccatgttattgcaaatggcaggatttaattcttttttaaggctgaattccattgtgtatgtataccacattttctttatccattcrctcattgatggccacttaggctgtttgcataccttggctattgtggattatgctgcaatggacatgggagtgcaatatttctttgagatacagatttcaattcctttgggtacatgtccagaagtgagattgctgaattatacggtagttctatttttagttttttatagaactgccaatacccaatactgttttccataatggctattaccaacttatattcttaccaacagtgtgcaaagcttccattttctccacatcttcaccaatacttgtcatcatctggggacacaaggtaatttttggaggtaatggatatgtttattacttgtactgtggtgagggcgacacaactgtttacacatgtccaaactaaccaaactatagatattgattatgtgcagtgttaggtataccaactgtatcgcaacaaaggtggatcagtacctcggacagcgccaggaagacacagttatcctaagctctggtaaggcagaactgtctggctctctggaacttttagctgttagggkaccttaggactctttaatgtcaacatggtcctcagggactttggatctctgtttctggaggacacctttgttttctagcctgggtgctggacctccttcttccccctctctctttttcccttcctcctttcttcactgctccgactgctggcctctggaagccagatcatggcaatcacaggagggagagattggagggaactgagcccagtataggaggccttcatcttgaagtccctttggtttctgagcccaggttaccacaggtttctacttggaaatttctagatagtttcccctgtctgtccctgggatttggaagtctccttgaatcagataagggagtgccaaatgtgactaggagctattttaaatcactgggaggaagctattggggaatgttacctgaacaaagagctttctccactggttttggctcaagagagccctgtataagccaccagagcccatgaatactcagtccttgtgagagccagagctgtagcaggggaccaactggggcctggggctccagcatgaggggctcccaagctaggtccctaagctcagaggaggactctttcttttaagatctggagaagaggctagtacccacttgtttgcccaaagccttgactaaagggttttgatggaacgatccctgaaggcttttcctcctctctgcatccacaggtcaggtggagtcatcttttccatggctgagagacagcaggaaaaagtgtttctaaatgtagtcagggtagatgttggggcactgatcacccccaagttatggtgggcggaattgggctggaacataggaatgtgcatttgtaaatgtcttgtatcaaggtcttcagaaagagaaggcttgtgtcttaactccttaagcctcaagttcctcaactataaaatggagacaatgttatagaatttttgtgaagattgtagacaaagtatagaaagtgctcaatgggaggctcagcccctcctttctccccagagggccagaggcattgtgtgatcctcctctctgaaatcccaggggagccatctgttctggccccaggggaagaccttattggaatccccagttcctgttgttcctgagagataatgctgccactcctcctattatggtggtggtggggggcaaaccgagaaatgtctgcatgcagaggccctcactcctccccactggctgctgcctccacagcctttggggcctcagatgtgatgttagacattctagtgcttcccaggcatgagggaccaaggagaaggcagtgaggtctgagaatcacatggttatgcagtaacaactctttcttttgggttttacacaatcctaaagccaagatcaatgcccagccatgtcacttcccatcagtttaagagaaatagagataggcttatgggacacgtctcagagcaggcacaggccctgcctctcagcacctgtcgtgtgctcctgaccaatgatgggaagttgagggagggcttcccccaagagatggaattagcttacatgagtgtaggctctggcaaagtgcgaaatctgcagagcaggctggagacctggggagagttgatgttgcagtcttgagtctgaagacagtctagggcagaattctttcttcctcaggggacatcagtttttttttttttttccttaagcccttcagctgataagacctacccacactatagaaggtaatctgctttactcagaatctactgattaaatgttaatcacatctgaaaaataccttcatagcaacctctagactcatgtttgacgaaataactggcccccatagcctagaaaaattggcccatgaaattaaccaccgcagacagggacaacgccacccagatgctttaaagtactgctctaacccagatgtagaccaagaggctcagggctgagaacacccacaccttgaccatggaaagcgtgtggctttgaagtttgccagcctgagttctaacccctgcttctctgacaaagacaagtttccttgtccctcttgaagccttcatttttccatctgtaaaatggagatcgtagctcatatcttacaggagtgttggagatcgacagagatgatggatatggcaggactgagcacagtgccaggccatgagtcataccttaccagtgtgttagcttcctcccagtttctctttctgcctttgggggcctctgtcagcagccctgaaatctgccatgccttctgtgctcaggatagtggacagaggcatagttctgtggggcttagcaggtgcctactgggtcctgctcagaggtccaggagcagaagtgttcttctgtggaaccccagcagcagagccaggggtgagcaagggtcaggattcacagggagctgagtgaggcagctgagggtgggacatgtggagcatgtgtccaggggcaggaagaggaggagtcccctctgccagatgtctttctcaacataagtatgttggggctcctgccttctctttgtcctggtgcatcttaaacacacagcttctgggcttcccaggagacatcacacagtgagccgaggggcagaatgcattttgaagcaggctattgaggaggcaggacaggtaggaggtgcagagaagtgcaatggagtgagctggggtaggcccttgggcccctcttgatgcctcctctgagtggggtaagagcagagagagtcactaccagggttgggggcttcacagcctgcaagagtctccagctggaggggaggaaatgatggagataggaaaaaccatggcaacgagaagtaatgaccaatgacctgagactaaaaagggaaaactggtgtgtctttaaaaggtcagaggcagtgaggtcaattaagcctggagataacatgtggaggcagatcttagagggtgtgcccagaaaagccccaggagagacaggaacggctcaggacgagccctgctggcgtctcctgctgacatctgagtgcccagaagagattcaggtgaggcttctcaaatagctccctgtgcaactgggtgagctgctggtggattggagagagcccagggctgtcagtgaaatcctgtccacaacccttaataactgtgtgatgtggggcaacgcgatgtccattaggtggctcagtttcctcatctgtaaaagggagctaatgagaccacctcatggaatggcaggaagatcaatgaggaaaataaatatctgcagctgtcatgcctcttagatagtgagtgctcgagagaggcatgctctccccttgcctgcttcttccctgtgcccctccttcctgctgagcacagtctctgtcatgtggggagagaacctgtgctgacatcctcctgggcagtgctccactctttgttcagaaaaactctaatgaagtaagaggttctttccttatatttctaatttttttaaaaatatttttgtacatacagagaagtatagactagtgtaatggacatagccatttacatctggatttaaacattgttaacatttgtcatatatctgcttcatctattttttgttgttgaaatatttcaaagtaaattacagacatcatggcattttacttctaaacacttaagtatgcatccctaaaaattggaggacattttcctacatttcatgcctagcagaataattctaatttcttaatatagtctaacacaatccatattcaaatttccctaattgcccccaaaatatctcttatacctgattggttccagctgggattcaatccaggacaacacatgtgattcattatttcacataaatctcttcctatttagacgagtgtttgtcagacttctgtgtgtgcacacagatcacctggagatcttgctaaaatgcagattctgcttctaggtccagggagggcctgagattctgcatttctaacaagctctcaattggcgctgctgctggtggttcaagaaatacaccttgagtaactaaggtctagaacaaccccctttctttcctatgacattgacttgtatagcatgggccagttgtcctgtagaatgtttcagctactgaatctagccaattgcttccttagggtgacatttaacctgttcctctgtcccctgtattgcctgcaagctggaagttgggtctggaggtgagtgtgatccagggaaggcatttgtggtaagcatacaggattgggggtgctgtgtgtttcaaatatcatcatatcaagaagcacatccacaaacctttcactgcgattcatggttgagcatccttggccatgygaggttgtaggcagaggctctgtggatgtgagcatagaccttgtggggaggtggggagaggattcattggttgcatcaaattcccaaggaggtgttagaagttttcattcacaaaaagtaccccagagtgcttctcaaacctccgaggctcatcagtgctgcccctggttcccctttcttttcctctgctgggcgaggactactgcctcttgctgcagatgtgtctcccaagaaggcatggtggcccctgtggagtgagtctcaaggaggagctgctgttcatgtccaggatctgcctgccaggctgggccacatcctgcagagacctcacctggctgtgacctagaccatgtgccagggtgaggagggaagctaagggtcaaataaatggagctgtgtgagccaagtgaggcttttagcacagaagtaggtggcgggctgggagccagggaaggccagaagtagagtgagggccagtcaggtggcctgggagccaggcagcaaatcatggctgtgtctgagcccatttttgggggtgcaaatatagccttgatgacttaagagggtctttcaggtacaaaaccaatgaagacacctgaaatgtgtttgatctgttgaatcagaaagctgttatccgagggctgtgaacatctgctctttttaatagtactgaggccttaagaagggtaaagaaactgattgcagaaggggtccttggggtcctttatcagtgatgattgtccatcctgggaccaatggtgacaatggttcaggcaaacactgctcagaggcagagggctggatgcactggcttttggatgcactggctttctcattctcgggccttgggggtccctgctccccctttccttgggaaggtggggatacaaggttggaacagttccttgtggccaagggtccatctgctggatggtaggccccttgaaaatgggtctagatctgggtgagatgtgtgtctgctccccctttaaagagctggcagagatggagagaaaagcacatgtgtgcaggctcaggggaaagataatgctgtgtaattttatatcttattttatgctgtggcttagccacacaccattagcacaacaggaaggaaaatgaatggaaatgaagggtgtcagtggcaaagatagatagatggagctgattgatttttgatgtttcttcagtgcaacctgaagcagaaaatcgacaagccactctgagctagagtctgccagggcccccagcagcaggtccaaggtgaggtacctctcagctggtctgtggcctgtggcttggtcctcgtggtgagccggcctcattgtctcttttctgctcccatgggctggtgggtggggggcacctgaaagctaagcacttattccyttagccttccttggatggcaggggaccctccagggcctgtgcattttggcctaaacatatggactagcaatagagagggttcagcaacttctccaagaccgcctagctggtaaatggtggagatggaatttgaacccagtctttctgcttccaaagctcccactctctgcccttcccattccccaggatgctgtagctctgtcttctcttctgtcttttcttcctagcccaggcttcccggactgcaccctggactctaggtgcattctccaggtgggagtgggaagtggctggctgcatcagggtggagcggactggagcccggggaaatgctgtgcttggagtcccaggccaagctcaggagggttctttcctcctgctccagttaccatagcttcattcataagtgttggatagctcaggtggacctagaagaagctggtctttgccattcccaggccaggatcagcctgggagggtggaggctgcagggaactctatttaaggaaaagctctttccaggtattttgttttttccctcccctcccggcggcccagcccccatgcccccaaccgccccgtgccactctcctaactgcagttggcttaatctttctaaaatatggctctgatctccccagctcctgcttaccaagctctaatggctcctgtagggggcagccactcatccatcctgcccagcctcccaccccgattttcttttgcagagcctcctccctctactcctagtccatgacttctagtgagctggccagacgcagtggcagcccaccccaacgaaacagagtgtcctactcaccccagttggttcagggatgggcagccaccccagctgggccaatactatatccttaaagcnnnnnnnnnnnnnnnnnnnncctgtgcattttggcctaaacatatggactagcaatagagagggttcagcaacttctccaagaccgcctagctggtaaatggtggagatggaatttgaacccagtctttctgcttccaaagctcccactctctgcccttcccattccccaggatgctgtagctctgtcttctcttctgtcttttcttcctagcccaggcttcccggactgcaccctggactctaggtgcattctccaggtgggagtgggaagtggctggctgcatcagggtggagcggactggagcccggggaaatgctgtgcttggagtcccaggccaagctcaggcagggttctttcctcctgctccagttaccatagcttcattcataagtgttggatagctcaggtggacctagaagaagctggtctttgccattcccaggccaggatcagcctgggagggtggaggctgcagggacgtgtagtgtaagtgctataggctctttgccaggtggttttgtctttctccctcgccctcgctgctccttccgctcccctgcccttcccctcccttcccctcccctgtctttcctccctccctccctcccttcctccctcccctgttccctctggctctgtcacccaggttggagtaaagtggtacaatcatagctgatggcagtcccaaacttctgggctcaagcgatcctcctgcttcagccttctgagtagctgggaccaccagcttgcgccatcgagcccactgttttagttttctagggctaccatatcaaatttccacaaactggatggcttacaacaacagaaatgtattcttctcccagtttgggaggaattctttcttgcctcttgtagcttctgtggcttctggtgtgccgtagctttctttggcttgtagatgcatcccccattttctgccaccatcctcaaatgggcttcttctctctgcaatgtctctgtgtgttctctcctcktcatatgaggacaccaggtgttggatgtaaggccctccctaatctaatatgacctcatctcaactaatgacatctgcaaacacactatttctatataaggtcatattctgaggttggggtggatgtgactttttggagaacactatttagccaagtacatattccactgggccaggtccaggcaggggattggaaaggcctcatggagattgtcagcagtgccgaatttcagtgtccccaagactaactccagcacgtgggtctgtcccatttgcagtttggtggcccaagtgtcagtgggaaccagggtctttggggtagggagtgtggttcatgggcccttgactctgcttggtgttggagggacaggcacaagccctggattttctgctggctttctgctaagccctcacaatccacattggcaaagcgctattgaaatcttattgcccacttcctgtgtccaagtgttgtcattgttcaattccctcctatgagtgagaacatgtggtgtttggatttttgtccttgcgatagtttgctgagaatgatggtttccaggaaggggaacttcacacaccagggcctgttgtggggaggggggcgaggggggagggatagcattaggagatatacctaatgtaaatgacgagttaatgggtgcagcacaccaacatggcacatgtatacatatgtaacaaacctgcacattgtgcacatgtaccctagaagttaaagtataatgataaaaaaaaaaaagaaatagagaacaggacatggttaccagaggccaggaaagaagggagaatggggagatgctggtcaaaggatataaagtttatgttatgtaggatgaataaatgtagacatttattatacaaaaaaaaaaaaaaaagaaatcttattgcccacatggaaagctagttgttgtcctgcagtaccacatggaacaggcaggcaggattggttgtatgtgacgttacctctctgagcttgtgagggcatctataaagtagaggtgatgatagctccccttatagggccgggtgggggtggaatggaataggacatggaactacccccagtgcctcagatatgtgagctcctttcctctgcagctagcccgggagcttctggaagacgggatgctgtccactccttcctcacgtgccacccaggcttggcataaaattgcaggccagggatccgtgagtggtgaacaaaccattaccaatgtcagccttataccaggccagagctcagcaccgggcctccagacacaaactggatagaaccactgccctcaaggaaaccccaggctgggagcagggcacaggacactctggcaactctgtgtctgggagagttgcaggtgccgtaggggtggagtgggattgagaaacagagagggaggtgaggaagcctcgggggcgtgtttagctccaggatgagtcctgaaggaggggcctttccagggaggtggggagggcgtttcagccaccccaggagaagcacagtagaagcctgggtctccaggcctgggtgagtcctcacaagaacggccagggctgcccatagccccacacccccagcacaggggttctggagtgcagggagtgaacgtcaggtgaggctgaccttatagctaaagagactcctttgtctgagtttttatgtaatacacaaaaatgctattacattagaatggaaataatagagccagactccatggttctattttcatcttctatattcccttccagtccttggtccatagacatatttttaattatggcacaactacagctttggttgcaacttcctttattatactgtaaacatttttcactgttgctacagttttcataattatcatttcaatggttgcataaattggccattaaattgatgttctttaatttatttaaacatcaccttttgttagaggtttagattgttttctgtttctggttattataaatcatgttgaacatctttttgaagcagtcatttctttctaacgaattattttctcagaagaagattattgggtcaaagagtgtgggcattttyatggtacttgcaatggtaacgccaaattgctttcgaaaagatcatttcctgtcagtgtgcaagaagattggttttaccacaactcaacaagcatttgatgtggcaattaagcctttgyttttcattttctgctatttaatagatgtgaagtgacctcccattggattcccrgagaggtggattttcctgtgtttgctaacagcaccttcccatgggtggactttctgtccagcccattcatctgctggcctctgggagttttgttttttataacggtttgtgtgaactccttatattatagttatcaacgctgcctgacacactgctacaaatgtgtttcatagactatttttaattttagttatcttgtttctttcctacaaagcttttgtactttttatattgttgaattatctttttatttatactttcttttatcagtatgaaacttgagaaattatcactccctccaaggaatagataaatttttccttctatttcctgctaggtttctttcatttgacttctctagttgactccttaatctctccaccgtttattttctgatgtgtgaggaaaggtgtgtttctgaactaattacttttcctcaaaactatcagcgcaatttattaatcaagaattcctttccccatggcttgttgatacctgctttgtaatgcattaaattcttgtatgcaattaggtctatttctagatttttaaattctgatccatatttctatttttgtgcaagttctacagtactttgttattgctttctaataatttttatatctagtttcctctcatttcttttcatttattgaattttatttatttttctcatctattttcaaaatgattttagaataactttatataattccttggagaaatccttttgagattttgattgagattgaattaaatgtataagttaacttttgggaaagtaacatctttataacataaagtcccatctgggaacagttattttctctatttattcaagccatctttatagctctaaataaagtttggtagttttctttacacgggtcatgcacatctctagtgaagtttatttctaaatagttatactctttgttgcttctgtgaatgagatcttcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtctccctctgttgcccaggctggagtgcaatggtgcaatcttgattcgctgcaacatctgtctctcgggttcgagcgattcttctgcctcagcctcccaagcagctgagattacaggcacatgccaccatgcccagctaatttttgtatttttagtagagacggggtttcactatgttggccaggctggtcttgaactcstgatctcaagtgatctgcctgcctcaggctcccaaagtgctaggattaaaggtgtgtccagcctatttttttaaaatcatacttttaatytattgtataaccaagatggcaacagcattgcagaatttaaaaagaaaacaaaggaggaaccaccatctcaccaccttaacaagcaaatggttttaatttttctgtggttctttctagaacttgtcctcaaacagacagacattgggcacagctataaccacagtgatgatctgttttgcctccagtggcttcttctataataccatagcattttccttcttgtcacagaattttgctaatggtttcacttaacggtgagccactgggactgagtgttggttctcagatgccctgaagagtgtatggggacattggagatgggctgtggctgccagccatggtgtgggagccactgtagttaactcagggctggtggggccagtgctatggggaaactggccacttcccagtagcactagctagggccgagctgagctaagcccctcaaacctctctggcaacaggaggagcaagaaggtagggacactgtctgtaggggggatggatgaggtgtttgagtcagctgaggaactgcccctccacagtgcaggtgagcaggtgctttctagatcttgttggtgctggtgccaggtgggcgaagtttacccatcattggtgtcttcctcctggtccttttgtctctcacatacctgttgagtgtccgtagaatgtcgttagatgctggggatatggatgaccaagccaagctcaggtatgaactgcagtagcactgggcaaaaccccaacctgcagctaagggtggaaaaaaaaagaacacccacgtgaccagttttggccgtcatatcgcgtttctccgggccattctttctccactccgtctgaccttcccctctctttccgcatctgcaacacctcctctctcctccatgctggccacagccccgagcagcagagttttgttccctatatagttcactgaggagagagaaggtggcagtggatggcgatgctccatycccacacctgcctgcctacccacccgtgtcctggacaacgctcgggctcactgctgacctgcccatgtcctgtctgagacgccctttccttgggcactacatcccatccgtccgcctcctttgctccaggccatcacccagcagttctctccctcctctccttcatcatcaagtttccttctctagtggattatttccatctgctcataaggacactgtgttatctcctgccctaaagattcctgcgcttggtccacttcctctgcagctactgtcctctgcgtctcctctgccgctcccccacccacttacagcgaagctcttgaaaaggccgttctgtatgctctgtctcccatgcctttctctccattgctcctgtgcgcactgtggtcaggcatttgccctcacgactctcagagctgctccaatgagcattctcatgacttatgtgtagcttggtccagtggcccaatctcagtcctttccttacctgtcccgcccccactgttccccgggctcaggactgcagcctccctcctcctggctctgtggcgggtgcaccttcctagtcccattgctgggctcttctcatctccygacctcaaaacactggcatgtcccatgtccccaactttaatcatctgtcttctgttgtactccttttcttgatgacttctgaccgtctcacacctttgaatatcacctacccatggaggactttgcagtcctgccagcttgcctctctcgttagctctggattctctgtccactgcttctccactgggatgacataggcttcttacacaagcatgtccccaagctgggtgcttcagcccacaccagcccccgtgaggcttctccatctgccctccctccagtgctcaggtccagtgccttggggtcccctgcactctcccctcttcccatccccaggagcccacccttctagctcagcccactgaccacccccatggctaagccaccatcgtctctcccctggattcttggaatggcttcctgacaggtctccctgcctccgccctgtcccacttggtctgttctcatcatggcaccagaaagatgctggtgcacacagctcactcagatcaaagctcccaacagctcccatctcgctagaggaaaagtcagggtccacacaggagtcgccaggccttgtgctgcccatctgctcccccaggcctcagggctcactgccctgggccaccttatgctgttctccttgccttcaccagaaccggtatacctctcttagagactcaaccccagagcttgccccaggactccgtgaagcctctaccctcactttctggtgctgaccaggcctgcctagcctcctctccatactcctccagcttctacactaggctctcctgatcctctgcctcgatttagttttacccataacagtgatcacccgcgaatatactctatcatccactcagccatatttttgaattgacttaaaatgttttatttgactttattgcaataaatttttatttattatcttattgttattttttatccatcagccatttttaattttactagagccttagctccaagaatacagacatccttgtctggtgcaaatgcacccagcacagtgcctggaccagagacagcactgacgacgtttgtgggaggaatgagtggtgaatgaatgaatgaatgaatgaatgaatgcattccaccccagctgcagtgtctcctcccccacccctccctatcgtttgagtctgtgtctctgtgctgacaggttggtgtggatgcaggttccctgatgctgcagccctgaatccagggcctggtgctggaagcagcaggttgctttgtggggaatacaaaagggtctttgctctgaggattggtttggggtttttgtttgaaatgtaatatgcagaataataacaaaaaaagtctttaacatgtaaatggctctgcttggcagagccaagtaatcaaatcaaatggctcttcttctatgcctaccccatccccaaggcattgctggcgctaggaagttcctctggggctttgatagtcagcttgtgggggtagctgcaggggcctgagcagtgtgggggcccttctcctcaagtctcagtgactggcacgcctgggccagggaaagacatggggaggtaggcgatggctccttctccctccctggcattggagtgtgtagccccccagccatggcagccctgcatgggccacagggaaagaaagaaggagtgataacaaagctgggaaaggttggagctcgaggaagaccctgggcttcttgagaccctcccacaataacctgcaatggcacatgggttgggcagaggcagcgccggcacagctagggcacaggacacagctctgggctgggcatggtgccaggctcaggagtgagagactgggtctgcagcagggcctctgggagtctgaggtctgtgattttcgtagagtccaggcccagttggctttcttttcacaagggcccatccatctgcccccatccatctcttcacacagacaccctcactcacacccacactcacagagctacattccacactcacatctgccacactcacacactcatacatatacagtcccacacaaactcacgttaacatccacactcacacccacacttgcatacacacacccacagacaccgtcacactcacacccactcccgacactcacacctgcccacactcgcacccacccacccacatccacactcacactcacccacacttgcacacacagccacactcctcacattcacatgcacacacggaaatgccttggccctgaagagagggaggaaggcaggggtgaagggaggtacagggggacccctccccagcctcagggcagcagattgctgtttgctccatgggaccagaggaggtgccaggggcgacgcttatctgtgagctcaactccagtttaccaacaattgctgtaggagctgctcttcctgagaactgagactttcttcccggcatggtgatgcttccctagggcatgtggctgcagggcaaaaggggaatccattttcccaacagggaaatgtcaccctgtgcatcttggctgctgtcagtcctgacaatctcctgaaatgaagcttgcaggtgagcaaagaagagcttcctgcagctctgaggcctgcggatgtgccatccttcccaaagcaggaagcagggctggaggcagagcctagaggtggcgcccttgtggcttctccccttggtcaggttcccctgagtctgtgctggggcgtgcgtgctttttcttgcacaagcctgcagcctctgtcgtgggcctgacctggagggtgtctgtggaggggcttccctgaccctgtgtgtgggccccagtgcctcctctgctcaggtttccagggctggcagccccagactccaggtgatgatgacagtgaaggagaggaataggccctggcttgagaatcagactggcctgggtttgagtccttctcaaagggccctggctgggtaacttgcccttgatttcctctgtcaggtgggcatgatamcccctcgatcagggccgcatgttgaattgctgccacctgcccccgccccagaccttgctgtgctgtgtccgtgtgtcatgggctcagggcatggtgctagcattgatggaatggtcacttygcatcagccttggagatgagctgatgtggtactcattcccacggagctctcygtttggtgggggaaccaacacagaaacagagacttagcgctgtgtgatcttgyaccagctgagatgaacagagagagtggtgttggggacagcagcccagggcagcccaacattcaggagaaggtgtctggagggcttcctggaggtggatggcctgtgctgaagcccaaaggctgagtgagagtcttgtgctgtgcccctgggctgaggcagggctggtactggcgaggctgctgtggggtgagcctggtactgcccggggttggggagtccctctcactcagcctgtgccttccctgggagtgactcatttctgctttccctgggctcctcagcttcccttcctctagcctggtcctaacatggtctctgggccaaagtctagggccaggctagggcgaggagtcagtggggatggaggtcaatggggatggaaagtgggggtctcatccccttcctgcctcttgttgtgtgctctgtgcaccgcgctgtggatctggaggccctctgggctctgctttccaccccccgccacaggtccccttctctgctttgtccctgggccttgtgcctgtggcccatggtggccacactctctgggggctcagagctgctgggagcagagcagcgcagacttccaggatcttcacaagctgtcctggtcctgggaagctcttgggacctggagctttgctgctcctccctttgagcctttcagggactgggacctggactgtcagaatctcactgctgccctgggccgcttcctctccaggacagctctctgtcctgggtttcaggggtgcattgtggcctgaggaggtgttctctcttgctggtctattaaacaaagcctaggttcattaacagygggaaaagaccctcacctcatgatccaagctgactcattcttggctttccacaactgcctcttgccttattgttcatactacttcctatttctcccaaacatatcatggtctttcatgctttatctttgtggctctcttacctggaacatattttattttattttattttattttatttttgagacagagtcttgctctgttgcccaggctggagtgcagtgtcatgatcttggctcactgaaacctctgcctcctgggtttaagcaattttcctgcctcagcctcctgagtaggtgggaatataggtgtgcacaaccacacttggctaatttttttatttttatttttagtagagatggagttttgctatgttggccaggctatcctcgaactcctggcctcaaatgatctgcctccttggcctcccaaagtgctggaattacaggtatgagccaccgcacctggccgggaacatcttttaaatgatggctttgatgtgtcctccccaggagcaccccaacgctctcagccagaatgaggcactgcctcttcagtgctcacaagagcaatttgcagttcctcttagttttattaggctccatgttttaggawaattattcatttatctataattgagtccacttatttttgcaggcatgaggagatgtattaatcaggactgtttgttgaaagtgataaaaataccagttaaacttgtttaagtaaaaaagggaattcgttttagcttatatgacaaagtggtccaaggatgggctagcttcaggcatggctggatctagcggttacgcctyctgctcttgctttctctttcttgctccctcgcggtgtcttgtttctcttcttctctcattggcttgactcttaggaatgtccttcccacccaatgacaaagaggaaccaccacaactccagcttgtctggtctttggtgtccacagtctyagcacaagtaagagtccctgtttggaaagctcaggcaaaggctttaaggatatagtattggcccagctggggtggctgcccatccctgaaccaactggggtgagtaggacactctgtttcgttggggtgggctgccactgcgtctggccagctcactagaagtcatggactaggagtagagggaggaggctctgcaaaagaaaatcggggtgggaggctgggcaggatggatgagtggctgccccctacaggagccattagagcttggtaagcaggagctggggagatcagagccatattttagaaagattaagccaactgcagttaggagagtggcacggggcrgttgggggcatgggggctgggccaccgagaggcagcatcctgggttccctggaagcagaggtggaagaggctgaggtagcagagcttggcttggcctgtgctgaatcaccaagggcagccgaggggtctgaaggggtgatgactgcttcagctggccgaygttctgtttctcagggattcacaattaggataatgacatgagggatgaccttgccagcagtggtctccaggcccttcccctcttcctcactcagtttcatgcttcttggrgccctctgtttttcatggctggggctgatgttcctgggcattaattggtcttcattagacagtttgagagttgaggatgctttgggcctcactgtgtctctcccaaccagcactgggggtccattggtctgccaaccttgagtgacagggatcttctgagtccatctttcaagtgtgtagctctagtgactgtgctcttggggcccagtgggagaagaggcatgggaggcagaacagtggtgtctacacatatttttgttcacatagaagcctggacagacatggtggggtgagctgtgtccagggccatgtcctattgctgagcaggaggccactaagtgctggggagtggtggggcctctgttctcctgcagccttcaccccatgcttgtgtggggtgtcttggtgcctgcgctgcctgctgtgttcatgaggctggcatagccagtcggccctgctcatagaagcgctctggccgtctctgcacactgaagaagaggtgacggccacccactgtcagattgacattatctggcaatttgagtgctgccgctttgaggtttggggtgataatggtgatgtttgagagggaacccagagacccaggtgctgctttgaggaggctccaacataactaagctacttttcccccagaacgcaaccgagaggcaagcacggctgttcagcaggactcctgggttctcacagagttccaccttgtttctggtttctgagtcaactgaagaccaagttrctgaagtggatgttgaccacattctagaatagcagtgtggttgcttcmtaaaagccttacttgtaggcatattaagctgaatgaacattgccagagagaaccccctccctcaaaactgtaactgatcacacactgtccaaacagcaggtgccgttattgtctctggagactggagactgtgggctctcccaggctccctggggatgttcttggtcagccatgcctgaacgctccagctgaggagttactgttcaggagacatgagggactcttggtgttcgctgctgaactctgctctcgcaggtgaacaggtttgtggccagtgagatcctgacttgtggggaatgtggcaggtgggcagatgtgagtctctgccctcactttgtgcccatagactcagcttctgccgggcagcctggcatcttcctgctgccttttccccaggaggcaatggtacaactctgcaacaagcatctttggtggaggcagagcatggcaggggctgggcaggcttgaagggtggtgctaggcctgcatggagcatgtggagctggaggaagagacccttattggctaaggagcaatttcctggagtcttgtgggtacatcctctagtgatcctgatgccagccaccttctgccatcctagatatgagtgtctaggaaaccacagaaaatctctggcaacaggaattttgggctgaaaccatgtggctcagaagttaggctgaccaccgagaaaccatttaaactgggaaactttttaaagtgaaattaataatttcactaaagaacaggtgcaacggctgtgctgggcaaacgaggatacgcggtcacctgttcagggaaggctctgtggaggggcacaaccagccctctcctgtggactctgatggttgtggtcagggctggggctaggaagtaaggacccaacgtggcaggttggcctgagtattgagatgtcaggactggtcctggtgcacaagcccatttgatccagggtgccagtgcaagcactgtgcagtagttcattttcattttttttctctgttgcagaagacacttggtaaaacaatagcagcagctgcttttagttaagtggtgcgttactgggaccaggaatggtgcccagggctctcccctgattatctcttgctttgaggtaggcacccaacttttagttacgagagaattgagtcaatgacctgactcagaggaacttccagtccctcagggatacaggggggaatttggggactgcagttcaggcttctcatatgacaaggttgctttctgtctggtcctgtttctaccccagcctcacctgcagctccttccccacgggacctcctgtgcccaggcattccatctacttccgtgcctccagagctgtcctgtgcatccttctggacctcaccttctcagcctttagggtcctgctctgctgtgctcctcaagtccctacggmactgcctggagtcacgtgtctgcctccctgaccagcctataagagcatggctcataggagcaacaccaggtggccatgtctgtggcccaggatcttgcaggtgcccaggcagtggtggtcataccacagtgggctttctgctgggatgggtcttgagggccctgatttctgctcctctggttttctgcatgggtgctgacttcttcccactcacagtagatagctgtcaaccctgccggcgcccagagcggagagctgtcaggctctgcccctggggtaggtaccgttgttgtcccattttacagatgagaaagtgaggtgcagaaggcaggtaactccctcacggtcacatggcagggcaggactatgatgaaatcctgcctctatctgacctgattccaggatcttgacaatttgctgagccactgagaagtgtttcctatctgcctcgygatgccacggagaagccatttgtggagcgcatcctgtactgcaaattcctgcctggcttctcgtggcctcactcgtgggaggacgcagggaattcgtggagcccatggtggttcccccaaacctagtaaaaaggcagggaagggaaagatgcccaagtgtggaatcttttgctgacgaaggagccatggagacggtctcatctccacccacggagacacaggctgctccctcaggcgtccttcctgggtcctcaataaaggcacagcactcaggtcagtgctgggttggtccaggctcaccgtcatgcttgtttcctcatctgtaaatatctgtccctttatagggttgtggtgaggaacaagatgatcctataactatacatctacacttctatatacctatgcacctatatctatgcctcatctatacctctctctacctatacctatacctacaggctacctctaacctctacttatacctacacctacagcctacatctaacgtatccctatccccatccctatccctatcccgacatctaatttaaatctatatctgtatctacatctcacctatacttataccaatttctagacctaaacccacatctacaataagttcttgcttaatgttgttgataagttattggaaactttaagcaaaacaatgtacagcaggttctcaaatacggttttgctcaaacgtcttttcattacaatgttgatgagaaaaaaatttggtttccattatacattgtttcacttaaagtcctatcagtgatgttaagtaaggacttaccatatatcgaatctatgccttgacctatttctactcctattcctattcctacatctaatctgtacctattcctagacctacagccatgccaacaccagcacctacagctgcgccctcatctccggtacatatctcagagcagkgtctggcatcctggaagccctgtgtgggcgtgctgacatatggttattattactgcaggccaggtggtgggcacagtgctggtctcttggaggtggcacagggttcctgtgttgttgacccagtcggcaggggccctgggctggggcatttaaacagcatgttgatgagaagctgcgccttttgtttctgtgacaggcggtggctggagtctccctggctgcatcctctttgtgggtcattaagaatgtcacatttggtttaggcaagcatgtcaccgcagggcttcaccatgagtgtcatgtgcagggcgatcctcagcatgccatccaggaagtccctgctagcagcctgagacagaggcgggagagggtgtctggcttcagagccatcgctgtcaactgatgttcacctggctcaggggaagcagggcctcataggctgtggagtctgacactactggtgctggtgtggtgtttgcagggacactctggatgctttccctgggctgaggaggggtagaggcaaaggtccctggccatggggggtgggttggggggctcgctcctctcctcttcttgactgcctcactgtggagggaggactgtccacctgtgggctggagaggcatggcatggtctcgttgtaccttccagcaaccccattactgttgtccccatggtttaggtcttgacatggaggctcgagaggtgacaaggctgtcctgaaccactctgcagaccagggtagagccagacctgagtggccacagcccaattttcttcccctataccacagtgcccactgcccactctgccatctccctctgctgcgaccctatgccccgtcctcagactctgacctgggattttggctcctgacagtggatggcattgtggccttccccacagcatccaygtttactgagggcgctctcttagcttttctgcctgccttgactgccatactgagagcctgtggcctggcrggcccacattcgctgctttggggtctgctctgagaggcctggctgtgtgatggagcacagcagctttgttggcccccacctgggagctggcagaagagctggttcaactccgcagtggtagggcagcccccagctcagcagtggtggaagtgggtgtgtcctgcgagctggtgctctggttttgttcacagaggagcatttgtagtctccacggcttggagatggaacctctcagttcctgtgtgcttcagtgaatcagagcctgattaggaggtggctgagctgctagaggagcctccatttgtaattgaaaatgcagcaatgaccagacaagggtgggctgtgtgtgtgtaggggtgaatgtgtgtgcaagtgtgtgtgatggcagatgtgttgtgtgcaggtgtgtgtgtgaaggcagactgaagacaggtgtatatatgcaggtgtgtgtatgagggcaggtgtgtatgtgtaggtatgtgtgtgagagcagatgtgtgtatgcaggtgtgtgcatgagggcaggtgtgtatatgcaggcgtatgagggcaggtgtgtaggtgctggtatgtgtgagggcaggtatgtatatgcaggtgtgtgtatgagggcaggtgtgtatatatgcaggtgtatgtgagggcaggtgtgtatgggctggtgtgtgtgagagggcaggtgtgtatatgcaggtgcatgtatgagggcagatgtgtatatgcagatgtgtgagggcaggtgtgtatatacaggtgtgtgagggcaggtgtgtatgtgcagatgtgtgtgagaggacaggtgtgtatatgcaggtttgtatgtgagggcagatgtgtatatacaggtgtgtgtattagggcagatgtgtgtatgcaggtgtgtgtgcaagggcagtgtgtatatggaggtgtgtgtatgagggcaggtgtgtatttgctgttgtgtgtgagggcagatgtgtatatacagatgtgtgtgtaagggcaggttgtatgtgcaggtgtgtgtgtgagggcagatatgtgtatgcaggtacacaccttatttgcatatgtgtatgcatgtgtaagggtaggtgtgtgtgtgcatgtgtgtgcatgtgtgtgtaagggcaggtgtgtgtgtgtgtgtcatgtgggcaagctacccagccacagctctttccaaccaagtgcctgatgccaggccctccttctctagcaggacagtttcactaaaatctgcttggtcctgctgaatccttccttccagccaggcagtgggctagatactggggcccctcaccacatgtggggagctgaatgaggtgaaaggcctgggtgctatcttgaggaggtctgagtcctcccttccccctccccaacctgtgcaaatagcacagaggaagggatagtgtgggggctgggcttttccagaggagagtctcctaaccctatgtggggaggaatctccagggaggactacctggaggagatggtgccaaagcagagccttggaggatgagctggaggagttggccaggcacacagcagggcagggagggcattccaggccatgagggcacatggacaggcagataggtgcctagggtagggggctggtgtcttagaggaagtgagagcagttcagaaggtgtaggggatggcaggggtaagggtgcactggtgggcagaggcctggccctgactgtgaagggtccttatgccaccggggagaggttagccttgactgtgagccaagtgggttgctgctgagtggcttcagagtgacatgtggcaagagtgacatggacagacatgactcttggagggtttctctgctgagggtggagaatgggttggaggcagggctggtgtggacatctaggagggagataatggctgaccttgggccatggcagtggggggctcagaggatgtgggaggggagcccccagggaagggccacaatccctgaatttagggggtgtctagtgatagaggccagcactctctgtaactccctgggaagagccctccgtgcccacccttgggtactgccatgcttaaatggtcttgctgctcatggtcgctctttacttacatgcaaacttgctccagtacagcccctttttttcctgggctgatgaggattcaagagcttgctggggaattgcactctttgaactgttccctgagatggaccacggatcccctgtgaggacaggctcagccggcacctggatccatggaagggctgtgctctgaaaactccctgcctctgatttccctggtggagtgaagaaaacaaaggctcggctcctgctgtggttttctgcattttacagatgaggcaactgaggcccagagaggtccaatgatttgcccaagtcacccagggagagagagggacacccaagcctcctgcctctacctttggaggctgggatgggagcaggagggcactgcttgaacatctgctgtatgctaggatttgcaggggcttcatgaattcactttcccatttcattcttccagtagccatgcaagctgagaatggtcttcccagtttgcagatgagcaaaccaaggttctaagtggtggaatcacttgtccaaggcgccactctgtgggatggggatgcaaacccagatgactggatgccagtgtctgtctgaacctaaccactgggctattgtgctttccactgaggagtatgggaaggagtggcatttaagcagaccttacagaaggcaggaggccccctccctgagcagtgctctacccccatcctagaacaactgtgggctggaggaaggagtccttcccaggccagggtctcaacctggctgcccagcagaatcatctgggrgagcttttaaagtgtgctcaagctctgatcaattgaaattgcatttctggagatgggacatgggcatctacattttaaaaaacctccccagctgatcctgatgcccaatgaaggcctaggactactgtcctaggcctcaggccatgggtctgtgggcaacaggagcccagagcacctgcttcctttctgtaactgttgggcatggctctcctgaatttggaagatctcatgaacaacaaagttgcttttggccatagttccccatgctgattttcagatgaactccaaataagccaaggttaggcacaaccgcctgcccagtgggtaggagagaagggtagatgaggcagcagaaatgttacagttttcctctagcccaggacagctctggtgagaaattctccctgaagagccagcccaccttgctgtaccccataacccctctgcagccactggctgcaataggtgcagctctgctgtgcacctcaatctcctctgcaatcccagcagctcagcgtcaggcaggaagtaaatgaaagatgcctttccctcaccacaccatttcttgcctctctttatccaagtgttccatttccttcctttttccagatgaagccacttcctcccccctcttccaacacttaccaatggtttcttttgctgtgccaggccctgatggaggtgctttgggttgtatagatgagccagatgtaggctctgccccctccctattgcattctcagtcagtacaggaattagacaaggaacaagtcccaaagggaaaatgcccctggctccaggcraggttcagaggaagggtgatccccatggttggtagaatcagggagcgcttcttagaaaagcaggtattttcagcctgtctgtaagggttgagaaggatttggatgtgagcagaaggargagtaatcgaggctggagaatgagctataaaaggaaagaaggaggaagggaaaatgggggagagaaaatacatggatatgttatgcactgacaggggaaactatagaggaggtatggggagcagtgaatccagttagctggcagaaagggtcagtgaaaggaggttaggggaaagaacattggaaaagtaggtagggggccaggtcatggccttgaaagctgtgctgaagagtctgggcttgattccatagggaaaggcatgatgaaagcttttgtaaaataaatgaagggaggagaggtggaagccactcagcccctgctacaatgacttaggagggctttgctcctcctgctttcacaagggttctccataatgaatgtctccatgttaactattaaaactctctttgcaagtgataccattgctattctgaatctactggccatactgaggagcttgttgagtttggcattgactgtgctcctgaaatgaagaacaaggaatcattgaaggagcagcaagtagaggagggagaagatgaaggataagttgtcatggtggaaattttgtcagactagtccctaaatactctatttttgatgctattgtgaatcatatttttaaaattttaaatttgtaatatacaattgagttttatatattgatctttaattttatttgaatttatttttagagacagggtctagctctgttgcccaggctggagcacaatcatagctcactgtagccttgacctcctgggctcaagcaatcttcccatctcagyctcctgggtagctgcgagtaaagatgtgcaccactatgcctggctaatttttaaatttgtggaagagatgagatcttgttatgttgcccaggctggtctcaaactcctggcctcaagtgatctcttgtctgtcgctcccaaagcactgagattagaggcatgagctgctgcacccagcctgtatattaatatctagcaatgttgctaaacttacttattggttttagtgcctttttttaaagggtagattccatmaaattttctaagtaaatgataatgtcacctgtgaagaaagacagttttgctttttcccaatttggatgatttttatttcattttcttactttattgcaatggctggaaattcttgtaaaatgttagaagtgatgacagtgaacatccttttttctgatcttaggaggaaaccatcctattcagtctttcaacactaaatatgatgttagctgtaggtttttataaatgttctttatcaaatcaagaagttcctttctatgcctagtttgctgagaatttttattaggattgatttcggaatagtcaaatgcctttaccatgttcaatgagatgatcatatgtgtttctttttgggcttggtgatatggtgatttgattgcaaatgttaagttaaatgttaaatcttacttagtcatgatgtattatcatttttatatattgttggatttgatttgctaaagtttttgcatctaaattcatgagggatattggcaggttatcttcgtttataaggctgctataacaaagtactgtcaactggaagcttatcagtaacagaaattgatttcttacagttctggaggctggaggtctgagggggataccaatatggtccagcactgatgagggccctcttctgagttgtagactgctgacttcttgtggtacctttccatggtggaaagagggcaagagagctctctagggttccttttataaagaattcataacattcatgagagctccaccctcatgacccaatttccttccaaagatcccacctcctgataccatcacattaggggtagtacttcaacatgtgaattttgggggaacacaaacattcagtccattacacatgtggtttgttattattatttcttgtaacgtctttggttttgttatggtggtaattttgtcctaatagaacaaattgggaagtattcattcctttacagttttctggagaagctatgtagaattggtatcatttctttcttaaacatgtggtagaattcatcagtgaggccatcagggcctagagttttccatgttggatagttcttaacttcaaattccatttccttcatagataataaggctagtcaggttatctgtttcttcttgagtgagcattagtagtttgtgtctttcaaggaattggtccattctatctatgctgatgagtttattcttattcataatatgtccttattatctttttaatacctgtagtatctgtagtaatatcatctcttttatttctgatattggtaatttatgtctttttgttttatcttgatcagtgtggctagaggtttattaatactattgatctttgaagaaaagccagcttttggtttccttgattttcctattgtttttctgttttctattttatcatttttttgctttgatatttattatttcctttattctatttactttgggtttaatttggtcttcttaagacaaattcttaaagtagaaacccaggtcactggattgaccctttaaaatttatgtacaatgaaactttatctcttcttacagttttgacttacagtcaatttaaaaaatagtattatagccaccccacttcttttttgattatgatttgtctggaatatctttttccatcctttcacttttgagctacttatatctttggatgtaaaatgagtcatttaccttgaatcatgttttgtaaaatttattactccagcccctgtctttggttggagagtttaacccatttacatttaaagtagttattgataagaatatacttacttttgcaactttactatttatagtttaacacatttacatttaaagttattattgataagaatatacttactttggccattttactgtttatagtttaacccatttacatttaaaataattattgataagaatatacttacttctgccattttactatttatagtttaacccatttacatttaaagtaattattgataagaatatacttacttgtaccattttactatttgttttcagtatgtctgttaattacttttttgtccctcattttctctattaatggcttcttttgtgtttagttgattttttttggtagtgaaacactttgattcccttttaatttccttttgtgtatattccttggatattttctttgtggttaccctcaggattacacttaacatcctaaatttataacaatctaattagaactgataccaacttcaacagcatacacaactatgctcctatatagctttatttccttgtttatgttattatgacaaatcacatctttgtcaattatgtgccaattaaaatagatttataattaaaaatgcatgtgttttttaaattatgtaaaaaataaaagtagagttataaactaaaaattcaagaatggcttttatgtttgcccgtgtagttacctttgcatttattccttcatgcagctttgagttaatgtgtagtgtcctttcatttcaatctgaagggctccctttggcatttcttacagagaagatctagtggtaagaaatgcactcagcttttgtttatctaagcatatcttaatttctctttttaaaagttgtggtaaaatttatataacctaaactctacattttaaactatttttaagtgtattgttcagtggccttaagtacattcatattgctgtgcagccttcaccaccctccatcttgagaacattttaatcttcccaaactgaaactctgtacctgttaaacaataactctccattttcctctccccccggctcttggaaaccaccatcctactttctgtctctatgattttgatgactttaggtatcttagataagcagaatcatacaatatttgtccttggtgactggcttttttcatttaacacaatggctctctcttttgaaaaaggacagtattgctggatttagaactcttgagttttttagttttttttttccagcacttgaaatatgtcgtcccactgctttctgccttgatttctgatgacaaattggatgtcgaatcttattgatggctgggtgcggtggctcacgcctgtaatcccagcactttgggaggttgaggcaggtgggacacttgaggtcaggagtttgagaccagattggccaataaggtgaaaccccgtctctactaaaactacaaaaatttgctaggtgtggtggtgggcgccactctagaggctgaggcatgagaatcgcttgaacccaagaggcagaggttgcagtgagctaagattgtgccactgcgctccagcctgggtgacaaagtgagacccccatctccaaaaaaaaaaaaaaagtcgtattgagtatcaagtgttgaattgtgtctcaaaaaattcatatgttgaagtcctgacacacagtacttcagaatgtgaacttgtgaacttatttggagatagagtcattgctgatataattggttaagatgaattcattagggtgggccctaatccaatatgacttgcatccctatagaatgggaaaatttggtcactgagataaacatatatagagggaagattgtgtgaagagacatagggagaagatggcaatctataagccaaagagataggcttgtaacaaatccttctctcaaagtccttacaaggaaccagccttactgacacctccatttcagatttctatcttccagactgtgagacaaatcatttctattgctcaagccacccaatttgtggtattctgttatgacactcccagtaaaccaatgcattgggaatcccttgtacatgacaagttccttctttctttatgcctttaagattctttctttgtctttgtctttcagtagtttgattataaaggatctctgtatgggtctctgagtttatcttacttggagttcactaaactctttggattttaatttcatgtctttcatcaaatttgggaagtttttagccactatttcttcaaatattcttcttcccctttatctctctcttctccttctggaacactcataatgagtatgttagtctgcttgatggtatctcataggtcatttaggttctgttcacttttcatctttctcttttctttctgattctcagacttgataatttcagttgtcctatctttaagttcactgtcttctgtctgttcaaatctgctctttaaccccctaatgaatttttcattttgttattgtactttttagccccagaatttctgtttgcttcttttaaaaattaatgttaatctttttattgattttctcattttgtttatgtataatttccccaattttctttagttctttgtccatgtcttcctttaccactttcagcatatttaagacagttgttttaaagttgttatctagtaagtctgatgcctgggcttccttaggcatggtttgtgtaaatttactttgttcctttgaatgggccatgttttcttgtttctttgtgtccttttttaaaaaaggacttctgaatattataatgtgttaactctagaaaacatattgtcttccttccccagaggctgctgtttttttttagttgttgaagggtgtatacttctttgtttagtaactttctcaaagattgtattcattgtcttgtgtgatcactgaagtctctgatcctttagcctgtgtttggctaatgttttgacagataattccttgaatgccatgagctaaaaacaaaacaacaacaacaaacaaataagaaaaacaaaaataccccaaacatctctctcagtctttgcagatttctctgtgctagggaaatccttcaacacttagccaggctggcattgtgcctagagattagtgtgcctacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctaggaaaaccccattgtctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaattgcttcaaagagaataaaatacctaggaatctaacttacaagggacgtgaaggacctcttcaaggagaactacaaaccactgctcaatgaaataaaagaggatacaaagaaatggaagaacattccatgctcatgggtaggaagaatcaatatcatgaaaatggccatactgcccaaggtaatttatagattcaatgccatctccatcaagctaccaatgactttcttcacagtattggaaaaaactagtttaaagttcatatggaaccaaaaaagagcccgccttgccaagtcaatcctaagccaaaagaacaaagctggaggcatcacgctatctgacttcaaactatactacaaggctacagtcaccaaaacagcatggtactggtaccaaaacagagatatagatctggaacagaacagagccctcagaaataatgccgcatatctacaactatcggatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaatacttaaacattagacctacaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatgagagtgaacaggcaacctacagaatgggagaaaatttttgcaacctactcatctgacaaagggctaatatccagaatctacaatgaactcaaacaaatttacaagaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatactacctcacaccagttagaatggcaatcattaaaaagtcaggaaacaacaggtkctggagaggatgtggagaaataggaacacttttacactgttggtgggactgtaaastagttcaaccattrtggaagtcagtgtggagattcctcagggatctagaactagaattaccatttgacccagccatcccattactgggtatatacccaaaggactataaatcatgctgctataaagacacatgcacacgtatgtttattgcrgcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagggcaaaaaaccaaacaccgcatgttctcactcataggtgggaattgaacaatgagaacacatggacagaggaaggggaacatcacactctggggactgttgtggggtggggggagtggggagggatagcattaggagatatacctaatgctaaatgttgagttaatgggtgtagcacaccagcatgtcacatgtatacatatgtagctaacctgcacattgtgcacatgtaccctaaaacttaaagtataataataataaaaaacaaaaacaaacaaacaaacaaacaaaaagagattagtgtgcctagagaaagcttagggtcttcttatttcttttcttagcatgcatcttgccctatgcctaatgtagctttctaaattcctcagtataaataggtacttttgagtgtaccactttcccaaagaatgttccaagctattcctcacaggtcttaggcagtctattgtatgtctcaactgtgtcttttgtcccaagtgtctttgagttgttagtttgctttgcaatgttgtgagtaatgcctgtcactttttggtctaagttccaagttagggggaacatagaagagtgtcttgtatcaatccttcaggtatccctcagacagcctataacagatagtcacaataatttgtgaataatatctgctctgctccctctagaactagagatgaaggtcttatattgggaacatgggatggcacttcaagayggtaccacttcaacataacatcatgctgggggagggatggggcatgggcaagtaaaaatgccacaataccttcctaaagttgcctttttcttgactaagtgttctcttggttgctgtaaacctttgactgttttccagagttttgacaaagttggctctggcagtttctgctttttttatttgttcattttttgaatgtttctgtaggaagattagaacttggagctgtctactctgccgttctcctccaccatcatttttgaaagattttttttcatggtataaaaatctaggttgatagtttttctctctttcaatactaaagatgtttctccattgtcttctatttgtattgtttctgataagaaatttactgtcatccttatccttgttcctctgaacataatatatttctctggctgcctttaagattttctctttatcttgattttgagcattttgattataatgtgtcttgatgtatttttcttcatgtttcttgtgcttatgatttcttaaaatttttgcatctgtgcatttatggtttttgtcaaatttgaaatttttcatgaattatttctataaatattttttctgtttcctcccactctcctcccctctgggactccagttacacatatgttagaccacttgaagttgtcccattgctcaccagtattactttctttcttcttttctcttttttgattatttttctgtctgtatttaactttggatagtttctttttccatgtatttaaatttgctaattttttcctgctgtatcaaatttgacattaatccaattcagtttattttttaaatctcacatattgtacttttcatctctagaagcttgatttgcatcttattttaaatcttccatgtctctacttaacgtttgaacatacggcatgtagttataatgactgttttaatatctttgtcttctaattccaacatctgtttcagttgtggtttgattytgatcgattgatttttttcttcacatgsgtaaatttttttcctgcttctctacatacctaatcagttttgattggattccagacattgtgatggatatttttgcattcgtagaaatatccttgggctttattctggaatgcagttatgtggaaatagtctgatccttttgggtcttgtttttactattggctaggcaggacagagctactactactgaggcaggacctttctacatactctacccaatgtcctgtgaatcatgagggtttgaaaacagtcactgttcttgagagtaccagatactattccttcaaatcttttggatgattcttctcctggctttggggcgtttgctcacactctgctgaacacttgagtgggagtttctgaaagctcgccaggtgtctttctctgtgcccatcactcttctctggtactctgtcctgtgaactctggcagcctttgtctctagactctgagctccaaatctgcaactcaggacatctgctagactctgcctcctgtgtcaccttgggaagaaagacagctgaagaaattgtagggcttgccttgtttgatcttagcctctggaatcactgtccttcattgccttctctccaatgtcttgaaaaaccattgctccatatattttgctcatttttttattcggttattccatgaataaattctgattggcaaactagattcctcttactttagctgggttagaagcagaagtacaaattgtttttattattattattattttttgagacrgagtctcgctctattgcccaggctggagtgcagtggcacaatctcggctcactgcaacctctgcctcctgggttcaagtagttctcctacgtcagcctcctgagtagctgggattacaggcacgcaccaccacacctggctaakttttgtgtttttgctagagacagggctgcaccatgttggccagggtggtttcgaactgctgacctcaagtgatccacccgccttggtctcccaaaatgctgggattacaggcatgagccactgcgcctggaccaattattattattttttaaatagttgtatctgagctcatttaatgatggagggaatggagagaatgaagggtgggggtggtagagaggaggcaattgttggagtgaggtggatagtgatttaatgatttaatctgctactgatcactgttctgtgccaggctgcagtgggtactgaatggaacaatgcatagcccctgccctcaaggaggccacagtctgaaggggtgagggaaagagtttatcattgttttaatcagaagattcggctgctcagacaaagcagatgttccatgtttccaaactattaagaattagattcatttaaaatgttttcattgaatgcaattataaacgctgttccaggaagacctacaaataaggatagatttgtttagtattaagggaaggggatgtttaattctgtgagggaggctgtagagaggagcttgggtcagaagactcatgtgtgagccctgtagaccccttccctacagggggtcttagtgcccgtagtacagtgaaatgggaccttgtattacaggcatctttcagggtttccatggagtacacctaggcratggtcaataaatgtgggtcccatatcttagagggcttagagggacagcaaaaagcaaaaaagcaaacaggatgtgcccctacctccaagaagttgctgccaatctgcctcagaagtccagcttgggaattgagactaaaggggagtgaaagcagccctagatggggcctgaggaaagggccagctgtgaccagggaggatgagaggaaggactgagaaccaggagaggcaagaggccgaggccaagagaactcctaattagccaggggtcaatgtcagccagtgtgcagaggccgaggccaagagaactcctaattagcaggggtcaatgtcagccagtgtgcagagccagaaatggtgtctctcagaatgtgtgtgggtgaaggggcaagggagctgggtgcataacttggagtattggcctcagtgaggccacacagcaggagctggggcctctgtgtgccctgtgtgagtgagtgtcatcttagatacagcctatcctcagttacctggccgtgctggagcctgcccagtccagggcttgggactcaggccatttcattctgcccccacccctccaggcatcttggagctaatcaaaggttagccaccctgagcaatggaaaattctcaatgttctagacactttttatgtgatgtctgtgctcctgttattttaagaatgcactgggaggtaggttttgttgcacctactttaggataaggaaaccaaggttcacagaggtgaagggatttgtccaaggtcacagacgtgacttagcttggatttgaacccaagtctgctttccaaaccccaatctttcttttcatttttttttgagacagagtctcactctgtcacccgggctggagtgcagtggcgtgatctcagctcactgcaacctccgcctcacaggtcaagcaagcctcctgcctcagcctcccaagtagctgggactacaggcatgtgccaccacacccagctcatttttgtatttttagtagagatggggtttcaccatgttgaccaggctagtctcaaactcctgaccttaagtgatcagcccgccttggcatcccagagtgctgggattataggtgtgagccactgcrcccggctccaaaccccaatctttctaacatgcttcacgtgcctcttactttttcagatttcatcatgtggttatcatagggacatatctggcactaagcctatgtagaaagccagcaaatggtgttggtggcctcctattcgagtccctgacccttgtgctggcctggatgctgcaggaagcatggttctctcacgccttgcatgggttcaaatgggctagcccccgtggtaacaaacaacctccacacttcagtgactgattccttgctcaggctgcatgtccatcacggacggtcctgggctatgctccctgccatcctcttcctccaggaaacaggctgacaagcagccagtatccaaatgctgttggtgataccggtagagaggaaccgggaagctggaaccagcttggaaacatctgccgggaagaaatgcttatcacacggcttccattttattggccagagcaggtccctggcaggcctagctctgaggagttggggagcataccgggtagcagttaactatggataccctgaaagctcccatcagtggtgactttcagatgccccgtgtgtgtctttctgtgctgaaactggggctgcttggtggagaggggcccctccagaagcttactgtctagggaagggacagttataacccaggaaaggtttgcctccgggtaagatgactgtgcatgacacaggcgagcaccgggctgtgggtgcgcagagcagtgacacattcttcacagggagaactgcagaggcaacagtgtctgaacccccagtttgaagctaagaaatccctagtgaggtgcaagaatggaagggcctctgcagtttgagggacaaagtgtgaaaaggttcagggatgagagagcacagtgctgggtgcaggctagtggcctgtgtctctggagctctggggacctatggaagtgtgtgggcagaggaggaggctggagagctgggcagggccaggagtaaggctttcttcattgtgggtgggatgtcatgtcccttttgttgtctttcagctgagccatggccgtggagttctggctagtgggtgtggtgggcactcggaactgcctgcccagaaactccagcaagggccccgtccctgcatgcatctatccagcctgggtggctctaggctgcattcacaggtctagaccctgctgttcaccctggggggatgaatcagcttcattcttcctgaacaaaagctcctgggttgccagggagatgtaggggctgccgcctgtacttcctggagctgcagtttggtgtcaggaagagatgggcactcagcagccccagggcggggctgggttgagctgccatcaccgctgttgtccttgttgaatgggaccgtatgtggatcagagacagcagagcctctgagtttgcacagatttgggtttgaatgtggctctgcccattgatggctacatgactttcagctgcaagctgcccttttgaagcctgtttcctcaaattgaagttgggatgataatatccagcttgcaggggctgagatatttcatgaggtaacagttggaaggcattccatctattcatttatttaatacatgtttgtggctgtctgctgtgtgccaagcactttcccggggtgggaatccatgccgtgacgtgatgctgacgtggccctgtgctgagtggtcagcctggctggcaccatgctaggcacacagagagcctcactaaatggtatttactcttgttcttggggacagaggctctgtggggataggggaagagtcctccttggcttggtgtttgcctggtcttgggcattttggggaagtggaggggtagggggagtcccactacccaatcctatagcccggcaggaagtagtaggcctcatgagaaaactctggggacttaagctccatgctgcctgtgaatcccagggttcaggggaccaagagggtttcctaagcctgtgaaagctgctgcaattggtgtagaggccaccatggagccacagtccaggggcccagtgggccttttcttatctctcttgccaggccacagagtaggttctggagaattgggcctggcggctctgagctgggctgacactcatcactgacctgggatcatgggagttgggcaggagggccctcccctgggaaagaatcctctcatctgactgtggtgtgtaaaagatcaggaagcctcgaaccagattagggcagggctggggacaggtgcagagcctgggggctcctcagctgtgtagaagtgctgggaaggcatggtgtatttgggggtcagatgtggtagttttggggttattgatggaatttgggggtaggcagggatgccgtgtgtgaatgctctgggaggaggtttgcaggaattagagggatttgctggaggagctttctgatggcgtcactggtgctgtgcattgggggttggtggcaggtcctggagtcatagctggggtcataggtgtgttagggaggcagtgatgatgggttatcaggagggggaggatcactgatgaggtgggaggtgggagcagcgaggatggaatggtgctgttggccagggggtcctcagtgactaccccagcagggtggcttcaactgtgagctctggtgtgtctgtttcttgtctcagcgctccacggggaagtttagacctgagcctctgagaggggtcactgggcagagagacccctggatctcagagggctgaagggggaggtgaatggtgggcatgggtggcaaggggctgagccagggcagtggatgagtcaggagtatgggaggctgggctgctgatcagcgactttgcagatcctcagggtcattacttgctgttgttgctggggaaagttgcaaaatgaaaattaactgtcagagaagattgattcgtttgatgcctaaccaggagcagccttttattgctgtaaaatgttgatttcctcttgcctgcaatgacaggtgagtgttagtggcactgaaggaagacagatccctgaacagaacttgcagaaaccatcccctgaggggctcagccctcttccctccaacctctatggctgcaagagcaagaatgagtgtctgattttactcatggggtgagaacacatctgtgggtgtgccagccacgtggcagggctggtggtaagacctggggctctggattcagacacatctggattcaaatccacgctgggccacttaatagctctatgcctgtgggcaagcctcagtgtcctcatctgtaaaatagaagggtcatacctaattaagtcctagattttaaagcacttggcacagtgcctggcacaggttatcagggctgggtccagttgaaatgatcaaatgctgctgaaattcagaactcggatcacttttgcaatagcagccatcggtcgggggcaaggatgggacaaaggcaggacaagagtcaagagagggagccgtcagagaagtggagtgggaggtgaacgaggataatttgttataatggaaccatgcctgaggtgggggtatgggagctcatgcctatggggggccgggcagggtgggccactcagtctgcaggcctgggccaggctagctgctcagaaaggatgagtagcccaggtctgtccctgcccagtgtgtggccaggggagcctctccgtgcccatgccacttgtcttgcttaagtgtggctaggaaggaaaaggctgggcaagtgcagctcctgcttggctgatccaggccttgatggcagatagctatgttcagagagtttcctgggggccggggagtagcccttctcctctaggagcctcttgtcagcaaggagtgaatttggctgcaggttggagggcttcctcgtctgcagggccaaccaggaaggggcggcggtgacacagacgagcgtgtgggaggtctctgtgttgggcgtctgtctgcccgcatgcctgcctctctgttgctctgaaggaggcaggggctgggcctgcagctgcctgggcagagcggctcctgcgtgggacatggctcttctctctggttacagactcaccacttcgctcccaacctacctccacagtcagcgtggggcatcaggccaggccctcctgagccagagaagattgtggaaaccttgctctccaggtggagtggccagcctctgggaggtgttcaggaatgggctcctagagagtgtggtgagctcaggctggatctgagctgggcaaaactgcttccaaggggggcccacatccaagggactgagtggtggtgggattcctccctctggggtagtctccagcctatggggcaggggtacagggtacaaggggcagacagatgtagggaggacaggcaggaagttccagcaagtttccgggccaaggaaatgttgtagagaaccagaggatgataggaaagaacaaatgaaggacaaatgaaaaggcctggccaggctccagagtggggcgtgttgaagtctgagggtcatgggtctcacctgttggtggggctgggctcttagctccagcgtggggtggtactgcagctgctgggatgggagaggagggtgcccagcagtaccttctgtgggtcagcgtgactggcaatgaaaatgaggtgaatgaacatcccaggagctcatgctgccaataaaacacctgacccggcaggtgggcagcctggattcggctcccagctctgctgtgaacttgcagaggctcctggacaagtcccttcccctctctggctttctgtttgctcctctgcaaaatgtgagccaaatattttcaagcagtggcactctttgttcaaatgaaatattccatgaaacccacttttcttaacttagtgaagtgggttgaggtggggaaacccagtggtctagcccatctccaaagcctacttccaaacataaacaattgtcctagattttaaaaattaatattttaaaaccaactcttattgagcacttgatatgtaccaggcactgttctaagcactttataaatagtgactcaattctcacaacccgagggggagggaggtggggaaacaggcatcagaggtgaggtgacatctcaaggtcccacaactagtgagtggcacagcaggattccagcccaggcagtggggtctaggacggggtttggcctctgttctcgctgcctgtaggtgctggcgaagggggcggcttgttctgcaggtgaaaggccacggcgcccacgtgacttggtgctgcacgctggaaccccgaagtcagtgtctggggaaccgtcccgttgggcctggattctgacgagctgggagaggcgggatcctccccgctgccgtctcatttcccagctggcccaccgcggccccgccactccaaggccggtttacaatggcaacgttgcgcgccgtggcgcgaagggaattgaatgcgggagcttctccgccaggcacacactctaaccaccaaatttatttaagcagataaaatgcagggggtgtaatgtcagattaatggataaataaccgttctggtttttggcacgatgacggggagcagtagtgagaagcctcattatgtgcggctctgcctcgaagaacaagcctcgtgctgcaaccccagcacccgggcccgcgaacagagcattaaattgttggaaatggctccccttcactcgcagaacaaagatgttttctccagaataaattgactccctcccagcgcgctgagccctggtttcccacaaacgcagcctatgctctcgggggagggagggcgggcgatgccggcctgggaacgccgcgcagggagcttcctgcgggggcgggctcagggcttctggctcctgggctctctgtcgccaagcctccatggtaaaggagcaaacctttagttgtgtggacaacgcagaagtctggcagaatcggggttggaattagggtgcgctgagaggcagtgttccttggttagggctttgcgttttgtgtccctaggtttgcgtgtcgttggccagctgggcgatcttcaggcaagttatttaacctctctgagctcagtttgttaacagtgaagtggggaaggggcccttcctaacagggctgtggtccagagcacgtaataagagaacgcttgggggtggagccacgttcccttcctccagaaggcgccctccactcttggccctctgccakcatccatgcccaagatggtgtggtggggtgtggggacccaggaggctgctgtccggctgggcctagaccctgtggcatggaccagggggccgaactgaaggacgcaagctcttcgaggtgggtgggggaataaagcctcccttcctgggtgcccaaggtctggccagtgcctagtaagcccctggctgggtgggatcagaatctcagtggagagcttggctttgctctgggccaaacttaaagacagccattgcctccaggagccattgtgcttggtttctgcctggcttcctgggctcagtaggagcagagctccgagaggctgctgaggggcagactaactgctttcagatcagcgcctttcttcccctgcttcctcctccttctagaaggtgacttgcacagtgtaaagagcgcaggctttggggccagattcaccactgccacctcctggctgtgttacgctggacacactgcttcacctatccgagcctcagttttcacctgccgatgccagaataatgctttcactttgtgagactggcatgaagagtgaagctcctgggctgatgtctggcacacagctctttgggccccaatgtcctgtaacaaatgcttatggagcacatacttrtgccaggctctgagatacaatggtaagcaatgaagccttgtgtgayctccaggggttgactggggagcaggatgacctggatgctggtggctgcccggatgtgtatgtgtgtgtgtgccacctcaatgcccctgctcaggtgagagtgggtgacctggggttttgctgcatccagcaggatctggcctttgggatggtgggttgcctctgtcttgcgctgccttttccttgtccttttggccttgctccttcttacctgatccactcgagtttctcactgacctaaccaagaggttggaagaggaaaacgcccctggcttggggcaggaatatgggtcctagcggttagtggagcacctccttcccagtacattgggtgctctccaggtgagcaaagcagatgaggtctctgtccttgtggtgcttgcagtcttctgagtaatgacagctactgagcatttgcccagtgccaggctctgtgctaagtgcttttcacatccgatcctcactatgcaatggatagtctgtggccagctttgaatctcacccctttgccatgccggcaggtcctgggggccctttttctcccccaggggtcctgcaggccctgctagcatagagctctgggctcagataggggtagcttcaaatttggttctgtcctgttattttgcaagtcacataacttgtgtaagcctcagtttcctyatccataaaatcgagataatcatagtaccacctcccagggttgtggggaggaagcaccaagcatagaacctgggttgctacaggggccccagccctcatggctgggtgttttgctccctgtggagtgggcacagaggcttctccgggctttgcagcccacacccagctttttcttcggtttgaggaacgtgtgtttaggaggctaggagaaggctctccaggcagcactccttctcccacctgctgggtctttgtttagctccaaattaaagctaaagcagaaaatacaaaacatttcctccatcacaggtgaaggaaccggctgtcttatcagctctggagccgagtggyttggcatgtgtgtgctggtaattgtggagtctgaatgaaggggtgtctctggggaccatgctttccatcactgtccgtgtctgttatcatggttatctcattcccaatcaggctcaggggacgtggggctgggcgaggattttccattttctggaggctcacatcccacctctgccttcttactcattccgatggcccagctcttaacagccctccctggcctctgccttgagccttctaggatgtcatctgctactggtgtccattccagttgtgtctgtctgcatccctatgaggaccgggagctcctgaaggtcccattagagtccagggattattgatgaagctccaaccaggaagacagagtgggacacatggttggggtggtgggagcatagaagttcttagaggcagatctggcttgtaaatctagctttgtcacttgctgtgtgacctagggaaagttacctaacttctctgagcctggctttcctcatttctaaaatgaaggtgttactggtacgtgctgtttgtaaagattggtgtaagtattatcatgaagtaatatccacagtctgtagctgagtgcctgggatggaatcagtgctttccaatgctggcccaaaagtggaaggaagccacgtggttggtactcagatttccctgttgaaggtagaacagagaacaaggtgcaggagaggaatgctggttgttgccctgactactccacacaggtgttccatggggtgagggcaggctcactgttatctcaggaccagctagagaccagttcacactaaccaagctcagaagagactgatttttggctgaacacaagccagcgtattaattcacaaggagaaaccactgcctgggctctcatgtgcttccccagtgagaaatcctagtgagccaggtgactaggtgcttcccactgaatggaggaaccttcagagggactgctggtgggtctcagggacttcttgatcactatttggagcctgctatggaagaggtcagagtgtggcctctatctggcctcttcctctcagttcactttccttactggactctcttccctttgccttctgctgtctttccttccctgcccctgccatttgtgcagacttgcacacgcatgtgcgtgcacacacacacacacacacagacatgtgttattaggaatgcaactggactctgcacttgattgaatttgaaataattgacttcatttctgatttgaaacttacagattccccactcccctatgttggcagtacccaagtttttccttgacaatttgtatttttaaattaatatacttatacaacctcgtatgtaatgatatagatgtatttacataatttaatgatattctttaataattcagagacattcaactttctgtacgcattgtttacacgcacacaagggaggaaagtcattagttgtcatcagtgaacatggataggtacagattaaggagagaggagagagagagagaggtagagagagaggtaaagactgcagaggtctggaaacagaatcttgtctttacatttttgggttaaactgttagggctgacagcttgcaaagaggctaggctaggccacttgccctagggcagggggctgggtcrtcaaaggaaacagcttcatgttcttatagctcctcctgcagctttaagggcacagctgggcagcacatgttggcctgtgtccagccatcagcgcccacctttttgaggccacagctgctcygttttcctcatcagaggttctctctttttctttgaaatttaagcattgttcagttatgaaacttagcattaatttctgtgcataaactaagactggttttgtccttttgatttctaatctcagttcttcgttcagttccaggaatttttctattgaggtgatgatcagctatgatcagtttcttatgtcttctttggaaatcgtgtccctgtaattgggttctccctgcattttctcttgtatgtgtcatctttcacattacaaaaagcctccacttacttagtctgttgtctggatatgtggagtagattgtttcattgttcaaaatatccactgcttctctctgtgggaggatttacaagctgcccttatgatgtcatccttggccatgtgacttgccagggccaatgaagtgagggtgaaagtgacagaggcctcttttgaacaagctctaagagctgccacatggtttgtttttccctctgccatgagagatgggggcttctccctcaagcctgggtcttggaataaagatgctgtgggacagagctgcagccaacctaccataaacaacctacaaaaaaagtgtgagaggaaaatcactttttgctgatttaagccactgagattttggggttgcttgttacagtagcatatcttagcttaaactgacaaatacatttctcaaatatattctttgtttcactggtatggtttcttggcaataccaattttgttttttacagcttccaacagtgattctattagaatcatacagatattaattttgttttgaattatatcattcagctgatgtatttttttatctttgaaaataattggtagtatttttctaaaatcttatgctctatatgtgagtctgttttagggttggctattctcatgaaattttgaaactggactgtagggatttttatttcctttacctatttactgcactttgagttttctctgttgtttcttcctgttttgctgaggggtttagaagcctcactggggtagaaaactaagttgtggggctggaggcgggacaccaaccagcaccatggttggtggcaggaagcctgcagttagagactgggcatgtgttttgctcattgctgttggtgctgctgaggaagtctttgtttcagtggattacagactgttttaattggattaaagggggaacctccttggcattgctcccctgttctttatcttcctggagataatccttttaggtgtctggagttggcgctcatgtcatcttcacacttagtctgccttctcccaggccctctctgtgtyyctcagccatgccccatgatgagttctgtgtcccatacacctgcctggctattcccttctaattcttccccatagtatcactgtccctactgaatgtagagcccagaatggatctcagcgctcagctgccatctggactgtttggaggggatctctccctccttatctagggtatgatatcatgaattcacacagtggtggccacatcagtctgttggcttatattaagcttaaaggtagttgcatccagatcttctcccacaagctcctagttgagtcttttccacctgttcttatgtctgtgactctcaatccatctctgttgagctccgttttgctcattatggcccattggtccagatggccmgatctttttgtatcccacacactgtattaagtctctctcaagtggaatcagtagcaatcaatatcctctgcagtcattgataaaactgttgagcagacaggtctgaggatagagccctaaggcctatcactagakactctgccagttgttatctctgaatgcacctaattgcactagcacccagcccacctcagagaggactgtgtgaatacctcattgaaatccaactctgcgtcaaagcctaaggttgttgactcttgaggtgctttagtcagtgtttgggaagaaacagatcacgtattccaaaggrgcactgaacagatttgaatacagaggaacccagcagggacagggaagcactcagagggtatcagtgctagggagatgcactatccctgggcctgaagggacaggggctgtgttgctgagcctgagagaaggatgcagcaggcagagaggggctgccagtgggaactgtgtccttcactggggaacacagctactgtaaacccaggcccagctcagccctctgatctgctgatgcttcccggtggctgaagccaggtagaagccaaggggcaagggagcccaggagctgagtccatagaggccagctttgaagggcacacaacagagtggacgggagacaccagcagaataggcagctcaccaggtcaggctgtgatctcatgtgcttctctaatcctccatgttgtgctgcactaggttacttgttaatgtcccaaagagtcttgtgaattatatatacatatatgaagagagagagagagagacaaagagagatcccttgggatggagagagagagagagcttctctgtcaatcgtcacttttggaccctcttgccaacagggtgagtttaattgcagtcatggggacatgacgacatttaattaattaattatttagagacagggtctcactctgtcacccagggtggagtgcagtggtgccatcatggttcactgtagcctcagactcctgggctcaagtgatcctcccacctcagcctcctgaaatgctgggattacaggtgtgaaccacagcaccctgagacattgatatcatcttagcaaattcagtgcccatgggagccaactgggctgttccttgtgggagcagagcccctgccgtggccagagatgcagcctcagggtgacaataggggaaagaagagcagtcagagttcctaggagttggagctattgggtaggggcccatggagtcacccttctgtccagggctgtcctgagcaagacacacagacaaaattcacacagacccacctgtgcgtctggaaaagctatgccaactactgctgagctggaagatttctgtttcatgcctgtattttaaggaaaggcaagggctgtgatccgaatgaccctgggatcctctccaggagccctggttaccggctgttgtgcacaccatgggggaggccgtgtagtggttgggggtgcggcagcttcagaagacagggcagactgtgttggacatgggaggtgagatgtggtgtgtgtggagctgggcagcccaggcgaggcccctggggctcctgctcaagtggtctgtccacctgccgactcagcccagcacaagtgagtgcacgcagccatctctctagctctgacatcctagctgataggaccaaaccaaatccttatggggacagtgctggggacaccctaggtccccagggggcagtgcacgtcctctctgaggtgatgacaggtgtcagtttgccagtgccacaaggctgggcaccgggcaagagagcttgcgactgcaggaggaaaagggtgacccgagccacaggtgcacagagcctagccagatgtgcacacaggtggcaagggagctcagccactgcatcccaagggtggtgagcacagggagggcctcctgaggggctagtatatgagtgtcaggggacattgaccttggccttagtgygcttctctaaaagtgctacccagcctccaagttgtgctgcactcagttacttgttaatgtcccaaagagtcttgtgaattatataggcattgatcccttgggatggagagacagcttctctgtccagcttctctggacacagtttgttttaattattaattttaaagtacagatacaatatagatgcatgacagaatatttgaaaataaagaaaagaaaagcatgtttgcatcttggcttgcttctttgcacgcccttcttaaatacttgtgattccccagggagtgggggacaagggtgtggggtgacatccaggtgggtggggagcccatggarcaggagacacagtgggaaaggatcagggagagtggctatgaccaagggcaggcctggtcttgggggtgtggaggccaggctcaggctggagttgtttgccctgggcttcctcatgtggctttctccaggggctggtccttatctgtgcttcctgagtcctggaggttttcccctgctttagtgagggtccctcaggcaaggccagcctgcttggggatccctggctggggctgtgcagccggcactggttcagccaggttcgcttgcaggaactcttgtctcctaggcatttctgtggtccagtggggagctgctgggcatctgacaggtgatgggcagccccaggcttcagcggctctgctttagtggcagcacagctggaagcctactgggccctgcctgccattgtggagaagcacacagggccagggtgtggccccagctgcatgaatcatccaggagtgtgtgaacactgactccaggctcccrcactatggggctgcaacgtgagtatcaagggttttgaaagctacccaggtgattctaaggagcagctacggtagttctcaaattttatgtgcatccgtcacctggatcttgtcaaaagacacaattacagagccccayctcaaaagtttctgatttgctatgtttgtctgagaatttgtaagaaattgaaatctaacaagttcccaggagatgctggtgctgctggtctggggaccccactttgagaacctctggcctagatgaagatgatgtgggaaattctggttacctccagaaggcaagggcaggcattagctccctcagttggtgagggcaggtgtcagcactcacaggtggtgaggacaggtgttggttgtctcatggggttgtgagggaggaggctgactgtcacaggtgctgagggaaagtgttggttgctatcctgtgctaaggaaaggtgtttgctgtcatgcacataggtggtgtaggagggtgttgcctggtatcagtaatgaggaaagctgttggctgtaggtctgggtggcaagggaagggggtggcggtgacaggtgacaaatcaaggtgttagtgttggtgggtggtaaggaaagctgttggctttctgtacaggtggtgagggcaggtgctgcctgtcccagatggaggggaagtagctggcagtcacatacctgaggtgagggaaggtatggctttgtcatagatgtgagggtcggtgtcaagtgtcacagatggtgagggagttgttgctgtgtcatggatcgtgagggaaggtggttacaggtggagagggaaggggctggcccttctagctggctaacacggacattggcctatttcccactgaggctgaaggtggctccagctcccaagttccctygtgtgtctgtcctgatcccctttcctgatgccctcggggcctggccttcttgtcctcccatgctgcagtrtagtccaagaaggcgggtggagcttcagggcctggctgggtgggtgtgtctctgggcctgggagggaggagtgttcggatgggctggggagcggcaatgtacagctctgtgctgaggaagtgctttgcacaatttcatgctggccttcagtaatgcatctgccacagaacgatggccccaggaagcctcactccctgcacacattcaggaggcacatttcaatgcagaagccacaggaagagcgttcttatctctgtcttttatcatcagtttccaatgaagaatcacagcagcctgtgtcctggggctccagcctggtgcctgtggggaaaacagttctcccaagagcaggcctccgatgcagagatgcaggatgtggaacccggcttttggagatggccacatgcagatgagctgatcttaggggaaaagacagagctgtcagcctggctgtgtctgatgtccctggtttctatagctacagtaaatgtaattaccaaaaagtaacccttttcggatttcattgtaacctcagagagctaatgacatttactgggtttctagcaatctgggacaaaatgctcattttaaatttaacatgagtaatgccattttccatcttagttaagtactttgtgtcataaaagagttatctgcccagagcccctggttctgtcagtaaacatattacaaatattatcaccacttattttctggatgaaagatgtggcaaaggcccagagaaacactcctcctttacatttatgactttgcttggagactcagcaaattcagcatgaaatcactgtggaggtaattcaggctgtgcaccaatatctcacactcagccggaggcccccagagacggtaatgttatctcagggagcacaaactatgtaaatacatccttccaccactcgaccacagtaggcatcagatggtgtcacttggctaccaacaaaggtgacagatgctgagtgtctttggtgtagaaaaatggaagtcattgactgtagcttgttagggggaagatgagtttcttctccattcctggagacatacagaatttgcacaccaaagtagagatggtgtyaaaccacgtatttatttattcatctgtttattcatgcactttgtggatccattcacacagacccktaagtaatccttacagtgcagtgtgatgagtattctaatggagggatgtactaggcttgctgcagtggaggaagcacagagcaggaggcacatgaactgcctggggagtcccaggaggcccacaacgaaggtgatgttggaccaggcctggatggatgtgactgagttggacagcccgaggctgaaggaagacactgcaggctgggcgtgatattaacgctcttcttgggccacatcccggtctctgctggagtgaggactggcattgccctgcctcccttagaatccagtactgcttcacaggtccaaggcagagaggagagcaccctagggccgtgggtcagctggacctgggctctgtatctggctctgctacttagtagtggagcaactccaggtaaggtcagagcctcagtttcctcatgtatggaacggggacacccrtaccaacctctgcaagtgatagtgaggatgacatctaaccatagcccaagatgcaggtgccactgctggtcttgctgcagatgactcctttaggcaatgagagtgcctatcccatgggggaggtttgtgctcacaggatattcctgtgggaggtttgtgctcacagagcactctaagacagcccagccctgagctgctcagggtcatcaaaagtgtttttagatatgaatgtcaggccatacaggtgctaggtatctgtgcttcctgacccctggtgaaggcctgtttcaatctggctgatgcctggtcctggctctgacacttgtcagcagtgattggcagattctgaagtgtgacaactttggaggaggagcttctgagcttcccttcctgggtcagtgcccagccctgatcccagatccccaggccactcctgtcaggggcctgatgttctagggaggcaagcagagggctgtaaatctagggttttccaggaaaagctgaggtagtagccctgcaaggcttgagggaccagctcccgcagacatgagggaactgagcctcgggtatgaggaccagccatggccccaatgctgtcagtaatttggcataaatatgtcatattgcatataaaaatacatgcaatttttttttttttagtatttattgatcattcttgggtgtttctcggagagggggatttggcagggtcataggacaatagtggagggaaggtcagaagataaacatgtgaagaaaggtctctggttttcctaggcagagggccctgccgccttccttccgcagtgattgtgtccctgggtagttgagattagggagtggtgatgactcttaacgagtatgctgctttcaagcatctgtttaacaaagcacaacttgcaccgcccttaatccatttaacccttagtggacacagcacatgtttcagagagcacggggttgggggtaaggttatagattaacagcatcccaaggcagaagaatttttcctagtacaggacaaaatggagtctcctatgtctacttctttctacacagacacaataacaatctgatctctccttcctttccccacatttcccccttttctattcgacaaaacctcctttgtcatcatggcccgttctcaatgagctgttgggtacacctcccagacagggtggtggccgggcagaggggccccccacctcccagacggggtggcggccgggcagaggggctccccacttcccagaccgggtggctgggcagaggcgccccccacctcccagacggggcggcggctgggcgggggctgtcccccacctcccggactgggcggctggccaggcgggggctgccccccacctcccagacagggcagctggccaggcgggggctgccccccacctcccagactgggcagctggccgggcgggggctgccccccagtacacatgcaatttttaagcattccttagattagcctgctgagtgccccactgggagccaaaacacagcacactcacacaagctgcctgctgcttactgagaccatttctcttggctgatgaatacactgcaatgctgaaactgtcctgaatggctcttcttccaagaagacctgtgcatggggatggtaactgtagaaacggaggggctgctcaaaggcagcaggaggggaaaacttaatgttgaggggaagctggagaggtacctcagccaaccctctgcctttgcttagggccaccttgaatgcctggaacagagggaaacctgccctattcccagtctggaggagactgcatggaggagattttggccactggaagcaatgtccccactgacttttgcctttgcctcttctttatgtgaccttcctgttgactcatacatgcatgcatccatccacctactcacccatccatctatccacccacccagctacccacacatccatccattcacccatccaactacccacccattcatccatccttccacccacccatccatccatgcatccatccatctatccacccaccccccattcacctactcacctatccatccatctacccacccattcatctacccaccatccatccattcatccttccaccatccatccatttatcaaacattgatgaggagttactgtaccaggaactggggattggaaggttctattgtggggagatagacatagaagaacacatatattagaggacctggaggcccagtgatggaggtggtgattggaggctttctcarggaaggccatctgagcattagcaaagtgatggttgagggagaggagtttcaggaagaagggactgcctgggcaaaggcatagaggcctgaaacagctatcttcctgttgtgggggagggtgtgggggggtagaaatggaggtgagtcggggtgtgtggaagacaaatggaggtggagtgtggtaggagaggagcttgggtggtagtcaagaccctcaaaggggatgccaactgttgtgcggctggtctgagggccaagctaggggcacaatcaggtctgtgttcaagtagatttgtctgatgtcagagactggagaggatgagttgtgggatatgagggtccaaggatggatccagaggagactgtgacttaactccagagaagtccttgaaggtaggactgatggtgaccttgggactcactagcctgtgggtggccaaatgccaagccctctctgatctcccaggtctaaccccaggacataggtcctgctgccaagggaggggcatcctgggatcccccatcctctaagaaatagggagatctcagtatgggaccctctccccacctaatcgtggctttccaggcatcatggctgtcagaaggggaaggtatttgggaacaggagggttttctgggagcccttgtggactgccctgcaccaaagttaagtgctgatctcggccccctggcagtcttggctcstccagtgagggaggcagctatcagacaggctggctccttctccctgggaaactgagggtgggggtggccctgtttcctaggtcctgcacggctcaagtgttgtgagctgatttgctttttcagctccttcaatcttgatagcaactgagaggtaagaatcgtcatgcccaggctgggcactgtattcctaacactttgggaggccaaggcaggtggatcactggagcccaggagttcaagaccaccctgagcaacatagtgagactccatgtctacaaaaaatacaaaaattagctgggtgtggtggtgcatgtttgtagtcccagctactcaggaggctgaagtaggaggatcgcttgagcccaggtggtggaggttgcagtgagttgagattgtgccgctgcagccagggcaacagagtgagaccttgtctcaaaaaaaaaaaaaaagaattgtcatgcccgatttgcagacagggagcagaggtctagagagattgggatttatccaaggttttgtacgaccagtgcagaaagaaaactttcaagtctgctgattctgaagctcatagttattttttgttgattgataatatattattgttttaaccactccaggttgcaatccctccgccctccctctcccaatttggttctgtagatctgtctgaatatgaccacctgctgaggtggggcccagcatggcagtgggtggtgctgtgcgtggggcctcagtgctcaggcagccccagcctgctgcgggggtgaaggtgggtgaaggtgactcccgctggcaggagctgcctcattagatggtgcctttgccatctgaagccactgtgtctgcaccgtctgcctactttgtggaagtggctttggtttattgggaaggaatttaataagcaagcagtgattctgaacattctgggggaagtgggaggcagtttgaggggtgggcagctccctctattgggccccttgggggcagctcttgttgatcccccatctctgtggaggttgtggggggatctggttgtcagggtggtcataaccacattctgggcctgcttggtggatctggagacaactaccaacacatgtttggtgttcagagggcttggtcttgggctcaagttggtcccttcagactctgcctgggctctgtgcctatgccaggcctccttgaaggaggagtgctgggccatcccctctctagttcatggctgggtgctccctggggtctcaggggcccagccggtgccagtctctgctctgtctagtgtgcttgttcccacattccttggcacttccccctctcaatcccagactctagctcccacctctctcatcttagtttcccaactttgaaaaaacttttaggggtagtcatggccccttactggaagacccagagcctttccttctagccttctgcccttggagactgcttagccaaactttcaccgttatggggctggtttgstctcttttttggtgactagtttgagaatttatctatccatccattcatccatctatctgtcaatccttttatactctttctacccacccagccaaccatccattcattcatcwactcatctgtccatccatccattcatccatcatccatccatccatccatctgtccatccctctgtctttccatctacccacccatctattcatctacccacccatccactcatatatccatccatccatccgtctatccatctatccatccatccatccatctatccatccatctgtccatccctctgtccttccatctacttacccatctattcatctacccacccatccactcatatatccatccatccatccatccatcatccactcatccatccatccacctacccccttgcccacttgtccatctgtccttctgaccatcagtctatccagtcattgagccaacatgtatttactgacacctgtggtgttccaggcacggtgtcaggcagcatggacccaaaaagagatgaggctcatttctaattggakaagcaatgtgcagaggagacatcagtcattcttatggggccatatttagtgatccaaggatgccacagagcttggtgagctgtccaagggctctgaacaaatcagtacastcatcacagtgattgttactgaaattgagtggggaggggcatgtaggagccagcactggctgggggaggccctgtgtagggggttggctttggagaggtggctgctgtgagaacaccaggcctagaataagctttcaggctgtgccattccctgtgggtggcagggttgtcaggaagacaagagggggttcttgtgcaaggtacgtgggggtgggacagggttctgggcggtggagggtggatggagggacctggaaaaggaggcaggggctttgaggaggcccgggttaatggtagggaatgccagcamggggagatggctcagtggtccccatgtggatgggcagattctcaggctcctcctcttccctgtgagctggcccaggtgcggccgggttgtggtggctgagacccagctggagtcactgtcaggagctcccttgcttgttccttctgttggtggccagggctgggctcctctcagatagcagacaggccaggctgtcctcagagagaggccacgggagagcaagaagtgtccacacagggccctcagggagcccaggtgggccgtggcttcacaaggccctgtggctttacctgcctggctgtggttagtggggtcagggagtggcagggccggtgagtgcagctgaggggagagcatcctttgccctccaggctggctctaagtcaaggccagagaggttctggagcagcacaggccctggttcccagattctggtggcactgacctttcagcctcgtggctccctgggagagcagagctgggaaggacccttgtgtttttccctgaccctgggtcgtcttggcccccaggcacatgggtgcctgccccagcttttggttcacctctcccttttgtatggatcatggtgggtttgggagtatgcgtgcacactcttgacatctgcctcagggaggctggctgctgcagctggaatggggaccatgagggttccttcttcctgccttccctggcttcctgtgctgccccagccttcttcttctgctgacctctggcctgtggctttgtgagtgcccaaggccggccagctgtggctggcgggaagcgggggcttcctttctgcccaaacttctcatgggaaagtggggcagggacagctttggggcaggtgagtggtggctgctcactcatgtggcttcaaggaccacctgagatgcccattcaccacttggggacagcactgtcacaggcagttcctttgggtggggccttctctgttttgcagaggccaccaaggaatggagtaaagcgaatagtagaggaggaatggagtaaagcgaatggtagaggaggaatggagtaaagcaaatggtagaggaggaatggagtaaagcgaatggtagaggaggaatggagtaaagcgaatggtagaagaggaatggagtaaagcgaatggtagtaggagctgcagtgatgatggtgacaggccataggaatgggtgactgtctgaggggtaggtgctgggacatgagccccagcatgggcagtttcctaacttccccaggccactggcccacttgccgtaaggggtttctgtgccaactctgggagaagcaggcgggtagtgtcccctcttccctcccctggcttaatccactcccccagagcccaggagaggagtttccaggcattgggagctggacacaggccagttggtctacagggagccccaggctctgtaccaggccaggttcttagtgcctaaggtcccccgccatcgcctcaggaggagaaaggaaaaaatgaaaacgtggaatcagtgcgacaggggtctaattaccctgggtagcatcaagcctccaattttgggccctggtgctccttttaatttggggtgtttaaatatttacctgcaatggaggggaaaaaatcttttgggctgcaaggctattctggcagcaatgcactgagaaattcattaaaccacagttaattaggggatgaaagatacgtatatagctcattagctcaacccacataatttacatctctgaggatattcgaggactagctcagcttargctctcagaaatggtgtcttgaaaggaaacctctcactttggctatttctttgggcatgtggcattagggagggggccatggctgccctctgtctgtccatccacgagagggtaaaggggcccaggcctcgctgcctcttgtgttcgccgctggagccagaggtggggctgactggctgtgctcctgctgccagggatgattaacgagggggtggcagcctccttgcaggcgcgctgcttagcataatggtgcggtgtctgagcaggctttaagctgcatcgaatccgatttctagatcagagacattatccccgatttaatctgtaatagttagagaaattagggcgggagcatcagatccacgtgtctcttaccagacaatagttcctgttctggcgcctgcctggggcctctgaggggaattagggaggccttggctctgctgaatctgtgtccaggacttgcacacacagcaggccccgcaactctgcccccttgaagggctgctcctctgtgccactgtcccaccaacttggggctatgacaggattactgaccttgctaagggtttctgcatagttgtcatcttttggtggatattggtaggaagtgcagttggttaaaaaaaaattccctggccaggtcccactatcagccctcaccctgattatgcccccaattgaggaagagagataaggagaggagctgtgtttgcatgcctatgtatatgtgtatacaggtgtgcacacatacatgtatacatgtatgtatatatgtgyacacacagtgcacacaagcacacgtgtgtgcatgtatgtgcaggtatgtatgcatgtgcttgtgtgcacatgtgtggcacgtgtgtgcagagatggtggcgaggactggggaaggctggattaaatgtcctgagggatcggcttggcccctgctcggccgtgacatctgcccgcgttgtgctgggggctgcgggtgaatggaggttggccagaatcagactggaaggtgggaaccccatgctgttaatgggtggcgctggcattttgggcaagcaactttcatttccaggccttgatttcctcgtytgtatactggcagcagcaatccctcactcagactatttttgaaaattaagggagatgatacaattgacactctttctccagggcctggcgtagaggaactgctccctctgtgttagctgttttcattattgttttttgttctttaccactctgagcctcagtttcctcatctgttaagtggggttgtctagctcacagggtggttatgaggagctgagttcccattggcatctgacacacaggacccagacagctgagtggctttgggccatgtcaatgaatgaggaggggtgggcacagcctgacagtgcttggctctccaggcctggttagggcccaggagtaactcagcccctaaagactccatctgaggatggctgacccctatcctgtcctcccccagaggagacctaccctattgagcacgggtctgcagagccaggcctctgggccttggtggtactgcctactggcaggtcctcttcctcttcttttgggtttgcacctgttcctgatggcacccacacctgcatcgggttccttgatatgaaccaccaccactgtcagatagcagcagcagcaccgagaattacagttgatatgcattctgctggagttgacatcttcacacccatcctgggaagtgggcattattataactcttgttttacaggcgaggaagctgagacacagggagcttgagcctgggcccagcgtaggcctgctggaggtggggagtttggtgaggcaggtggggctgggtgaggagctgatggacaagcagtgtccattggctgtcagtaccagatccctgtcctaccacttgttactgtgactgtgggcatgttacctctctgtgcctgagtttcctcatctgtggcctggatgtcattactcggaggatggagcaaggtcaccatgcaaagcaccagtatctggcacatggagagctctgattcttgggagtagggtgtgaagagtgtactgctggagaggcccttttggacgaggtggcctggacaggggttttggaggtgagcatgggcaggggctccagcttggccattcttcctatatggccttagccccttgcactctttaagttggctgccttacctatatccctttcaaaagttttaaaagtgccccctgcctcagcccaggctgagccagggcctgtgaatgcctgatgagggcatccctccaccagcaggcagctcaggatacgtcaagagcccttgtcctttcttggatgtcctgggaggggaagtgtggcagccctcagcctagccccctgaggctctcaaggtcagcgtctgggtcaggaggcagtctccctcttcctccataccctcatcagcaacttgtggggccttttgctccaaacactccatgatccaaaagctaggaatgccattgtcctcctccgatcttcgtatgtgttgttccttctgccaggaacacctgaccttattctttccttggtaaatcttgctctgccttcaaaaggctcagttcatgatttagcaaccacatactccctgccaggtgggctcattgtttccatgaggttccactgtgttgccagaacctagcacggggcttggcacatagtaaatgctcaacaaaaatctgtgtaattgaattagtgtacattattacaagccatctgcttcacgtctctgttgcttcttccatgtgagccattgaggccaggattcccctgagggtgggktgaagctcgatccttgcatccagggacccagcataggcattggcacacaggaggtgcttcctgagggtctgttgagctcagcaaaatacccggggctctgaccaggctgggtcaggtgggggtgtcttctgctccatccaggcagtctgggctcttgcaggtgatggcctcccaggggcagtggttgggggtttgtctcagcaggactttgagtaggaacttgcactagatcactcataactaattaattatattgtggaattgaggctcattcctattattcactgatgagaaaattaaagatctattgatattgcaataattaattgaataaaaatgtggaaataactatgcaaactctgtctaggattaagttagtgatactaactccctggtgaccagatagcggtgggggggagttctgcttaaggggagcatggcccaaatgaggcctggaggccctgcctgaggtggtgtggactgatgggtggtgctcgtttggcaggggcattgcccagagggactcagcctgcggctgtagggcccccccctgtaaagatgcctcactcttaacttgccagaagtggaggggtcctgatggccagggccagccagcgggtggagcctttgccctgaagggctaggacagagagggagttacaaagaggagccaaagtcacttcagggaatagacagcctgggtgaggtgaggagaggggctggggggccagggcatggtggactgaagggtcagagataaggtgagagttcatagccaaggctgagagtggtaaacaagtgggagctggtgcatcttgtgggcaacagggccttggacccctcacagagcactgggcagtggccactgattccaaagaatggtggcttctccccagaccctgttgcctagactttagcatcaggctgtgtctccttgtgtgcttgggtaaagaggcagtgtccattcaggcttcatgtccccagggccagtggggccttctcaggggctctgacccagcctggcagggacaccttccacgcctttccacattggctgctcctgctgctctgtgcttggctccccgaggctggtctggggctcccatgctgctatctctggaggatggggacctgaggtgaccaccagtgagccactgcttggcggcagcattgatgccatggctggaaagccacatgttgttaggttcaccctgatgcacctggtggctgctccactgcgtgcagctgctgcttggactccttatctgggcagcacattccataggggagcagttggtctcttctcttctggagctaaaatctgcttttcaagggtcccagctctgccctgcccacccccgcccccrccgcacccacccaagaggtgggcccctggacatatcttgccctcttgcgtacaatagccacagctctttttcagcacctgcttcactgacctgctgccttccctgcaccttcctctcagtgcccctggccctccagcatggggctcagtgcagaggaggcagcactccactctcattctccagatggtcccagaatgcccctgtgagccaggcacaatcccaggccaggttctagctcccaggaagctcatgtcctagtgatgtgtgtgctggagtgatgggggtggaaagtgtggaggcccagggccctgaaaccagacagccaggcttgcctctccccagccatgggcctcaggtacagtgtccgcttctgagccacagtttccttatctggaaatgtgatatttggtttcctggggcttccataacaaagtccctcaggctggtgggcttcaaaaacagatatttattttctcacagttctggaggctggaagtataagatcaatgtgttggcagggttggtttctgctgagcccctctccttagattgtagatggctgtcttctccctgtgtcttcacatggtcttccctctgtgtgtacctgtgtcctcatctcctcttcttatgaggacaccagtcttataaaggtggaatagggcccaccttcctgattcgttttaatttaatcacttctataaggaccctgcatttgatcattctcacattattataaataactacctgaaactgggtaatttataaagaaaagaggtttaattgtttctctgggctgtatatgaggcatggttaggaggcctctgaaaacgtacaatcgtggtggaaggtgaaagggaaacaggcatgtcttacatagctggagaagggagaagagagcaagagcaggtgctacttgcttttaaacaaccagattttgtgagaactcactcactattgcaagaatagcaagagggaaatttgcccccatgatccaatcacctcccaccaggcccctcctccaacacggggattataatttgagatttgggtggggacacaaatccaaaccatattattctgtccttggcccctcccaagtctcattttttatcacattgcaaaatacaatcaacccttctcaacagtcccccaagtcttaaytaatttcaggattaactcaaaagtccacagtccaaagtctcatctgagacaaggcaagtaccttctgcctatgagcctgcaagctcaaaaccagttagtgacttccaagatacaatgggggtgcaggcattggctaaatacacccattccaagagggagaaatcagccaaaacaaaggggctacaggccccatgcaagcccaaaacccagtcactaaatsttaaagcttcaaaataatctcctttgactctatgtctcatatccaggcaacactaatacaaagggtgggctcgcagggccttgggcggctctgtccctatggctctgcagggctcagcctctacagctctggaggatggagtgttgagtgcctgtggcttttctaggcacatgttgcaagctgttggtggatctaccattctggggtctggaggatggtggccctcttcttacagctccactaggcagtgccccagtggagactctgtgtaggggctccaactccacattttctctccacactgccctagtagtggttctccatgaaggctctgcccctgcagcagacttctgcctggacatccaggcattttcatacatcctttgaaatctaggtggaggctcccaagcctcaactcgcacactttgcacacctgcaggtttaacacctgtggaagccagcaaggcttatggcttgcaccctctgaagcccaagctgtaccttgccccgccaaacgcttttttttttttttttttttttgagatggaatctcgctctgtcaccaggctggagtgcagtggtgcagtctcggctcactgcaacctctgcctcccaggttcaagtgattctcctgcctcagcctcccaagtagctgggactataggcatgtgccaccatgcccagctaatttttgtatttttagtagagatggggttgtatttttagtagagacggggggcaggatggtctcaatctcttgacctcatgatctgcctgcctcagcctcccaaagtgctgagattacaggcatgagccaccacccctggccaccttggcccttttagccatggctggagctggagtgcctgtgatgcagtgtgccatgtcccaaggctgcacagagcagcaggtcctgggccttgcctataaaaccattcttccctcctaggcctccaggcctgtgatgggagggctgctgcaaaggtctctgaaatgcctttgaggcattttccccattatcttggctatcaacatttggctcctctttacatatgcaaatttctgcagcctgcttgaattcttccccagaaaatgggtttttcttttctaccacatggccaggctgcaaattttccaaacttttatattcagcttccctcatcttcctgttttcttctgagccctccaaactgttccaacctctggcaattacccagttccaaagtcgcttctacattttcaggtatctttatactaatgccgcctttctcaataccaatttgctgtattcgtcggttctcaaattgctttaaagaactccctgagactgggtaatttataaagaaaagaagtttaattgactcagttccacaggctgtacaggaagcatgactaaggtaggcctcaggatcatggtggaaggcgaaggggaagcaggcatgtcttacatggcaggagagggagaaggagagaaggggaaggtgctacatgctttttttttttttttttgagacagagtctcgctctgttgcccaggctggagtgcagtggcacaatcttggctcactgcaagctccgcctcctgggttcatgccattctcctgcctcagcctcctgagtagctgggactacaggcacctgccaccatgcccagctaattttttgtatttttagtagagatggggtttcactgtgttagccaggctggtcttgaactcctgacctcgtgatccacccgccttggcctccaaaagtgttgggattacaggcgtgagccactgtgcccatccaggtgctacatgcttttaaacaacccgatcttccgaaaattcactcattattgtaagaacagcaagagggaaatccaccctcatgatctagtcacctcccaccaggctccccgtccaacactggggggattacaatttgacatgagatttgagcggagacacaaatccaaaccatatcagaccctgtatccaaataagttcacattctgaggtactgggggttagggcattttaagggagacacagttcagcccttaacataggaggtaatgtcacctcctcccaggagcgtagtgagaaatggcacagtgttcatgacacagatcctggcacagaggtctccctggctttcctgggctttgggtctctgaggggaaggagtgtggaagcagaagcagaggactgtgtcgtgcctgcccatggaattagaagttcttcctgagtgtatctcaccacgtctacctcccagcagcagtgctcaggggctccagcatggcctggcccccagagtgccactctgcctcctgctctctgctctcctgctaaccctgagagccaggcctggccacactcgctgggtcaggcgtgtagcccttccctggcacccaggatttgccatgcacattttccttctctgtgcttctgctcctcctgacccctgtgccaagacgtcttgtcatcctccccctactcacacctgtcccctttgagactgtgctccattttcagtgctcccgtaatgggtcctgcctgctgatattgcactttgctgtgtgaagactggagctagtgtcattgatgatgtatgcaggtggtggagggaacatgctggggatgccggaatggcctagggctcaagctgtcctgggtcctcatctgtattgcactgggtacttcaagttgaaggccaagaccatgcagaccttgacttctagggatgaagtggggacagtgatggtagtggtggctccgtttttcaatggcctatgtgacacactaggcactcatcatccttgttctttactacaacatggtaaagtgttatggcatrcttcaacttgcaggtgaagacatwgagaggttgaaatattgcctaagagaaaaaacgtgcaaatcacatattttataatgaatttctgtccagaacatataaatgagtcttccaattcaataagacaagccacccaatacaaaatgggcaaaagatttgtatagatacttcaccaaaaaagagatacagatttcaaataaacatgcagaaaagatgttcaataatgttagtctttagggacatgcaaatcaaaacataatcagataccacttcacacccactaggatgactataataaaaaagacagtaacaagtgttttgagaatgtggagcaactggaaccctcatacactgccagcgggaatgcaaaatgatgcagctgctgcgaaaaacagtttgacagcttattaaaaagataaacacatatacttcaccatatcatttagcaattccactcctaggaatttgcgaaagagaaaaggaagcatatgtctatacaaagacttatacatgaatgttcatagcagcattatgtatgatggcctcaaactggatacaacacaaatgtccatcaactggtgaatagataaacaaaattggatattcctattcagtggaatactactcagaaatacaaaagaatgaaacactgatacacgcttaacatggatgaacctcaaaacattattctaagtgaaagaaggcagacacagaagactacgtgttgtatgattccatttatgtgcaatttccaaaaaaggcaaaactatagagacagaaaccagatgagtagctggctgtagctgggggtggaagcagagattgactgtaaacaggcatgaggggacctttggggtgtatggaaatattgtaaaactggatagtggggatggttgcacaattgtataaatttgctaaaactcaaaaccatgcaatgggtgaatttcatagtatgtagtttgtaccttaataaagctgtttaaaatgatcttgctgaagaccataactagaaaatggtcaaggcagaattcaaagcaagaccagccttctccaggcctgggtctgtggtccacactgccaggtacagagaggtcagcctcgggcaggagttgagagacctctgccctctgcaatgtgggagccgcaggggaggtgacagttgcatttggtggtgggtggaggactaggaggttgggactgggccttctccagggcctgaatatttgaggagggcatatgtatgagtgtgcaaggcccaaggagagagctggccaggctctggcccggggagtagggaggccgagagggctgaactgggcagctgcattttctttgggaaaaagtctatctgcatgcacgtccgtggagctttctcccctccactgtgctttctcctctcccctgcacctccctccctttgaggtttctccagctctattgatttggctggtggttccaccatcagtgcgcctgcaggtagtgattttccccatgaactgcatctcggctcattaaggaagccggtggctccctgtgtcgccagtatgcctgctgtattttgctgatgggcccagagcwssatggaccatggaggctgctttctcaccctcccattctcatcattagcattccaaagtagaaaacaagcctgatgcttgctgcctaaatatttatggaatgctgctggggtcagaggatgagagcagcaagtgaaattaaagatttacaccgcaacaccaacctgggggggcttgggccatggcttgctttttgtgttgcttagagaaaagagttttctcttttctcccaggaaacttagtttttgtagatatttgaagcaaaatgcatgaaattttaatctcttgcttcacattggatcttcctaagttgttagttactaaggagccgatgagtgagaggtgcagacccttccgtgtgtctggatgcacacagggattctggaaaaaccaatgccrttgtttggctttcattcttttggctccactggggagcagggctcatttgatagcgtgggagctgctgcctgtatagggattagctgggggcagacgtgcccgatgtttgtttctcaataaccctgaaagctggccacttctctctttctagggtggctctgatgaaacctcccattttaaattggaggaaggaaaagggggatggagcatttctgccgggccagctaaggtctggtagcaaacagaccctgaacagagttttcctagaagtgtgggcaaagttagggcaccagctatgttgaagtggcctcaggaggtgttcctgtccctagtcctgaaggggcacagagaggggacagcaactggagcaggtagtgcagccacagtcaacccagcaaggaggcagccaggggagaagcacccccaccctcacccaccctcctccccacccccaccccctctccaccctctcatttcctgcctgtgtctcccattggtcaaatcaccaagggacctggggacaagggagtcttggccatgccgtccacagcagtcagccttccagagtcccagtagtggatctggagggcccaattgtctccagtcacgttccctagaggcagagcctgggacaggggttgggtgtctgagatttatggagggaagcaggttagagaggaaaaagagacaaggaaggatgtggtatcatgtaagtctagcctgtcctgatcagggactctggaacatagagttgttcccctctggagggaaggaggggtgacctcctctaccaccaccactgtctgatgttggctgtgagctaccctagggtggggagtgggccatcccctccggcagctcccctgggtgagggaagtttgctggagaagggggcacctatgaggcccagctgcctaacatttagagcaagaggggatgggagtgtccatctgtaaagggggcctggctgggacactaatagcatctgcgactccatcagggaacagcctccgcaccacagcctggctttgtgggaggactgatgtcaattagcagacacctctggattatagaaactggccccttgctcccagccatctcatctggggaattaatatgagtgctagtcttctcagaagctgcaccgaacctggctgaggtggtcacaacagaggcagagccccttctgcagctgacggctttccctctctcggtggctgagactgttcagctttccctaaaacgctccagccggccacttcagtgggtgtcacatcctgtcccccagcctctgccatagacatcccgttctcctgcaaaggcctggctgaagtactctctttggttatcctgagaaattatcctgaagggttcctgcaagtgaagaattttagatgagggtatttatcagagccaagcattgataataaatgatgcctgatttttttattagaggagccacataaatgtggctgcttcaactttttaactcttgggaaagcttgaagttgcaggctactctgctgtgggagagtgccagctaatcaggtcccattcatatgcaaagcacttgctaagctgagttcatcaaaatgcagtcgtttcttaaaaaaaaatatttatagactttccctccctgcaaaagactgcaaggaagatggatagtgaaaaatacaaattgttaatgccctgaaaaggaagtctcatcctgagccttgctaaagcattccctattctttgagaaaaacttaaaaatgggcatttgtactctagatttctctacttccctttactaaactctctccctcctcttattccagtcacttcgcagtatctctttggagtctagtttgatctgtccaggtggtggtgggggtaggttcaggatgggtgggaaatacaacaggagaggcagctgggctgtatcgactcctgccttgactgtacctgacacagtgcagtcttgggcttgtgaaacctcactgagtctttgcatcaagtctgtccccattatagagactggaaaactgaggctcagagagatgcccagtgactgccagccagagaaccctcagtgtatcagttcctgagggagcgggagcggcattccagagcatgcgggaacagtgctgctcagcttgccttttctcctggctccctaatacaacggctgygttattcccctggggccctccctggcctcccagttttcttcctcgtgggattgggatgckctattctcattgcacttagggatgagagaggagaaaacagggaaagggaagctgggattcagggcttcctggcccacttctctacccttgtttctcctctcttatacccaagtgcagtgagaagagggtaccccagtctctgggaggtaaaaaaaaatgtccatgcggatacacgggagggtttgcagtataggagcaaccctcaccccatccctcacccaatgaacatttgttgagtgtgttctgtgtgccagcctcggggaatcatggtcacatggaggtcctggactgcttgcttccttggggagacagacagttaaatgcatgttactgtgaagaggtttgctgatgagtaactgaagacactgcgtctccaaatacaataggaggcacagactaggtgctgattgaggtcagctgtctaatgactcctgtggtggttaataatagctgctcactctgcttccttttgtggtagcaaataccctttggagacacacttggacaggttattcttcccatttatcaaatgggaaagctgaggcctacagagataacatgaccccractgtgctcttcatccaaagcttttgctgtctcattgcttgaatacttgtggagagagagaatggttgacagtagggccatgggcctgcctggttcagcatgccctggctcagggcacaagggtycacttagggggtctggaatagggttacctgtggcctgctggatcaggggccattagagccagagcctctgtccggagtgcagaatgacttggccctgcttcccaggcagatggctgtgccctgagygtgcagagatggtgggggtcaagagggcatttctgacctcccaggaaccagcccgggccccctgcctccctcctgggagacactatcttcagatttccagcagattagcagcaaaccaaccatttccgcttggaatttgaaattgattgtggacaattttctgacatgcatgtctcctgccatttgcaaaatgtgtatcacaggccccttctggaagcctagctgggcaggcagttctccctccgtccctggccaccaccacagatgtttgggtttgctggagccagagttgtgcttagagaccttggaaacagcccagtgctgagaggcctggtcctcgggaaagtctcatggaaccagggattgcagcttgggtagaagtgtggccacttgggcctgtcactgcccacaccgccgggcacagagatgtgtgtgtattactcatgtcaccatccatggagggagcccatctgccagccctgggtgggagatggatagatgggttggacatgatcctgcttggaggagctcacagaccagagggggagacagctctggcaacacagaggagagatctgggagaaatcaggggagtcttcgtggaggaggtgacaactgagcaaactcttgaagtatgagtaggaatttatagtggtcagaggagacttatgcacatagaggaaacagggtatgcaaaagtacaaaatgttgaaaggtgacatgtgttcagggaacagtgggaagttcaggtgtggagacagaaagaaatgcatgtttcctcgctccaggctcaatgctcagccaggtttagtgctgatgatggcctctccagagttgatcaggagaagccgtttgagctctgtctgctgtcctttggttgtgcattgtcactgagtggcttctgggaggggtgagacttccagctccgagggaagccaaatgtggcacaggagttcctggtggtgttgtccccactggagactcatttcctcatctgtgatagaaactcccccaggcaactgtgtgaccagagaagtggagacctgtggtggcctctctcctccgtagttcttgatatgattgcccagtctggrttggggtagggtgggtggtggttctgggatggggcgggactgtagggtgaggtcaggcagggcctgaagccaggtttaggaggcaggggcaagttgggctcgtggtgggctgcttgaggctggctggtcaccataggcaggagggctaaggccgggaggargagctgctgctaccaggagcaggatgcaggggctggggatacctggaggctgttactccttcacttaccaatggtcccatgttgagtcaacaagcaccctcagggcctgctctgggccaggctctggggatcccaaggtgaggcagacaggtgtggccatatggtggagtgactgcctgaggacaggactctatgtgtggtggtgtcttacagaggacatagcctagcctggggttcagggcaggtcatctgaaggagaggtgtctgggcaggacttagtgaagtgggggaggttgtggaggaggctacagcagatgccaggtatgggtaggtggacttggctggcccgcacgcccggctrtctgccctggccacgccatcagaagggttgaagccagatgagttgaactccaggcagtgctgggctatgacaaacctgcttaagaatgaagcttctggggtccctggaatgactggggcctgtgtactcccagaagtgcacccactgccacccccagatcatgagaatagctgaaactcatagagggtgccctgtgagtcaggctcggctctcagcaatttacaccatttactcactcagcctgtgaggcggggctattattagcccgttttgccaatgaggaaattaggcacagagaagttaggtgtcttgcccaaggtcacagagttaagtggctttaaccttggcagcctggcttcttcatccttactctgaaccccacactctgcttgcagtgctgcctggtgttttggtggcctcaggccccagcaggtgccttagctgctcctctgccctgggaggagggggactggcagtgctggccccaggcacttgctagagagtggggtggcctggcttaggctgaagcactgaggttcccatgggaggcacagaggcacatggctagagagattgagggaatggggctgagtcagggttcacaaagtagaaggcccaaaggagatcatgtggggaccctcccccagctacaagcagtccctattcggagggcacggagccccactctggaccaaggcagcccctccctactgtgagtacccactgcctccacacccacacccttgttcagggtgcctctgagcaagtggagcatttagaggggtcacacttctctccctcagtctctgctgttgcctctttggtgttgaagagaccaatgcaagatgcccttaggggtccctcctggggtcccagctctttagagcaatgaactggttgccargtgagtataaaagagtggccgggccaggagggaacccacacatccacttcctgaggggtgacccagctccctgaatgtgtgtgtgtgggtgtctcttggtgtcyccaagctctgctgtgggctggagctcctgggacactgttgttctcattgggtactggggggtccaggagagtgatttttctgctggccttggtggagtaggcccatctcctgccatccctcatacggggccaacacctggcagytctgggatgcctggccagggtgtcaggtggaattaactggcagcagggccaggtgggtgttgattgaggctgattgctggaaggcagcggctgcaggctgcgcaaagctatttccasctgctccaattgtatcaaggaggcttaatccttctaagtgcctttgtggttgggtggtgtggagtgaggatgggggaccaaggccagagcaaggtcagacttcctctgattgtctacgtttcctctcccattcaccccacccaccccctcccatgcaccaagccacccccattcactcctcaccacaccatcctctcccccacccctccatccacccatgtacacatccatccggccacctactcacccacccacctacacatccatccacccacctactcaaccaaccacctacacatccatccacccacctactcacccaaccacctacatattcatccacccacctactcacccactcacctcacatccatccaccccaacccggtcccccatccatccacgcattcaaccatctttccttccatccatccaactatccttccatccacccatctgttgatctatccattcacccatcartctgcccacccatctacctacccatctgtctgttcttttgtggccatcattcagcattttcctcagtgtttactatgtatctaccatgtgtcaggcaccatgcagggcctggggctaagcacagatgaggcatggcctaggtcctgcagtggctcacagtctagtggtgggaacggtgcatggagcacccatgatggagggaggatggccaccacaggagctcaccttgggaggggagccatgctgaggaccaagcagggacttcacaggtgggagctgggccgagcatcctccaggcagagggctggcatgggctggggctcagacgtgtgaggaaggacagcagagtaaggaatggggtgggagcaggtattgggaagggactggggaactgggctggctgagctcatgagggtcttggggctgggtctctggctgctagttctgtgagaatgggagtctttgagagtcttaagcaggtgtgggttttaggaagattgctcctgtgagcagttagcccaagaggcaaggctggaggcaggaaaatgaaaagaccaggagctcctgccttggtgctggggctgcagcccccsactactatgagcaagttcttagggagtactatgagctctccaccacccctgccttaatgctggtctcatgggccacctcagtgcctatgacccaccatacaccccagaagggcccctttgaggggaggggcggccccagttgccattgtctttcgtcttccttttctcaactccacctttccaggcttctcctttccccaggctcagtccctcctctcaagcctcttccccactgggaagctgccctggtagagcaggtggcttcacccaggcccatatcagagggaggctccctttcttgactctgtggctttggaggcttcccctttccaccagctgcaggcgcacagctcagggtggctcctctggtagatgcttgataatgtastgaaggataaactgcagggcaggaggcctgtgccagcagggcatgcagcaccaaatcaggaaaagcagcaaggctgaggcctggtaattccctgcagttgtctccaggtggcctttggcagttccatttcctagttagtgtgtgcaagctggctgagctcagggaggaccgccagctggtttagggggctgcgggtgaggggaggcctggctgcctctctgctgggactgctgcttctggagggagtgggtgaggaggccgggctgggacttggggcacttgtccaaggtgactcctgttgctgccaacaccccactccaatgggaaaactgaaggtgggagggtatgctggggtgggagggtatgctggggtgggagtgagggtgtgctggggtgggagggtatgctggggtgggagggtatgctggggtgggagggtgtgctggggtgggctctgaccactgcttcatggggtgtcagctcagggaggtggcttttcaatagctttgcatatatgagtgaggcgtatgacgtgtgacggccaggggtgggtgggtaggatccccagtaggtctgtgcgggaaacaggcaggtcccctgtccagagacgtggctctgaggtcttccgggatgtccttcttccctttcgttcttacgctcttcttgcttctcatgcctctgtcctttgccccatcagcctacctgtccacctgcagggtcttgtcaccttcattaggtgactattaattgaatcgggcctgtggaattccaaagccccaatgagtgggtccccatgaggcccccagctctgtagaaaagaccccacgaatgcctgcagccttgatggtgacctgatgctcacacacggccgtgatgtcatggttgctgtaataacatgcaggttcatttgctgagggcacattggcttgaggtcacaatgagtgctctccagcagcaggtactaaagtacagctacctcatgtaggagccagttttgaactttataaaagggtcctgtcacccaaagagctgggggacctctaagtttctgagctggtccttagcagttctttctgctcctctccccaacaacttgaggcccatgggccttcttggtccccctccagggcagggtgtctggcagatgctgtctttcatgtctaggtggggctggagctgggacgctagcagctctcctgtaccttctggaccctgctgtctccaggccgacatccagccactgggcctccttccctgcagaaatacacgctttgagaagagtgcaaattgccgtgagcaatatatagtcctcatctgaatacgattatgcttaaacgctataaatattcgtaattctcagccttgagtactgcttcccttggtgttatatccttttaaaaaacactcaaccatttaaggcaaaaaagtgctgagctcatcctgggcagtttcctttgctggtgtcatggctggagaaatgcaagtagtgaatcatgactcttggctcttagtctgtggtttacctcgggctcctggacaagtcactgagctattcagctccccaccggcctgggaggggctgggaaatgtcagcccctaccttcctccccgcccctctgtcttcacaccagggttgtctgctggaaaactggagtcagggttctgtagggcaaaatcgatgctttctatgtgaaaccagtcctctgcacctgggcttgatctaatgcaatagtttcattcactccttcagtaaacattcctccggcacctgtgccttggggaccctgaagtggcctcaacacggttcstaaattccaacagctcacagcctggtggtggaggcagagggtgatgattcagagtgataatgccccggctgagctgagctctggatgttgcgagggtgggaaaatctcaagggcttcctgggggaaggggcacttgaattgaactttgaagggtgaggaggaagggacagagagccatgggcttggtggttggtgtgacaatggctgagcttattttagtggccagtgctctggatggctgcgtagagggargtgaaacctgggtgcactaaggatagcagctggctgtctcctcagcttacaccttcctttagcttcctagagcccctacgggttgatggaggtgcaggacagctgccatctgggctggggtctttgagagtagagtgcgtctcccctatttttgtgctccccacatcccatcctgcccagtccccatgagaacctgtcagagcagaagcagccatggatccagctgtggcagggcagtgggtggcagcatcctcatgcctgggactccttgtgttctcctctggggactcccaagcccaggagccttgggttggtctcttttctcatgagctgaatggagtgtgggccacctttcaagaatgtactgggggaggaggaggcttacccctctctggtaaggctctgcctgggtaggtgtggacacttgggctcacttagccagtcagcacactttccttcaaccaatgctgttgtgacttaagcagatgcagaaaataggtgtgtgcatctgtgtatgctgggagtgtcgggggtgggagcttgggagggtggggattccgggagttcaagaggttggagggggtgaaaccggagtacagttggagggaacatgtgcctggcatcccaggaaggttttccttctttcatgtgacttggaatatcagtgtatcacctgctggtccttggtctgtcatcttctggtctttggtttatcacctgctggtccttagcctatcacctgctggtccttggtctatcatctgctggtccttggtctatcacttgctggtccctggtctatcacctgctggtccttggtccatcacttgctggtccctcgtctgtcatctgctggtccttggtctatcacttgctggtccctggtctatcacctgctggtccttcgtctgtgatagacacagcatgcagttgtcacttgctgtctgtgctacctcagtcacttcttggaaagccgacccaagctgggctggggattgcccactcccatgggcttgagggagggagtgcccctgcctcaaagcctgagctgagctgcccttgttggagacagtgcagaggtaggcctcagagcccctccccatacctccagaactgcctggaatcatccctccaaatctcctgagaggttcagtggccttgggtgtgactgggaaagctccctgcaccatcatgggratgcctcctcagcrcagagcagcyatgtgtgcatgtgctgggggccatgtgcctgtgggtggtgtgcctgcatgcgtgccaggcagggcatttggaggggcygagcccccagccacagctccgcagcttcctgttccttctctggtgtgtgtcctggcagctgtgtccttctgcctgtcatctctttgtctctttccagggaaggtgtctgggcagggggtggagaaagggagcaccatcttccatgcgcagggcagggctggagctgagcaccagagcaacctactgtgccctccagacctagccatcccgctctcagccactttccctgcagaaaaaggcccttagggaatgcagagagcaatgagcagtatgtggtattttggggggattctcagagcccctctgccttggtttggtataccatagtgctccccagaagcaggtcagtggcatgggagcatacatgcccaggcttctctcccagccagcaggagctcatagttcacagtggggtggggaccctatgaccccagctgagcttgctgtggagggggggatgcagtctcgcatgtccccccagggggtgacggtgctgttttgggtgtgcacctgacactcctagcccttgcctgactgtggccctagtgcccttgtggcttggtgttgtggtgaggaagggggtgccctgccccccttcagctgggctccagggaagtgctcgggctctgtgacttgtgtccactccaacttggggaatggcataatgcagttttgcccatgcttacaccccttctccccttcagaggtcttggatctgatctgtcccagtggctggccctggcacttaggggctcctacagctccactgccctgggttgccaggctgcctctcctggggtgcgtctttcagaggcccctccatttttcagtgaacaggcctgctccccagctgctgggtggcccctaagctcagcctggcctgcaacatgcatggtttctatggggcttcttcaggacagagtggggtgaaggccccgcttttcctccccacctgacccactgctcccaccaccccttccctgggcactcagatggcaccgagtccctcaaggctctgagggcagctaaggtgctgactggaggctgaaggactgaccacgccctccccctgggctgggaggcacctggaagcccaggcttggggtgggcagagtgtgccccttggaagccctgagttcttgtcctagctcactccccactagccatgcagtggatcatacctggcaagagggctcacatcgccaagcttcaggtgccccctctgcaaatgggtggccccccctctaggcctgggaggatgccatgagatggcatgcaggaccctcggggaccaccgcrtggtaggtgcccttccctagtcctgccagcttcagggttcttggggtttggtgtctgtccttggcctgtccccttcttccccccatgctttagctggctctgtcccctgtttctgtgatggccctgatgctgttcctgctgcctcccaccccctgccctccctacccctgttccttccgggtgaggaggaggaggaggaggagaaggaggaggagggggagggggcttccacctccagccctctggctgcatcctccctgtggccactttcccagaagcaagctctgagcaggtcctgccttcaaggctccctgctgctcctgggatcaaaacaaagcccctcagctgatcatccaaagacttctggggactccaccctccctttcctcctaacagccgtcacccaacctctcaccccagtgtgagcgggccattcctggagggtgctgggccttggctcacagcagccactggcctgggttgtcctctttctctgccccagcatcagctgctgtcctctgtgaagcccccttgacaccccaggctacatgactgtccacccccactccacctgctggacctccaccactcccacagcccacagcccacaaaggcttcctctccagatagcctttgctggggcctgtgctgggatctgcctcagttctgtgttcccagcacggcgtgcttgaggagttttgtggggggtttccgggaggcaatttgataacctgctgggagaaygtggctcccaatctgtctattatggctagaaatgtgctggtgggaagatggagcctcaccaaccaggattctctaaagttcctctctggtttgtgagttttgttgtattatttttcaattttctctgagcatctgctactgtgaaaattttcattatcactggcaaagagcccctctcatccctgctggctgcaggagatttccgatttctctccccgactgctctgaagcacctgggggctgagatggtaacgtcccagggccagctgggctctgtctcagaaaatattaggagcagggccaggctgaatggccagggaggtgctggccatggcttatgtcgtgatggctttgcctcctcctggaggcgcagggttgatcaagctgagaaagctggctttgggggccagtcagcacctgtatccacttttccatcttgagagacccttgcccccagggtggtcccctcagatgctggtgctgggtgcatggygcacccccgacacctggctgactcattctctaaaacaggcctcatgtcaacaacttcagaggctgtgtgctgtcatgctggctgttaggacggcgatgaggtgttggaaagcaaagcccatgcaaaacttggggtgaatgagaagagctcctgcagcatgtgggacacaggctgggtgtggcacccctcacccctcacctgcagaattgcacctgggcatcctgctcagagatggcaccgatgagcagaggatggccttggacatgcccaggcgtctgaccatcagcccagacctcactctcctagcttggttttgagtttgaacctggccaggctgctttcttctcactcttcttgcagtgggtggtaagttacctgtacttactggtgctggtcaaagtgcttcctcagtactaactcgactctcattattactccatgaggtcaggactatcataaccgcgttttcagggtagggcatggagcaggtgtgacttgcccacagcagtaaggtgcagagcagggattcgagtccgggtagttcggtgccagaacctatcctcttaccgctgggccagtccttctctctgagagttctggagagcctcctttctcttgtgtcaatcrgcgtcctctgcactaatgtggcttttagtttcaaaggggccaagaaggagtgtgtttagcacttgattggtaaatgaatgaatgaatgaatgaatgaacacttcccgaggaggaggaattagcattttagaacttattcaagatctattttgtgccagtggctatattttcacatctgtgtgtggtgcaggtgccatgacttgttcttctctgcccttcccccattttacaaartaaggcatgaggcatgaccaacccaggctctgggctgctgtgtggtagaggtgggctggggcctgggcttcgtgattgccaagtccattctctttgcacagcccaggctgcctcccggggggagcatctgtggactggctggacagagttagtttgtgagagatgccttcagcttccgtagtgtcactttgcctcttcctcattctgttcacagtcccctggagttagcattttgaccagtaaatgtggacaacagtccacttgcacttggccacataagaatcacaagaaagatataaagaacagaaaggacctgggatgggggaacccgctccatttacccccactacctccccagcttcaccccagctctctccctcctgccctcactctgggacggggggccacacgtgaccagggctgtaggggagtagtgtgcagagcagggagaaggggagcgggggtgctgcccctcataggtcatctccctgggcttggctgcaaggcatgctgggggcttgctggcagccaaggtcggtaaacaactaggctgggcagagtgagggaggggcggcgtctgtggagggatggcccttgaagagggacctgtagcccaaatacctggtttaagggccattgggcagttggcagcgttgaactcacactggagggtgggcacagtcccctggtaatggagtcaggaaaggtggacgatggattgggggttctgggtcaagagcccagcagctgggggtgtaggggtggcacattccccttgagggaatgggctagacctgcccattggcaggcttcaggccagtgcttctgtcttggtccccaccaggtgacaggccagggagcggcacagagggctgcatgcactcccacctgacctgcccaggcagttgtagagggagtgaggtgggtgtgggcatccctgtgacttttaccccagagacagacccacagggtgatgactggctgccattgcctrtggtttgcctggtgagcacagctgtctcgggctgtgctgtcgatagtgggtggaccagggccaggccaggatgatgtacatcccgcattgtcctgttgctgcctgctgctccaaggcatccagagctgggggtcccactccatgcggggtgctagggagacacaagtcctgagggtgctcagtgcaggtggtgacagggaccaaggagcagtcaatgacactgagctgcaatcacatataaagcagaaagtgacatcagaggaagggcctgtgttgtcctgattgtgggtaaacaagaaggtccctggagaggaggaggcacttgtctgggtagatgagaaggattcaccaggtagataggggccaacaggggacagtgagcttctggcaggggaacagcaggtgcagagatgaggacacagcatagcctccagaccctgcgctatatcctgaagcctggaggttgccctgggaagtctgctggctatgctgcaggattagtgcaaggccttggagctggggcttggggctggttaggctggcagggtgggcyactccaacctttcctagaagggctgctggccaaggagtgagttttgctcctgctgcatgaatcacctggggtgggagagactagacagctgagggcctagcagggggcatcctggtcagcttccaaatgcagggtggagatgagagccttggcacagacaggagctttggagcagtcagccctaccagggaggcaggacataggctgcggtggggggagtaatttccacccatacacctgcatatacctttgctggtgcgtgcrtgaactcacacacacacgcgcacaagcacacacacacaggaccaagactcagaaagtcagaagtaatgataaggagaatgagagagccagagaaagctaaaaacaaaagtcagacataggttgagatgaagagggagagccagaaacctcacagagcctcagttctccatctgggagggatgctggagcctgctgtctggatgttcttgtctttcaggagacaaatgcaggtggggtaggggagaattggacacaggatcaggcccggtggcccggggctgcagggagggctgaggcaggctctgtggtgtggcctgtccataggagtctaactgcaggctccggttcctcagacctggccttcatgggcttctcagtggtctgttaccaggagaccagctggcccaaaggccagcaggaggagagaccaccgtgtagctccctccctgagcctgttttagggtgcagtggacattctctgttcccatggcccagtgacttctggagaggtgttgcttacgaggtgttgcttacaggagcaccaaacccgcaggcatgtggaatttctgggaagccggctgcctctttcctagggccaggccatgattggtgtctggccaagagcttttctgctcaacagtgctgagactacctctgcccgcccagactgaatgaaggaattggccccaagctcctccactctctacttggccgagtctctaaaaacaggatcccatatgagagggctgtgaataacaacagaagttgatccttttttgaacacttactatgtaacaaacgttattctaaactttttacatgaattagttcatttaattctcatgtcagccctaggaggtgggactgttattatccatttacaggtgagggatagaggctcagggaggttaagtggcttgcctgagggcacacagctaccacagtggcctgactgtctcctgggctggtctcttaactttgagatcagagacagctcagggtttgaacccaggctcccctgtgattttaggcaatgctgtaacctaggatctctgctcctgttcctcctgtctagaatggggtagtagtacccacttcccagggaggccatgcggttcagtgattagttgagggggccctggcacagctcccttcctcctctcccacttgtctgcagcagaaggcatgtccttgccccaccctgagcactgccataaccttatcctctttttcagcctttttctaaacagagctggaagcaccttcttggttaccctagggatccttttctggccccagccttccctggatgtggccacacctgtccctttctttcccccttagtctatgtcctgggcatagccgagctcctcagagagctccctgtgctgcccaagtctccaccctctctgagccagctgtgcttcatagtcttgggacctgagttgtcctgcctggggccccatggaaccaagggttctcacatctggctgcttgtctctcccttcctttgccagccccaggacagcaccgttgctttctcccaagcttctcgttgtccttttctgaccccgaaccactccctccttcttgggcagaattagataaagtgaattgcccaggactcttgactcattcatgcagggactggattctgaaccaagtctaggaggccccatattccaagatcttttctcattgtgcgctgaaggctaactctagtcttggacaagacagaattttccattgcctcattcctaacataagttccatcccattgattctctgacttactcgtttaccttgaaacactgatatttcaaatgatttccctagtatggatgtttctgtgctttcactcagctcattcaattgttccatatcttctgaatatctctgcttcaggccctgaccctgaagatacacaaagccatgagcctcagctcctcctcttgtgaccttagggattaagcatgagataatatgatatatatgcaatagaagtgtgctaggataaagtattcctggacatgcaggaaaaggaatggttaactttgcctagcaggggaaaagtcaaataatgccaaagagcaagaggcatttgaggtggattttcgggagtgagtggaagtgtgaaaggcaaagtaggggaggaagagcatttcaggaaaagggaatcagcacgtgcaaagatagagattagaatgggcatgtctacatgtagagagcatggggcacgtgaaggttggcaagtacactggtgccattgtgatgtgtggagctggggagcggtggaggatctcacaaactggactttgatcacttgcagtggggagcatggctaatatttcaagggcgtgcttgtcactgactttggtctgtagagtgggttggagaaagaagggctgggaggcagggagaccagttggctgataggggaggaatacagacattcaaaggcagagtgaggaggtgacatcttgtgggctggcctggggctgaggaggagcccaggaggagctgtctgggcttgggttcctgggagtgcttcaggaagccccattgctcagttgctttcgaggttctccaagacgctccctgcaggcatgcccaggactcatcactgtcctgatttaactttcacagtgtaggcttccatgtgaatcctggctggggagcctaacgtttcattggcggagcagtaaaagtcattaatgaggagctggagagctataaataagcgagcatgatcccacccagtgttccctgtttccaatctgcaggagcagggaattggttttgattcattaattgttagaggaatgaggccccagagatcccatggtgctgccagctcttccccaccctcctggtctgcttcgtgcatcctgactgcatgagctgcccacctgccctggacgacagtccgtcattcctcaggaccattcggctctgctcccctgggcctctctgggctaggctgagcttgaggccagagaggctggggctcccagcctggtagtgctcctggtgagatacttgcacagctgctgctgcctgagccaggcctcaggctcatacctcttccctccccactgtccccttggttctctgcaaactctcagtgaacccctccttagaaggagtgttggctttaaggaactggctccctttctccaaattgtgggatatggctttgccttttggtgaacatgatcactgtgagaccttggcaagtttgaaaactttgtgtctcacccacgaaatctggactccagttgtgcttattttccagagttgttaggaggattcttttctttttttgatacggagtcttgctttgtagcccaggatgaagtgcagtggcactatcttggcttactgcaacctccgcctcctgggttcaagcaattcccataccttgggcttccgagtagctgggattataggcatgggccaccatgcccagtaaatttttctgtattttttttaagtagagacaggatttcaccatgttgcccaggctggtctcaaactcccaagctcaggcaatctgcccaccttggcctcccaaagtgctaggattacaggcatgagccacagattacatagtttcttgctstgctgtgctgtgctgggtgctgggggtcaggggggcgggtaagcagtgaaggtgcttctgcttatgggcagaatgagaccacacaaaatagtccaacatggcaaatgtttgttagtgccaggaaggcaaaccatggtgagggaagactggggacggtgtggaaggttctctagagggaatgatggttacctacccagcacacaggagaaggagaattagccagacagacgtagcagaagtactttaggcagtggggagagtgtgggaagagtcctggcagtgagcaagagcttgggacgcttgagttactgcacaaaggcctgctacctggaacgcagggcatagggtgtggagtatgctgggcctgtgggtcccattagggtgtgcgttttgttttaaggccagtgggaagctcatgtgattttaagcagggacagcactgtctggttggtgctttataaaggccagtccactagtgtgtagaatggacagtgtgtccatctgggacaagtggggaggttggaggtgtaagggtccactggagaggtgtcagtgttctggcccaaggtgatggcagtggagtggaggaaagtcgacaggctcaagatatatttgggagataaagcattcaggcctggtggtggcttgggtgcagagggccagtgagagagaagggttaggaactggtgggtggatgggacaccactttactgagtttgggagaccgggaagaacagactcacaccctaggcagttcagtgttgatgcatcaagtttgagctgccaagggactcattaagtggagaactcaggcagatgggtgggtgggggtcaggaccccagggggagccttgtgggcttgagaaataacggtagagccctcaatagggccgggcttagtgttcagtggggtgggtcaaacatgcaaggaatgttgatgattccataaagagagggtatacatgatggatctgggtgtggraaaaggccagaggagggaggcttcggagctcaggagcagggaccagccttaggagaaacttttctcttgagctttcagcacagacagggaggtgtggagctctggaggcaggaagtcatgcgagatagcttgtgatgatggcttctgattcatgaaaaaggatgtaagtcattcgttgaacttggggaataaacctgggtggttcaagaagaacggggagggaggtggtagagatgtgtcagcgtggggagccctgctgaggtgggtgactgccatgtggccaaggtcaccaagttgccaggtgcgtggtactctctgtggccctgcactgcttgccggcagtgtggaggagcgtgggcaggttgatccaccctgagttgactcctagttgggatttcagcagccaggctacataaggaaagagagggattctgtaatggagtgactggagaggaggaaagcaggctccaaggcaggaggtggggttgctgcaggtctctgggaagttggaaagtgggcagagaatcactgaaacacagtctgtgggacaggatggatgcctgtcaagtgtgtgtcctgtgctctggagggaggcgtcttctgcaggagggacgggagagccagctcactccagggcccgagctctagcattggcctcttacagcaccaccacccatccccccaccattttatggttttggttaccttttaaatgtcttaataaaagatgaaacgtatttattctccatagatcaataatttactatgagttatgacaatactaaatttggtcaattatttatcagctctaaagtatttataaatgctaccttaatttaaagcattagccattggaattcaaatattaataaagctgtttcccatttaaaggaagaaaggaagagtacagataatgagggtggctgggggcaggtgggtgctcgtggaggttaagattattggaggaacgaggtggctcgtggagcagccttgggggcggcagaggtgctggactcccttggggagagaccattccttctgggcaggcagggctgagcccgggtttgcccagagcctggctcttttttctgctgcccgtggagaggagctgagccttgctgggttcctctgaggttagggcatcaggttgtttctccccaggtggaggctctctcttgcctcatscatttggaaatgtcctgctgttctttaaggtggcacccaggggccagctaacacaggagctgccggttgagggggcttgggacctcagagttgcaggggctgcatgggcagatcttcttcctgggtgagcaagcctgcggagcgatgcctccagggcacctgacagagggaaaggctgagctggcagtggccagtgtcgtgactggggggtggcaccaggaaccgtgggtctcttctaacacatgccttctggggtattgcttcccacagccttgttctgagaatgttccagaaatccccacggggatggagaatagtgggcatggattagtgatggcgcctagagtgacctcaatgtctgagggcacctttctcacctccagcacccacctgcaggcacccagtgacttgatgagtcaaggatctgctttcaggggagacaggccttgttcctgcctgcctactccttccctggggcctgcactgagccgggaggtgccctggggatttctatccagggacagttgggtagagtcagcctggaatcctgggttctgtcccctgctggccactttctctttgcagcattggatgtagaggtgcctggtggtctggtgttctctttgctgtttgctctctggctgtgtggccctggccaagcaactagcactctctgtgctctgattttttttttttaaccagggaaatcagaaagctcacctggggtgagagttactgagagtttgttctgtgaagtggccagtacctcacctgacatgtcccacccctgagagtccgctgtctggaaaagcctggatgggtgggatgtgaacatcttctccagggaagcaggtgggaatgtgactgtggattgtgcagttgtattgsgaatgctgtctgggcaccccccacacccccaatgccgagctctgagtagccctttcttttgtggggaccctccactttcccaggacacagggtgcaggtgggggggctggaagccgctcattacagtttgtctttacttactttcccagctgatggatgggtcattctcagggggcccttatcagtccatcaagcctgtgttgtaatcaagagagacatcagctttgtgaccatataatatggaggcaaagaattataacaaaagctgttatcctctagagagctgtaaaaacatctttgagcatcatcctaggtagcgatgacttctgagttgctactatgtgccaggcagcatgaatggctgtccacatataaagacctttcatggcacacatggagcagccctgtgaagagggagccatcatctttatttgacccccccaagaagaaagaaagaaagacagaaagaaataaagagaaagccaaccagtaacccagagaggaccagccctcacccacagtcccagcttgtgaccagggcaggccccggactccggccaggtggccagtcccagtcctggggttcagcatctgtcacaacaaccagggcatgcattgtgtaacatcccatcacacacaaccttgattaagctaatagctgatttggctttgatctgatgtattttgatcttattatttttatgttagaagcctccaaataaccatcatttcaacagtgccccaattagcaggccattcacagtggattggaaattgactcacatcgggcctctccattagcgcctgggagaggcttccagccttaattacccaccctttttgtggaggcctggcgcttacaacgctgcaggtggctccacgaggggtgggccggcagtgctcacctccacggggagggcgagatggctcttgcctgtgactactagtacttaagatcctgggcatgactttggtggagagatgggatgtccaaggaaggggcaggaggctgacatctgttcagcatcttgtgcactgtgaggcattggcgcttgctatcagcgtcctaagtcagtgctctcgtagctctgctgggtagagattcttattcctatttaatagaaaatggaggctgagaaagggacatgcccatggctgtgtggctrctgaccggaggagccaaaactggaacttgggtgaatgaatgcttgagatccgaatgctcttcccaccacccctggtgaggtggtagctggtgagggttcagcccggctatatgtctttgtcactctgcacccaccttgtgctgctctcctgagaccctgaaaggttctaagtcccttccttcctttgaggccctggtgccaaccacaaatgaatttaccctcctctgtgtcccagggagcttcctttctctctcctccagttgagttgcagagtctgtctcctcagtggatcctaagctcctcaaagatgggacctgtggtcatcctgctcttccccctgacagtgcttagggcaggggctggcttgtggggtgtgggcagggataccaagtgtatgtatgagacaaggagggcaggagccagtggcatgcatgcccagatggggaaactgaggctcagagaggttctgccacttcagaacctgacatatatggagtggggacagatgatgacctgggagggagccaggcaggtggggcaacaagagccaaaagtgactgatggctgcaaggaggactctccgtgggagtcctgggatgggacaattccacaattgagcattggmgttcctggacaatttacgtcccagggatatacagtttattttatacaattgctgtttaagattataaatgtattgtattggcattaaagagagcatgcataagaaaaaatatccacgtattgtcatagtgccttagcttttagtgttttctcttgctgttttcatgggcgtgctttctgcctagctgtaatcatagttagcatataattttgtgccctggtattttcacgtgaccatctctcagaagcattttccccatgtctgtggcagtgttcgttgtgtggcctcacatctcattatctggaaaatggatgcaatgatacctactctacacaaatgtcctgagaatactgtgaattcacatgtacaaaggacgccaagagaatttggcacagaggcaattctcacacaatagtccttcctcctgtgtagttttcctgcttatccattatcagaggattatttttctttttaaaaggaattatctgtttatgtcacaaaattttggctaatatagaaaagaatgaaaaccactttcaggtttcttctaaattgcagtcacttttaacattttgcaatatttccttctggtttttctttcatgcatgttgatgttttatttaattgataaaataaaatacatacaattttgtatcactttcacctaccttttttatgacaggcactttcccatgttattgtagtatcttcttgactagtttaaaggctatatatactttcagaaaatggggcactttcataaccactcatctatttgcatcttttagatcattagcaatattccaagagtatggatagtgtcctctgaatggttttggattgagtgctgttcctacggtttggacaggtacccagagaggaattattgactggggccatggaaattcttgcatggtgttcttgcacgagtctttactgctattgtgaactgggcttagcctgtgtctgggaaaggatggtgaacacagcaggcatgaccctkgtcctcctggagcctggggtcaagttggagagccagccagtaacacaggcaacatgtggctcatgacagggaagtgcagtgaagggggataatgccacaagggttatgagccagtctggggatgctgagtctgagttttgaagcaagagtgagcatcaggattgaagaggtgagtttgagggtccagggtgggcagttggttgggatgtagcagaaaagggtgtggtgaggagcatgaggctgcaggtatgggagcttgcaagaccaccctttcaggagtgggcttttactttatccctaggctcttggggggcacagcagggcacgcaatggatttctgtttaggagagaactcagcagactggagctggggtaggagggggccagggcatctgggggactgtgagattcacaagatctcatcatctcttgtttagctaccccctgccggtggccttgaagaggagagaaccgtaggatttgggttctcttcctgctggtgctcatgcaggtgcaaggcgagcgcccttgcatggagggcagccggtctttgctgctggagagtgtggggggaccctccccttcccacatgttcccctgcctcccactgccttgctccctggggtcagttcccccttttcttctctctctctcccagccttatctgaggcattacataaacccaagggctcttgaccaaaagaactgcattgtcaaaagttgttcaaagtctgctgtgtgcagcagatggcctgctgccattcacagcctgtgttttgaaactgcatctgcggccgggcgcggtggctcacgcctgtaatcccagcactttgggaggtcgagacgggcggatcacgaggtcaggagatcgagaccatcctggctaacacggtgaaactccgtctctactaaaaatacaaaaattagccgggcatggtggcacgtgcctgtagtcccagctacaggggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaagaaactgcatctgcttctccacatccttgccatcgcataaaccattagtaagagatgtttgcttcaaaactggtgcagtgggttgcagcgttgggaggtgcatctttctattaattggttgatgtcccaaaaaagtgtacgcacgtggctacaaggggcgcctcttgcagttacaggagaacttgtaaagatgagcccctgagcgtgtcagccctagaagcggctgctggagcgtccgctgtgttcctcctccacacccgtggtaactgcctgagtggcgggagcgtctttctttgttattgtcaagtggcttttgaataatccttctggaacaactgcttcatctggggtttggcccagtatttttgtgatatggatcacttggatttggccagaagacctagggtttcttttcttttttatttttttcctacatcttgggtcctcttgggtaagtacctctctgactttcagaagccatttagtcccttcagtcccaatcagttcagttcagtcaacagttgtagaacacacagtatattctctgcctgtggctaggcatgaggatgcacagatcaacacaatgacgttttggctcttaaagggcttatagtcctaggtgggaaacaggatggctaattttacagctcagtgggggtgaatcaggcagatttgggatggatctgtgctctaccatccttccctgactagcctagggcaaatggttttgcccgttttgacttctattttctcatgttaaatgggtacaagaatgtatagctggcattttcaccaaggatgtcagtgaggctgtgcttatgagagccactggcctgcccaggatggttcttggtcctggagggaggcagcctctcttgggagtcctgggcatgagctgccaggcatggggcctgcaggttgaagctggtgcagcatcgccctgatgctgaccccttcctctctctcttctctctttctagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtyatgttctacgacagcgagtatggtgagttgtccggcaggcgagctggggctgcttggggacagggatggccagatgctgggagacctgagagtgggtggggccctggaccggtcrggggtggtctgtgctgagtgggcctccaggtgatagggtcaaacctcgagcttcatgagtcaggaagagctgcaacaacagctccatagataggtataaagttgcctagcaacaacaccttatcatgacggctgaagtttgaatcatcttagaggtttcaataaaatattaataaactgctggcagggatccaaagggctgtatgctggcacagatggaggctggaaagcatggttcctcctggaggtctcctctccaaagagtgcccttcacactggacgattgcctggccttcctggctccttgcctccatccatcgcaatctgccttcagtttcagggttccaggctggggcaaaggtcaggggacggaatgccctgagtgtcatggagccaggctggggttgggggttgggaacactgggtagggctgggcatggcttctttgaagacctctcatatgaaaaaaaatcataatttgcttgttaggaaaccacaaaaatgggctttggagaaatggcttcaggttttcttatgactgctctgtaaaaacagactagtcttaatcctgagatagaatggtttccatgtttagtgtttaaacaatttttttgaaaattatgygataatttagatttacatgcaattataaggagcaacctagggagatccagcgtgcccttcacccaggttcccccacagtaacatcctgcatagctgtagtacaatattgcaaccaggatttgatacagcctgtaggccttgttcatatttcagtagtgcacgtgttcttgcaggtgtggatttactgctatgcattttaaaaatcacatgtgtagattcctatgaccaccagtcaggatacagagcagttccttcacaaggatccctgtgctacctctttatagccacagccacctccataacatgttagagggtgtgggagactgatgagggttggcagccccacggctggtgccaggatggaatgggtggaccttcaaaagtcccattttgtctctgggtgatataatttctttgccaagaatgtaactaagaaaagaaatcagcatatgtttgcatttgcctaaatactcttcttctctaagactggaatgttgtcctcagctcttgagcaaatatgctgtttggagtcttccaggaagaattgaaagagcaaacagtcactgtgctgaaataaagatgaggtggatggggacaagggcaggacctgaactggactcagtccaggacctggcctctccctcccaccctcccactcctgctcagtccctggcccttggtgaggagttggagattttgtaacagccccgagctgcctgcagggatctcttaggggccaggccttccccgagaacccttggggctggtggctcaaccccaaagtccagcctgctctgaggctgaaccctgtggagaggcatggacactgccagggatgggggtgctgtggtccagtgtgcccaggcccttcccatctcactttctctgggcaccattgctctgtttccaatctggcctgcagacacagttttcccctagagcctgggaggcgaccttgatgggagcctcagccgctgggagggcaggtgatcagctctctagcctgcccacccgcctgggctcctgtgactcctgcagactgaacaaggcctggtggcacttgcccaagtcctgttttcttattaccctccttaccctcactcttctcaagatgcaggtcctcaaagaaaggtgtccctgagccccacctgtcctacagagctggcagcttggttacacgctctcgcagacatgctcgtcctgccctcagcctgctcttggcttgtcctgactctcatgagggctagtcctccatgagtgctggactgcctggtgatgcagtgaagtccgggagagtggctgtgtgcttcccaccaccatggccctgcagcctgcatggtgcctggcatagagtagcccctcgacacattcatggatggggacatggagttttcaagccattttcacacaaaacaaaggaggaatggggagaaggacaagggtactggatggtctgacctctgactatgaggtagcagggaaggggtgtaggctaggaaacaggttgtattctacagtcacactcccccacccctcttctttcctccacccagaatctccaatgtgatcaaaagctgtgttcctcttttctgacatggacacctttgctacctttggtggggttgaagttagtttccaaccagactgctccttatcagtaattccataaagtcgccaagtgaccagtagctttcatctggaggaccactgcagctggttggttgaggctgcttgggagctgtgctgggaaggattctgaggccgtgtgtgggctcagcagcagaaaacaccatgatcagtctgtgaggcttccatggtgcaagagagggattggcagagacctgtcatgtttgctggttcagacctggagggtggaggtgagcggagaaccccagagctggggttctcagtcagaagacagcgtcagagtggtgtgctcatggcgctgtccagggtgctagcccttctggctctcggcttgctggaggccagagaactcttttattggattctgtgcaggacctcctgcctttgcctgccctggtcatcggcctcctgatatgacaagcattgaggcttggtttctgcctctacacattttctgtaaaattttaacccggtgcccagtgctcgtcctggctttcccctcatgcccagcccagctgctgcccatttccaacatgcttgtgtcaagtgagccaaggcagctcagcctatctgctgtttgatgcagcacatccagccctcggagtgcaagtgtggctgctccctcggcatggctggctgtggcctgtcccagtgtcactcctaggtggatacacattgctaatacagccaagacaaacggtgcctctggaacacctcagggcccctcctcccactgactcactgtagcactagctgcagatgagcacaattcaaaagcaaattaagtgtaaagactattctgttctttccaaagtcaaacagaagtggtttggaaatatagcaactttttttcaatgctgatctgcaagtacctttatgtattttacttcattctagccacccaacatccctctgaggtcagattattgctacattttacagatgaggaaaatgaggctcagaaaggttcttcctgactttagtacccatgcatttagccaaggcatcatcctatttctgtaatttggacttactaggctctagcttcctgctcctgtccccagccagtcagagttgatgccaagaaagagggaggtagtttggaaggacatggcatgctctaggctgatgcagtcactttagtgagcatcatacataggctccctcctttgtggggcaaggcctgattcttcctcatttgcccatcagcctccctttaaaccctggaatgtcctgccccaggtagagcctgaggactgggcatttgagccaggagttagaaatcagagcaggaaaagccatgggctccaagacagaatttggcagaagggtgagagaggagttggtatgtatatggtttacaagatgtgctatttggtaaaattccactgaaaatacttgtatgcttgttatgacagtgaaaggaaaaataaaagagaagacgacatttgagagagaaaatttgcaacattaaaataccaaaagtttggatcgaaaagaatggagaactttctgacttgccacttcaaatgctgggatattcatgtgtgtatgcattggcaggggccgaggtgggaggggggtgctagtagctgtatccacaatttccctctagtgaataaatttggatgaaggttgtaattatgatgagctcttagatatcattgactccttcattcaaaaaatattcacggaatccctaccgcatgccaggtattttgctaggcactcattttcagtgaagacacagatgggtggagtaacttggctaatgttgcatgggctggcattggaagttaggccccaggggcccaggggcatctccagggcacggcagtcctttcttggtctctgggctagctcgcagacctgggatgggttgggagctgggattccacagaaacaaaacatcagggctctgtttgagtggccactgtctatttgtgctagtttaaaaattattttttaattgaaagctacacatggttacgatgtatatgtttaattaaaagattaataacctgaagactcatgaacccacaatcagtttgaaaaatatcaaggagcccttgtgtgcttcacctgaccatgtctcccctacagagggacttaaacactctcccgattgtgtgctaacaagwccctcgctttccttgatagtttttttttctttttatgtgtctgaagttttgccaagttgtatctaagcatggaaattttaaatttatgcctcatatatttaaaacactgtacatgtatttcactgttttagaggatcccaagccagtgtcttttttttttttttaacttttattttaggcttagtggtacaagtgcaagtttgttacataggtaaactcatgtcatgggagtttgttgtatacattatttcatcaccaagacagtaagcctagtacccattcgttgtttttcttgatcctctctctcctcctaccctccactctccaccctcccataggccccagtgtgtgttgttgccctctgtgtgtccatgggttctcatcatttagttcccacttataagtgagaacatgctatatttggttttctgttcctgtgttagttggctcaggrtagtggcttgcagctccattccttgatagttttatcatacaagtatgggacccatggttggtttgcgactcatatatgtggaataacacttctgcatgcttctgagattgttttttaattttcactcagcattargtttttgagattgatccgtttgatgcaggtggatgtattaatcatttttattgctgcactgtgtgccctgatttatttatctactttattgtctgtgggcatttgtgttgtttccaggattttgttattaccaaaaatactgataggaacattctcatatttgtcttttggtgtttgtgtgcaagagcttttcagggtctattctgaggagcagaattgctggactcttgggtcagtgcacatttcactttattaggttagaccaaactgttttccaaagcattcctacctattcacactaccatgtgcaatatatgagatttccccaagtcccctaacctcaccaacacttgtcttcttgttacttttargtttctagtgtaaaatgtaattttattttgattttaatgtacattttcttgatgatagatgaggttgggtatcttttcacatctttatgggctatttttattttcttttttgtgaaacacctgtttgtagttgatttttttgcctgtttttaaaatcgagccttttctttttaagtgtggcaatatcttctttaagttaattgtttgtcttagtgaacagaaattctttattgtattgttgtcaaatgtagtcatctttttttatggctagctcttttgcttgtcttgtttaagaagtcctttcctaccygaatgtcagaaagaaattttcctgctgaaacctccctctctatatggagggcagatattgtccacctggctaggtgtccacagctatggcctggccaggctgtgcctgccctcccctgcccctctgcgagcctagcaagcctacctctctcagcatctgtgggctgatattccttccaccctgacactgctccactttgccatgcctttgggccagtcttttccttggtggcaactgaagaaagctcatgcaaattcagtgcagcctatggcaaggtggttaggaagagcttcctggaggaggtgacatttaagcaggtgcttaaataagagtagtttttactttttattaggcaagcaaagggcactgggggctggaggtgacatttaaacaggtgcttaaataggagtagtttttattttttgttaggcaagcaaagggcactgagggctgtasgaagagtgttctaagcagagggaagaacttgcttccctctttccagaggaaaggtctgggggcaatggagaggaggaaaratcatatggctggaatatgggaattggctagggataagactggagagacagtcggaggaggccttagatgctcaggatccccagaaatctctgggagccatatcttgctacctcgggtggcactcttgggtcctgttctttataccccatccagagatttgaagacagacaaaggcaaagccttcatctctagaaggctctggtcctttcactgcgtcctgtctgaagtcattctctgcaaacaaaagggcagaaactgacacattctcaggaatgttgatccgagttaggacaaaccacagtcccagagtctaagctagaggtaggacccgaatttcccagatgacccaggcgtcatgccagcgggtaacagctccaagtccctctagcccttgcttcatgctgggtgccctgaaagagcgtggagctgcccttgctcacatcatcccaatggcaaccccacatggtgggttctgtactcagagaagtaaagggatttgctctaggccatatggctggagagttgggggctggccagctctggttcccaaagggtccacagctctgttcacagcctcttggcaaagctgtggggagcaaacaccgtggtagagtctttgcttgatgtacaaagatttattgtggcatttttgatgacatcagaaattagcaacaacctaaaggtccatcttcagcaaattggttaaatatattatgatatttacatgtaatggaaaactctagttccttatgtactgagtrgaagtagttccaaaacatggtgctgttagctgacaatagagaagtgagaatggtgaygtgggtgttgctttgtgtacaagtgagcttctatgtgtgtgtatctgagtggacacacatggtcactccaaggaaatgctgtttaaggaaaggaaacacagtgggttggactgggatgggagatgaatttttcactgcataacttcttgtactttttgagttttgcatcaagtgcaaaaaataaatgagtaaataaaaaagtaagcatggatcgccattcctctctgcctcctgcttcctgtgcaaggtgacttctctgagcttcagcctcttcatctatagggtaatttctgagctgtaagggcaaaacactagtagagtgcctggcacatggtaagtggtctatatgatcacaacaaaccatgcatggggaccaagagtggtaggaaccaacattcttccctcatggcagtgcgtgtgggcactaggcaaccttggtagaatcttggtgcaagagatttggcagtttgctcctccagtcaggctcaggataacctttgcgtttaatagttaggggcatgggctccagagcagtcttcttgttgaatcccagctccgctgccatatctgtgtgacattgggcaagttactcaacctctctgtgcaacagttttttcatttgtaaaattgcgatacaatactactttctgcctgatggggttaacgtgtggattaaatgagycaatagatgtcaggggcttagctcagtacctggcgcgtggtaactgctcagtaacacttactactctggagctgtgcccagcagtggtcccattgctgtccattcttccttggcttcccaaggcagacctggtgaatcccagtcctggcttgttcagcagcccagaacacagctgtattttggttgtgttcttggtgcttggggaaacagagagagcttgggggtcagctctttcacctgcaggttacacaccttgccctatggaggagctgagctgccaaggcttccccaaggtctccttgcacagtcacaggtggctccgaagagccatcatgccttctaagctggacagcttaactggttttcatagaaaatatctgtcgggatctcacccccagagtcttcctgaagtaaaattccgtggaagaaagggaattatcggggcaaatgttactttaatcaatgccccttgctgacgtctcctttgcggcccctggcaaagcaggccagatgactgaactgccatgctgatctcattaataatacacattggatcattatggcattagtttaaattgaagtaatacatactttttccagacaaaatgagtaagtgagtttaattgctaggaaacctatggaagaagtttgacaataactttacctggatgagtgttttgggttttgttcttcgatctaattacaaagtaactgtactttggggtgtgttaattgcagtgtgccctagaagattaaagtttattaactctgaagttccctcacccctccatcagattccagagtgcgtctggagacatgaggagatgcctgatgcaggcctgcataaaggactggaaagtgaggctatgcygactcccacacatgccccggtgtgctgctgggtcctgctggagttgagggagcaagaacttgtccagatcgtcccccgtttcctcttctcaccacacaccattgtgcccttgcaggaccgatgcgggctcctgttgatatccccctcctgccagacccacactccccagacctcctttgctccacacatgagagggaacaagggagatgttgtgttgttaaatactagaattccaggaagggtaccagcgagatgtggctgcagacttctggaaggaccactagtccagatgggacctcccctcctcctgctccctgtctgctgccttccagctccggctccttgctgctccatgagcgtgcccggcacaacctgctgcagaggctttgggctggctgtttcctctgcctgggacactcttcctgcacgtgcagacgtctgcaagctgcaccttcggggctttgcttcaattccatctgtcccgtggggccttccctttccaatttatttaaaaatggaactctattttctcttggcacctctttctccctttttccattgaatttattcccatttactcatcttttgatgtctgtctttccccaactagttccatgcagacaggcagttttgtttgcttggttgagtgatactggacccacagcatttagarcagcacctaaagcttagtaggtgctcattaaatatttgatgagtgaatgagtgaattgatattttgggggtgtttcattgcccatttattggcccagaagcatttgtttctttccttgagtttaccaattacagcagtaatatatgcttcctatggagtccaagtatgtgcaaaggcaaagcccctccctcctccactttcagtagagcactggcttgttcagcctgctgtgtttctgtctataccttcctccttgtcaagtgtgtagactgcctgtgtatgccaggggtcaggactggaatgtagtttagatgtggccagcccctgagaaagttcttcccatagcttcaagtcaagaatgactacaaaacacatatgaatcacagtgagatggcaatggtgctgctgaggtctggtgggtgagyctggcttgtgttggaagacttagttctcttcctggctttatctttttctaacgtgcttctgggcacactggcaactctttctgatcctttgttttcccactttagtagtggggataataaaaacgcctacagtggagggttcctgtgaggctgaaatgaaatgaaatgaagtgatggatttgagagtgattgcactccctgaggtcccagaccatttctcgtttttcttactcctccgcagtacccaggacaatgctgggtacaaggcctgtgattgagccaagcgctgaacaaactgtgctaggagccctgaagcctagagccccaactctgtcccgggaagcagtgggttttgaattacagctgggagcaagagggcttctgcagatggaggaaacctgtgactaaaatgccagggtgtgaatggcatggcatatttgagagggaggagggatggagggtcagcagcttatgggaaaggatgaaggggtccatggaagggaagctgtgctagcggtctcagaggccaggttgtcgtgtctgtcatagggttttcctcttctgatgtgaggcatgtgctgtgacgtcgaggcttgtcctctgtgtgaactttctcctgtgtagtaaggatgctcaagaacggaagcccgttctctctggttgcattgctctggaatgttaaaaggatgaaattgcctgtatcttgtgtgactagttctggactgcaggaagcctggtggttttgatccaggtggcagctgcctgccccgtattttctgtggaaggctctgggagtggtgacaaggccacttagaaccaaaaggtgggggtcacgcccagacacagccatgtgggtaacattatgtctcctctcagcccttcacgtacccagttccttgctggaagttatcctcttacccacctgatggcgtggtcgccgcgggggcttgtttgctgccaacccccagccagggtaggaggctgcacatgaacctggcacgctgcctctgatttttggtttgattgtttcaggttgcattgtctgcctgtttgcttatttgtttatttccttcacacatccagagagaatttgcagaggcttctaatgtcttcttagagagacactgaggttaagaaagcaactgcattagaaaatcaagaggtgccaaggacggctgtggtcatgctattctggcagccacaggttacagggtgggaggaagcagagggaccaggcccccctcagcactgcaaagaatcctccctgagggacctgatctctacaggagaccatgaaggacagaatggatggcaattccagctcaacctttacagcaaatgtagaagtgggttttgcttggctgtttctcagtcaagcacagtcgctgactgtgcagtgtggccctctcatggctcagctgatcccaagctggaacttaccattcctggaagggtagggataggacttgcctctgcctaagcttcctctgggccagacttgaagcgggtcatagcaagggttgtgcgttctggcactccttgctgcccacggagtgaggcttcatgtgtccattcagtttagttctgttggacaaatgtccaccaaaggcctttgcagtcccaggtgctgggtggggctcaggaggagagcaaggcaggcatggtccctgccctgacaggaactgctgtaagtgggacaaggggtgtgaggggggctgtgcagtgctcaccatagagccgtagcagagctgggggaggccttcataagcattggtggccgagtgcagtcctgttggggtgaggagggctgagcagagaccagcccaatgtgaggggttccagcagggcagaggggctgccttgtgttctaaggggagtgggaagatgtggaaggggagaccaccctgctttgggatttttgctttgaaattatttgtatcatatacataagtcatacacaaaatgaatatactcttgttgaaaaaattaaaacaacatacacatttaaaacacaaagcaagcacccattaggcacgtgttctccctctcccacctatctgccttcctctcttgaggtgagtaaaggccttgcctggacatgccacatgtgcacacagatacagtgctttgcagacgcagaaggggaaccatgccccgggcattgtttggtgacatgcttttacttgatgggctttgcagcttttgctccatattgcccacttggttctaccccattctttttgcctgttgcacaacattctgcagagtgggctttattcctccatgtcttgattcaggtggcttctagttcttggccgtcacacagggctgtagtgcgcagccgtggatacatcctcatgcatgtatctctaagtacttctaggggttggattgctagaaagcagagcggctgggctgcaggagattctgttttcaaattaggaagctagaatacagtgatgagatgccagttaccaaaataaggcagagaaaggagaagtgttctggaggagaacagaccttgttctggcccctgttgtttccattcttgggtgccatcttgctgagaagtgtgattgggcagaaagtcagggacaaaatccaaaatcagagaaccagataaaatgcagcaagggcccacttaggtcggcagcagctcttgtgagaagcgatttgaggattgaattatctgcagcttggtgggagtgagcggtagtgggagtgagcagtggaagggagggagggaggtggtgagggctgggtggtccctttggtgtatcctgcactgagggacatgcctctctggtggaatggagacaagctggcaggaattcagaaaggagggattctgaggtctctgacaggcctggagctgggggatgggctgatgtgagctgaggggtcccaggaatgggactaatgaggaaatggtgcagagaatagggtgcagtatgtcaaggaactttccaactgtcagagttgacctgagctggaaggggctgcctctgtcccccagggacccaccctgggtactatggcaggaaggttcttagctctggtgtgcccacaagcccctggatgattggccatcatgagatagaggttctccctagagaccctggcatggtttcctcaggcctagaggcccaccaaaggccacgtggttgagctttgctaatggatcataaagagaataacgtgccttgcgttgcttctcctaaaggaagggaatcaaacattcactgtgtagttactctgtgccaggcacacaaccacagttcctgtattggtctttatagtaactcaacaaggtaggcatctgccaccaggtcacataaggagcaggctggggggaccccagctgcaggtggcgattcagatctcaagccctcactctcctgactgcaccccaaccaccctgagctacaggtgagtgcgttctggataccatgccctgggaatgaggagagagtggagggtgcaggtagggtgagctcctgaggccccaagttaggagatgctgaggctggatggggctaagggaactgggaggcattttttcattgcctcaccttctcttctgtcttccttgcttcccatcctcccgggctctcctgagacacacgctctggcctctcacacattctgtttgcagagggacccacacacagtggagccttaggcctgggactcaggctctgggaggctgcatcctcactgtggggcctttaaggattttgttgctggagacccctgtggttctgtggaatcaccacatatatcggtgtgaacatcacctgttggccctggtcctgtgtgctggattctacctgtgctctgggaagttcctactttacttttgtagttttttgttttattgtggaaaaatatatatacaacacaaaatttaccatgttaaccattttcacgcacagttcaatggtgttaagtacagtcatattgcagtcactaccgttcatctccagaaggttctcatcttcccaaaccgaaactctgtactcattcaacaaagacccccatctcccccctcccttcagccctcagcacccactgttctccttcctgtctcttgactttgactattctaggggcctcatataagtggactcgtaccgtatttgttccttgagactggcttatttcacttagcatagtgctttctactttcctccacactgtggcatgcatcagaacgtccttcctttttcaggctgagtaatattccattgtgtggatagacagaattttattgacctattcatccatcgatggacacttaagggttgcttctacctttggtccacttggctttctgagggtgttgggagaggaatgtcgtctcttggagcctccatgtgtgtgtgtgtgcgcaggtgtctgtgggtgtgtgttgctgcaatgggattgtatgtgtttgtgtgtggtgggcatttttgtgccacactgtttggaagacatccattcatccttcattctgccaccaaagtcaccttccttaactcactgccctgcttagacccctgaatgtctccccytctccttaaggatcaagttcagatcccttctcgcagtgcacagggcctccaaggtctgtctctccctggcctttctctcatcactccctcaagacctcygtgtcccagcgacgcaggatggatcagcaggggtgccatcaggaacacatggcccactccaggtcattcagaggaggggatttaacatgaggaactactgacaagtgytggcagagttgaggacaggtggagtggaagcagcccagactaacaactgggcagggctggagtgactcccagggctcgagggatgaatgggagagatggtcctggagccatgactgtccagtgggtactgggacctcatagaggggccaccctgagggaactgggagcatgtgggagacccaaccatggccagagacactggaagcagagagagggtgaaatacctggcttcctcctcctcctgtgcctgagtctcctgaccatgcttctcagtggtcagtggtaatcagcaggatagggagtctgggaaggggaggggtgggcactctagagggaagaacaggggagggtgggggatggatgtgactgcaatctgcactccccaccacacccagggactcaccttcctgaatgtgtcccagtcacaccccaccatcccacatggctccccgacctggaccagccacctcactgcctgaaagctattcctccatcctcaagacttatttgagcgtctccttgttttggaagtttcctctcttctccttgttcccctgccaggtgggctgtcccttctctgggttccacagatgccctctgtgcatctcaccccaggttactgggccataattactgacttccttttctccctccctctggacagtaagctcctccagggtgaaaagcctgctttacctgactttgagtctgtggcatcaaatgcatgtaacaggcctgagcagatgcttattgtgcgattcagcaactaggttagaggtgacagaaataaaaagcccagagatctggagctctctttctcacacacacaatatgtgcatgtgtgttcacacaggcacatgcatttgagcacacacagatgcacatgtgcatgcaggtacacactcatgcatgcatgcacgtacacactcatgcatgcatgcacgactatgcacacatgtgcacatagacacatgcatgtgaacacccacacatctgaagtgcctgtagtcattaaagttagaggtgcagatgaatgtggtctgaggctagctatgaatcttactaacagtcaccaagaaagatcaatacattaactcttttcttctaagttggcatgaggtttcactggagggcctcggcagctcaaggtgaagttcttcctgaggccttccttctagcctggcttgtgcagggaagggagagccaggtgagctccaggggccctgcacacctgcaggatggggatgggcatgtcaggggtgcctttggttcatctgggacctaaccaggtcttggctactgccactgcagtcagaggacctggctacagagccaggctgtagccatggggcactgcccagcccctccctgacaccagcacagccaggcttcatgggcccccacacctgttgtggggcccaggggcagcaaagggaggaggtatgtggggtgcactggagcctgtgcacaggggctcgtgtgagccactgggccacctcttcccaactctgtgtttggtcacagcacttcagtgactagaaatcagtcccggtgggaatatttacttcatggaggccagtaagtgccacatgtcagagcttcttattctggagggccggttaggatcacaccatgtgtcccactcacatagtgtttgtgacctgcttgggggtgggcgactagatggtgacacagaggatattcaaggtaacggtgtgttttgaagggaaggcaggagcctggggccgagtcacggaaggcatgcggtggacttgcactgggttttggaaggcagggagggcttgggcagagggagacagaggtcccaggaggtaacagcctgagcacagagaagcacgagggtcagagagtggggtgttagcaaggagggttaggtgagttttcaggcaaaagagaagggcctggaaagccatgttaggagttgacctttgtccttgcagggcaggggttcttagtgggcacaagagcctcctcccacctctggccccggggacatttggcagcgtctggggacatttgtgtttctctgtcataacaggggatagggaggagtactagtggcctcagtgggtagaggccagggatgctgataaacatcgcacagcacccgcttaagacagcccctgacagtaaagaactttctggcctcaagtgtcaatagtaggtaacagggcataggtaatagggagctatkgcaggttcatggtcagggatctataaagttgtgtttttagtgcagtttgtggaatagagtggaaatgtgtgcatgtgatgtgtgtgtgtgtgcrtgtgtgtgtgtgtgtagagggtagggatgstggggaaaaggagaccacaggcaggggagtaatgaggaggctgtgtcaggacttctgggatggtgatgagggcttactgggggtggtagcagtgagaccacagcatagaagacacatggggccactttgtagcaggaagtgacgggagttggaagccgactagttaggccaggtggagtgggaaggttgacatcagaagttccccaaaggtcccatcactagcctaggaggccaggggttccatcataccaaagaacacgagagagttgaaaggaatgacagtgagtctggtttgagtcctggattccagggtcacataatatctgagctgcagacatgacccccacttttagagaaggggagtagagctttgaaagtgccagcaggtgcctgtgggtgttgagatgcaggaaaccagagggaagtggctttggatggtggaaaatgggtgtttcacaaatctgcctgcttcttcactggtgtggatcaggagagccctgggcctggcggagtggggcttcagccacagatctccctgtgtcagacacttggttcccgctgtggctccttgtggttagaattccagaactgggctcaacttatgctctgccacttgtctagttggaccactctgaccttctttgcatcttcatctatcaagcagagataacactggcaccatccccatagcttagatagtggattaaatgggattactgatgtgcctagcacatttggggttctgttttggttattctttaataggggatgttggcagtggtgggtgatggatgatgagaagaatagatatgtgtcctgtagccccagggcagccctgccaacctgctcaggccccgagagagagggaggtgctgtaaatgcttgtccccacccctcccagccctctggcattcttcctgtatgccttgggcacagaggcttctctattcctcagggagtgggtcttggcaaaggaacctgtttctaggcttagacagcgggctggcagggggatggggtagcttggcagaatggaaggtrtggacaggacaggcctagcaagggctgctctcctggtgggctgcagctcccattttccctctggcctggtttgttggggaatgagctggtccctgaagggagcagagcctgagcccttgttggcatggggatggcatcagcatagctgaacgggcattctagccatgcagggactcagccttgtgctaggggaaaagtggggtttagatctatgcagcttttctgcttattttctaggcacctttgaattaacttatctttccatctgtgcaatgaagaactagtgcccaacttgctgcagtccatgtaggagccatacacgctcacgcctctattcacttcaccatgtgtgtcactcatcagtactaactgaggatctgcgctataaggggctgcagaggatggacagggcagggcagggcaaaggcctggagtcctcctggagtcttcacccagcccttccatcacccaccaatgggcttttggtgggtctcttccttcaagacttatttcccttccatcaattaggacagggctgggggtggtccctgtgactctgacatctctagttgtgtgtcttatgtagcaactgtgaagttaaagctccttaggagatgggtggtgggaacttctccttgaattattcctcccatgtagctgccttatggaaatgagccgataatggccaattccatgtgcaaatcagctctgggctcagctcagcctgagcaggcgtgatgcctcttgcactataaatacctcccctggaactagcgcagccccaagagtagccccagtgcttctcagcttgcacagatgccaagaacattacctgttcttcctggggctccccagcctctggctgctcctgggaatctcacatttcctggtctcgttcagtgctgggtcccttagggatattcgttaattctcataaaaccctgggaggatagtgtaattagcagcactggatgatgatttagcactcagactctggtgcagactgtctgagttcaaatcctgcctccagcctttctaggtagcatgaacttgggtgagrtactcaatgtctccatgtctcaggttgcctgtaggcgtctacatcatagccttcttgtaaggtatagagagctggcaccagaataacactcagtgcctgtctcatagaaagtgcttatcagatgcttgatattattatcaacccaattttaccaatgaggaaatggagactcagggaggtgaagtaatttttctgaggtcgcagagacagcaagtggcaaaagaggtctgagccccgccccgcccccaatgaccatacttttcctaccacaacccacctggatctctgtcctctggggatggtcaaatgataaggtaaaagctaaaagggatttggggctgcctttccttggctcttctctgggatgtccaccaaggcactgagtgtcatagaaaacctggtttccccagcttaaacctctaaagctagtccagaggaacagttgcttctgcctgggagttagtstctctacctcagtttgcttctctctaaatgaatagatcagatctgctggactctcttgtggctgcattgatctctgtgttttgtggctatggtgtgcttcttatgtgctctggggttgtcacccaaggaagtgatgaagtggttgcttgtcatggggacaggaaagaagaagcatttgaataatcactgcatgccagcattgagtttagtgtttaaaaaaaactggccccatggagttttcgtaacacctctgtaagttaggtacttttggccccattttccagatgggaaaactgaggttcaggcaggctattgaacttgattaaggtcacccatcaagaaagacaaacactggtggctatgaagcttgaagccccattgtcccttagagaagcagaaagtcctcaaattacttgagcttccacctaggaagctaggaaaaaagagcaaatcaaatccaatataagtaaaagaaagaataaatgaagattagagtggaaaatgatgaagtggaaatcagaaaaacagtagagaaaataaatgaaacaaaaagtggtttttcatgaagataaaattgataaacctctgaacagactgactgggaaaacacaagagagaagacacaaattaccaacttcagaaatgagaaaggtgacatcactatagatgtgagaggcattaaacaatcataagggaatgttttgaaaaaccttatgccaacacatttgacaactaagctgaaatagacaaattccttgaaagacacaaattactaaagcatactccagaagaaacagaaagcctgaatggtcatatactgattaaagaaattgaatttctagtttaaaaacctcagagaaagaaaactccagacgcagatagcttcactgttaattctgccaaatatttaagagagaaatattaccaatttatgccaatttatccagaaaactgaagagaatacttccaaacttatactattagatcagtgttatcctggtactaaaactgaccaaaacgtgacaagcaaattaaactgatgtccttcataagaacttcaacaaaagattagtaacaatatataaacagaatacttcattgtgagcaagcagggcctagtccagtaatacaaggctgatttaacattcaaaaatcaagtgacgtaattcaccattattatagacttaaaaagaaaacacgtatgattatgttgtagcatttgatgaaatccaacattcagttatgttaaaactctcagcaaactggggatataaggtaactttcttaacttcataaagggaatttataaacaatccatgaggaacatcatacttaatagtgaaagactatatgcttgtcccttaagatcaggagcaagacaggatatttactctcactgtatctattcagtgctgtagctgaggttttagccagaaaattaggcaagaaaaagaaacaaagatgcccagattggaaagaaaaaaatgaaaactttaaatttactgattatatgatcatccatgtgcaaaatttagtgggatctacagaaaaatactagaattaacaagtgagtttagcaacattgcagtctaaaaaatatacaaaaatccattgtatctacatactagcaatgaacaattgaaatcaaaataaagaagaatactatttacaatagcatacaaaatgggaattatttagggataaatctgacaaaaatcagcaagatctgtacactgaaaactacaaaacactgctgagaaaaattgaagaagatcaagataaatggagagacatactgtgttcatggattggaagactcattactgttaaaaatattagttctccccaaattaatctatagattcaatgtaatcccaatagaaatctcagcatgcttcttctttttggtagaaattgctaattgtaaaatttgtatggaaatgtaaagtacctagaatggtcaaaacaactttgaaaaggaagaataaacttggaggactaacacaacatgacttcaatttcgatttcactacatgactacaagatttcaattgtccattgctagtttatagatacaatggatttttgtatattgatgtttctatactgcagtgtttctaaactcacttggtaatgctagtagcttttttgtagattccattgagttttgtacatagatcatcatatgatcagtaaactaaaagttttagtttttcaaagttatagcttcaaaacattaaaaagctacaataatcaatacagtgtgtttttgtgtgaacatagagagatagatcactggaagaggagagacaatccaaaaatggacccccacttatatggacaaatgatttcaacagggttgcaaaggcaattcagtgaagaaagaataaatagtcttttaaacaaatggtgctggaacaattaactttctgtatgcaaaaaaaaaaaaaaaaagaaaaaagaaatatactrcaatcaccttgcctgtatgtaaaaataagtcaaaatactttacagacacaagaataaaccttaaaaatataaaactactaggagaaaacacagtggaaaatcattgtgaccctaggttaggcaaagatttcttagatgtaacagtaaaagcacaatccataaaataaaaaaattkatcagccagattttattaaaattaagaacttgcactctttgaaagattctgtgaagaggataaaaagccaaaactgaggagaaatatttatgaatcacatagctgataaagaaatcatgtatagagtataaaaactcttaaaactcagtaataataaacagcacagtgagaattgggcaaaatatttgaatagacactttaccaaagaggatacgtggatgacaagcacatggagaaatgctaattattgattaggaaaatgcaagttaaagccacagaacatgctatttcatagcagtgattagaatggctaaaattaaagatgattgactataccaagcatcaggaagtttatgaggcaactggaattctcatttactgctgctgggaataatgtaaaatgcactaccagtttgrcaaactgtttggcggtttcttaaaaagctaaacatacacctatcatatcagtcattctactcccaggtatttacytgaaagaaatgaaggcacaagtccacatgaagatttcagtagcagcttaattcataatagccccaaactgaaaacaaccaaaatgtccattggcaagtgaatgaattaaaacattttgggctgggcgtggtggctcacgcctgtaatcccagcactttgggaggctgaggcaggtggatcacttgaggtcaggagtttgagaccagcctgaccaacatgatgaaaccctgtctctactaaaaagacaaaatcagcggggtatggtggcgcatgcctgtaatcctagctacttgggaggctgaggcagatgaatcgcttgaatctgggaggcagtggatgcagtgagctgagatcatgccattgcacttcggcctgggcaacaagagtgaaactctatctcaataaataaataaataaataaataaataatwgtggtatatttatatgataaaatactactcagcaataaaatggaatcaattattggtacaagcaacaacatggatgaatttcaaaataattaggctgggtgaaaaaagacaaaaagagtatatactatgtgattacatttatacaaaactagaacatagaaactaatctacagtgacasattgcagatcagtggttgcctggggactggggtgggggatagggaaagaaagaccgcaaagaagcacaagaaaatttggggagtatgttcagtatcctgattgtgtgatgcatgtgtcaaaaatgcattaaaaatttacattttaatacatgcagtttattgtatgttgcacattattacctcaataaagctgttgaacaaattccgttgccttttcctgataccatgctgcccgtcacaggggttctttgtccatgccaaagaaaccatcactcctgaattcattcaaataatcgcatatcccttatggtctgcaaagacttgttagtttgagaatccatctgtgtaacatctaccacataagcaagcggtgctgacttgctggaattcctgtcacacacgagagagaaagggtggagcagtcaggattatattatagcagggacccgaaatgcaatgagcagtttcaacgaatagtccttgaaatgtatgacaaaggaagctaagtgcattgcaatctagaagctgacatcacagtttttatctccatgttataattttcttcctttatcaccagtctgcattaaggtttattagtacatctctggcctgctcagaagccatcaggtggggacagattagtgtgtcggttatggaacagtggtaggcagaagccgatcagatgaactcagacagcacggtaattagcatgcccgagacaccaggctgccgtgctggggcggccttggccagtctcactgtggagcagtttgttcctttccacaaagaaattcattagtggcgatcaatggcatgcagtgtggaggctcccccactgatgcctggagtctccrtggcccggagtcgccccctgcttggggccgggagagaggtatccatgccagctctctggctgctcaccagggccactgggcagcccctcagggttaggctacggggaagcacccgcagaccctggaattctgcatgcagccatggtctcaccccatagtctcaatggaagggcgagcacacagctctaaggctgtctgcacccacggagactgatgtggaattgatgcaggggtcgagtgcggagtctgaagtcattaagctcttaaagaagcccacttcactttttgttgtttgctccatgccagcaaattctaagtactgcaacactaagttgtaaattcatgtattcgtccaatgagtatttattgtgtaccttttgcatgctaggttctggggattcatggagaatgagggggtcaacgttcctgccctcatkgagctatagcctggcataggagacagagaataaataactaagaaagccaacaagataagtaccactgagtaattaagaaaacttgttattatgtaatgtcctggatacaacatgactctcttaatcagaggttcttcccctgggctcatagaccccataagctccttgaaatagttatggaaaagtatgtgtgtgtctgtgtttctgtttttttctctagggaaagtccatacttttcaccatatgcctaaagtgtctatacttcaaggaagggtggacagatgactctagttcacccctcaggtgtccatgggcacaggcattctttcctaatcctttcctggacccactgtgactgtctcctccttgtttctctaaatcactcccagagaagtctgttcccatgtactagcggggctgggagctgttgcttccctctctgggttcatgttagtgtccactggaagaggcaacctacctgcattcaatcagcattgctctgcacctctgagaacaagcactccatttcccaggggagagccaggtcctgggggccacagcttcaggggcagctggatgggagaccatgcagccctgcaccgccagcctgatctcctggatttgtaargtgatggttgcagtgggaggccttgggtgggtgcagctaaccaagttcacctgtggggataagagtgaaggtttgtaagcaaataccagggaacgtgccctgctcctggcacctgtactgggggttgctctgcacacctgcatggttgggggtgtgtgtggcttgtacagcctcgtggctgtatcctgcccaagcactgtgtgttcgggggaggttcagcctgggcttggctgtcctcatggccagcatccaagcgaggaccctcacttgcctgccctggtcctcagcaccatctctgcccctccaggttagccttccctgagcccagagcttgccagttcccttacagagcctttggcctctctggtctggcactggtctccccaagtcctatttcaggagggggctacagggatcttattgccatttgtgtcacagtctctgaggatgttcacagcccagttcccgggcctggccgcaggtggtggagcaggccctccctctgtccagccctgctcctgtgagctgcaggcagcgccttgttcctgcctgcagctcacatggagagggagccttttgtggagcagcttttggcatatgtcgggaagcctaggaagtgggtgcacttgggttttgttctttaaagctcctgggtgctcaggcctctgcccagcccagcttgggacagggagcacatggagctggcaaccttggtccttcaaagcatcattgcccctgacctcaggacctgtcctctgctcagcagaccaccagttttaattatggttaggacgtggtcagtatggggcactctgaggacaacctctgaggtcctagagtcacttttcttacagagtatcatataggactgtcacacctgcycaagcatggccctgggcagctgttcgatcactctgggcctctatgccatttgtcggtaaaatgaggggctcctgcctgtggcatggaggagaggagttgctgagccaatcactgcgggccccaggcatggtrcccacccctggtgttctctagtgtccttctggtgcaccagccggagccttctgctcacaagctagctggcggccacctctcctgcacctctccaccactccaccactgggctggcctccctttgtccagcctgctcctgctccgccctgcccactggctcccagactcttgacttggcytctgccataggttgatggagctctggtttctttgtggtgcctcaggcctctgcaagggattcagacccttctgcgtctttctggactcattctttggctccctcccgcccatgtgcagcatgggattcagactgaggtgtgtgtgtaataaatgtgggcctcctcttctctccactttacgggggaagatgggcttcctcatgaccctctggaggatgccctggggaggatcatgttgtggtggtgtttcattgttagacctccctggattgaagtagctgaaatcctagccgacgtttatgtgtatttagacatgatgcactggtttgggctaggagagtcattgtgattgattggctgtggccctgaggttcgtacagatgttcccatagagggtaggacactgtcccgtggccagttggagcagtgactggggacccagggagcagaaggggacttgaggccccacaaactgtcagagaaaatgaaatgcagttctctgtggctttccacttgcaaattgtgtgaccttggacaagtaagtagaactgtctgagccatagtttccgtccttgaaagctgggatggaagtgactccctgctggggtcgtggaggaccagaggaggtcacctcagtgaagctgcctggcacgccatcggggagagcctcagagaaatttgaatgagtaaatgtctggctgatcccaggagagcaaggagaaagatggagggaggggaagagggaggagggctgcagtccggggctggggcatgggtgggggctgctgtgagacaagcctggccagtctggctttgtgagctggtggcaggaagaggaaggtagctgggcttgctttgggaatgtgtgtgctgtgggccccagtggaggcccgggaacttagcctgtgtactgtcttggggggatttctcccttctgggtggggattgggtctggagcctggaaacacctttggtctgatgacctaagccccaggcattccatyccatccttggctcaggctaggctgggacctgggatggctccagtcccagctctcctattagccccaggagtgtgcagctggggcaaggcctgagggtaaaccagaccctccagcctctgcaatgcctgcccaaggtcaaggctcttggctcaaagcgacagagaaaattctccccatcaggaaacactctaaggcttccctggacatggcactggctttgagggtctctgggctaaatggtctcactccgaatcaagcagggaggcyggggagaaaccatgggttcagggaggggagtgaaatcagagcctctcaaaggcagaaagggccaggaggcctggaggtggctcccagggtctgatgcatggaaatgaggagtcgcttagtttaaggagaccgtagttctctgtgtgtagaacgccccggggtggatgcacgagccgcctgctggtcatctggaggtggcgcatgggctctcttgtgcctgtcccctgtggcagaggcccttcctgggcctaacaccctcatgaaatggcctatgagcttgaacctgggcctgaatgtcctcactaataacccagcaccgtttgccaaaaatcaggccaggttgcctctggagagcctgttaactgagtgacttgctgtcacccagccttgcttcttctccccctgtcctccctccactgctcccgcttttgtgtgcaaataggcaggcaggggaaggtttggggctgtgtccaaaagaagggcacgatggatataaaacgtaagaaaaaaaatgctcaataatttggtcatctggaaaatcagccagaggtcatttgggagacaagtgattttgtgacctggtttctggtgagttggccactaggagaactgctcactcgaagattttgtcacttggggaactgactttggagatttggtttttgtggagtggagctgatttctgaagtgaaatctcagcacagaggtttacaggaagccagagtcctcctcacttgaaaactcacacctcacccctggtgcccctcaaggctgtgtctcggctttgtccccacggaggggagcatagtatgttcttcacggtggtggactgggatctctttgtctcactgtctctccgtctcttttacacacatactggagcctttgtttctgtctctttcatgcacacacacacacatacactgaagtctctgtctgtctcgtgcacacacgcrtgcatacgctaaagtctctatttctgtttctctgtaatgcatgcacacacaggcacacacacgcacgcacacactgtctcgctcatgcacatatacacacactggaatctctctctgcctctgtctctttctctcatacacaccaaatggatctctgtctctcacacacacatgcatacacatgctaaagtctctttctctgtgtcatgcatgtgcacacacacactgtctctgtctcatgcacatacacacatactggaatctgtctgtttttctcatgcatgcacacacacaccaaaatctctgtctctctcatgcacacatgcatgcacacgctaaagcttctgtctctctctctgtaatgcatgcacccacccccccatacacagtctctgtctctcatgcacatatgcacacactgggatctctctctgtctctctctctctctctcctgcctgaagcctccagagaagtaagttgaatgttgagcagggttttcccacggggtggctcagaagcagccgtaattggagggagtagggaaaagacaatgcactgtaattggtctaaataacccttttcgctgagtgttaaaggcaagtaagttctcaggagcagacctggctttttcctccctaggattttcttgctgtttggaagtgcttgttcctggagggtgtgttcatctctctcgggggaggtcgggatcctgggtgctgttggggtttgctgctgtagggggtgggggcgaagggcaccagacagtgatacggtggaaactgtaccgtgcatgcctggggctgtctcacagatgctgaatctgaactcaccatttctcctccagatctggtctacttttgtcttggctggtgacatcactgccactggatgatgtttcttacttttgccacggccactgagaaagctgacaccttttcacagctttcagtgattgaacactgaccttttcaagcatccttgcatctactcctccatctgcaccattacagtccctcatcatttcttacctagactggcacaatagcgacctatcaaggctttctgtcaccaatgtcttctttctctaattcaccccattggtcaccagaggagacttgggaatatgagtctgattagtcagatccaagcttgaaaaccttcagtagctcttcattgcctcagggtcaagttcaagctttgcagcttcatatccaggaccctttcccacctggcccctcccttcttttgcacgatcatctcctcgtcttctcactcatttgcctttggtctccggcagtgctgaactgctttagctctcagcgcatgcacaggctgctccttgcttatgcctccattttttcaggcctcagtgcctttgcacatgctgatcttcctgcctggaaatgcctttctttcacytcgtgccatgatgaatataataaggccaagttccccattcttttaggtaacattagatacactctccttgtgctatttctgttctttttttgatgacaactatcatgctccaacactgtgctattattcatttgcttccatatcctactctcctcctccttcagccccagaacgtggtgttcaaagacaggaaatacgctttgttcacctctgtatccccagcatctagcccagaactcagcccaacagctgattctggctgggcgcagcagctgacgcctgtaatgccagccctttgggaggctgaggcaggcggatcacaatttcaggggttcgagaccagcctggccaacatggtgaaaccccgtctctactaaaaacacaaaaattaggccgggtgtggtggctcacgcctgtaatcccagcactttgggaggccgaggcaggcagatcacctgaagccggcagttcgagaccagcctgaccaacatggagaaaccccgtctctaccaaaaatacaaaattagccaggcatggtggcgcatgcctgtaatctcagctactcaggaggttgaggcaggagaatcgcttgaacccgggaggcggagattgcagtgtgcagagattgcgccattgcactccagcctgggcaacaagagtgaaactctgtctcaaaaaaaaaaaaatagtgactcattccccctaagtgaattcattccacaaacatttaccaaacactcccctgtgccaggcacagctctgggcactggaggtgcattggtgtgagtgtcaaccaccgggttaacagcggaaaggtccgtgatgtccttgacaagagccgttgcagtggggcagtgggcagatggggtgggttcgagagatggcaggaagagaggaagtggagccagctggctaggtcatatggaattctctttgtcaaagggtatggaggcatggtggccattgaaggagggatcatggtatcaagagggagatgtttttataaagacagagggtaacttaggccaccactttcttggagtctttttttttttttttgctttattgagggcaaagaggtagaggaaatggccttttgggagtaagtgagtgagaaaggggagagagaaatacacagagaataaccagatccacaagttgagacagtctatctgcggctactccctgtacccatccctatagctattgctgtatctatatctaaacacatatacttcccctgccacgcatattcacacacatctttatagaactttcaatgatttccaaagatcctgtggaatactggtgtgctgccttgtggggagaaaagaagactgagctagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccactgatggtgagcattttttcatgtgttttttggctgcataaatgtcttcttttgagaagtgtctgttgatgtccttcacccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcctatttgtcaattttggcttttgttgccattgcttttggtgtttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagctgcagatatgtggcgttatttctgagggctctgttctgttccattgatctatatctctgttttggtaccagtaccatgctgttttcgtgactgtagccttgtagtatagtttgaagtcaggtagcgtgatgcctccagctttgttcttttggcttaggattgacttggcgatgcaggctcttttttgaaagtcaatgtggcgattcctcagggatctagaactagaaataccatttgacccagccatcccattactgggtatatacccaaaggactataagtcatgctgctataaagacacatgcacacgtatgtctattgtggcactattcacaatagcaaagacttggaaccaacccagaagtccaacaatgattgactagattaagaaaatgtggcacatatacaccatggaatactatgcagccaaaaaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacattctggggactgtggtggggtggggggagggggaagggatagctttaggagatacacttaatgctaaatgacgagttaatgggtgcagcacaccagcatggcacatgtatacatatgtaactaacctgcacattgtgcacatgtaccctaaaacttaaagtataataataataaaataaaataaaaaaaaagaaaagaagactgaggaggaaagtttagactaaaagtgatttaagagatgtatcaaacaattggctatatgtatagactttgtcaggattctgatttgaaaaaattataaaaaaaaatgtgtgtgaccatgggaagatgtgaatactggctggatattggaagatagtaagggtttgtttactttttgtaggtatgcttatggcattgcatttagaaaaaattcttgtcaggccaggtgcagtggcttatgcctgtcatcccagtactttggaaggccgaggcaggaggatcacttgaggccaggaatttgagaccagcctgggcaacatagcaagaccctgtgtctacaaaaaacaataaaaattagccaagcatggtggcacacacctgtagtcccagctacttggtaggctgaagtgggaggattgcttgagtccaggagatcaaggctgtagtgagacgtgattgggccactgcactccagcctgggtgacagatattctgtctrttaaaaacaaaataaaacaaaaacaggaaaaatccttgtcttttggagacacaattgaaatgtatacatgtgaaagatgtgatgctggagattttcttcaacttaatttgagggtgggtgaggtgtaggtggtaacaactgaagttgggtaagacatacacaaggcccactacccttttttccaatgtttgaaatttttttataataacaagtaaaataaaatcatataatagcatttttttcttagttatacaggaatcttgtgtgctttttattttaggttttacggccttaacttttctggaatattaggtgctgttatcacttgccggctagagagaggagcagatggcaggatggatggataagtaatgagcaaatattaatgagaacaggaaactatcaatcgagtttcctggacagattgcttttatccctggatacttctgcaaaattacatgcatataatatagtcatattattttttgctagaaaatgattcataccatgggattaagtagggcagtactttgcggtgggagggaggtttatagaggcttaagtgtgggctctggaggcagactgcctagcattgcactcagtaatcctctgacctggggcagtaactccctatctgcaaaatgatgataaagtaggtgtatgcatgaatatgtacctgatgtatactcacacaatggagtattatttggccacaaaaagtaatgaagtactgatgagtgctagggtagcgatgaaccttgaaaacattatgccaagtgaaagaagctagccactaaagaccacatattgtatgattccacttatatgcaatgtccaggatagctgaatccatagacacagaaagtggctgccaggggctagggtgggatgggggtaggggagtgtagagagtaattgctgatggtaatgaggttccttttttgagttgatgggaaagttctgaaattagattgtagtggtggttgcaagagtctgaatataataagccattcaattgtacacttaagacaggtgaattttttggcatgtaaattatatctcaataaagctgcttgaaaaaaatataccamccacatcacagagttaaggattaaatgaaaaactgtgtgtaacgtatttcctggcatgccgcgtagggtttctaactccaggtgcttcgctgaaatctttagggaagagcgtgttcctccggcgtttgctttctgaaatgcttgatatgaatcatgctatgaagactctggaagtgagtggtttaggtagaattactatttcaagtttctaatgaccacatactggtctggaattaaaaggcttctaaatggccctaaagtagattattcatattgctccaactttttggtctttaaaaccatctgtctttgaagcttggaaatcttttagacagtctacagtgtggcatttccttgcacagcccccaccctacctgcctctgcagaacctcctcttttcccatgggacttatgtgaacgcctgagccctgctgacatcttcaccctctgggtccccacctcggttaatagagataaagccagttagtagctaatctaatggactcatgatgtcctagtttatctctctttcttcaatacctccttaattgcctaaaatgttatgggagagacacagagctagctgacccacagaactggtggggttggccttgcacttggggattttcttcctttccaactttcaggcttgcrtaccaaatccctgggctggaggcagaaacgcttctattgycccaggtcccttccctagtggttctcttgagcttgagaaggatgagaaccatccctttaatttaagctcttgctgccctggcaggtccaaagcatgcttttcatagtggctgcaccttgggatcccttgggaagtttcgaaaaatacaggtgccttagtcctgcttctagacgctctgatgtaactggtatagggtagagagtattaaaactttccaggtgattctagtatgccttgaagtctgagaaccactgcctcagaaggaagtcacgctgaacgggtggtggcggtctgaaggcagggaaaagcagaagtgcttaatgagttgggggaggaagcgtggggggtaaacgtttttcttgacttgagtgtagaggagaacctgtgagtaaacatgctattttaaatgggttggcatttggctgaaaatagacaggaagcacggatccagaaatccattcagcttttagaacgtgaccccaaatagcttcactcctgctctgacacatccccaagaaggactcttcctcctttgtcagccaaacatgttagcagttgtcttctggcacttggagtgcatgcgcacgtgtgtgtgtgtatgtgtgtgggtgtgtttgtgtgtgtaggagagagacaatagaaaggttgtgcatagccatggcaggctctctgcaatgcttctttgtggttcactggtcccttggggagcaaagtggggaccctcctaaagatgggcaggcccagcagggagaagagcaggtccattcattaaagaacagggcattgccctctcctgggggagctcacatttgtgatggggcctatggagggcaggcactgtgctagggccattatctcctgtaggcctcaaacgacaatcctatgagaagctctactttaccggggagtcaactgaggcttgtggtgcatccaaggacatacagatggtgggcgacagggacctgattagaatcgctgtccactggaccatgccatccgcctgctggctctgaggtggctgctgcggagctgacacccccagatgctctgggagggctggtacagaaacccagtcctgtgggctgggccagagccactcaggctctaggtgtcacgttgggcaccgttgtggtcctctttggctgtgtgattccctcaagccccaggcttgcctggagaccttcttgggagaggtggcttgggataatgcttttcattaaggatgggcggaaagrcctgtcttctgagagtccatggcagtgctgattcagaaccccagggccaggtgcctgtggcttgcacggggcgctttcctgccccgccttggcctctgagagctccagctgtgctctgagcaggacagaggaagtgactgtaccttgaagaagagggatcctcagaagacccagtggagccacatgggctgccgctgggctgtttcagcggtaaatctcccaggatgggacatctttggggagttcctcctgcaggccatggcagggctttgcctctagcaatgggacatcttctggggactcctgagttgaactggctggtgggggtcttctgcctggggattgaaagtgaccatgtttcagaaatcccaggctggactgctgctggaaactgctagaggaattttgtgctcttctgacttgctgactcaccaggccttatgggttgccctgtgtgctttccctgaggtttcaggctttggttcccaccctcgttttctccttggcagcatcccttccaccacccccatgatggaactgggcacatgtgggtacccctgtgcaggggcatgctggaagctggcgtcctaactccatgcttagtaatatcccttggtagcttgaaatctaccatggtggaaatatttacatcaaggaagttggtaaatgctacaagtcaggggtttatttacttccagagagccagttaaacctctcctagcataccactgcccctggggctacagcgtggcttgacaagctcaacagtacttgcctcattctctatctgtttggcctaaggtcattgccggaaggcacctatctatctcagggcagtgtttccagaggccactgtggcccttttggtctgctgtgaccaaatccctaggtctgacacaaggccttcttgttgcagtccggtctagctcttgccatgatcctggattggcctgraccagtgcactgaagcatcttttacgtcagacacactgtccttcagcctttctgcaccggcattgtgcacccatgcaggtgtgtgagagtggggagcaatgcctggctggagctgtgggcctgggtcccctttctagcttcaatttctttccccacagaccgagctgaactcacaaggtccagctcatactctgtgcccagggagtctccctgaatggtgctgtcacctgtgccccttgcctgggatgcacacctgccttgggtctttgccctgccctgtcccccagggtaagtgggtgagttagaagaaggtctttccagaggcaggtattttgtgggtctttgagtatgtgactgggtatttctatgtgtctctgtgtgcaaagcctgagtgtgttctttccctgccagccttactcaccgctctgccctgggcttgctgaggctccctcagggctggggtgtgtgaagaagggcagctcctcagggtgcagtgggcacttggctcagaatccttcccacacctggcagaggggattctgcatccacaggtgttgtgtggacagcaggctcttgggttctggagattgtcatgggatcccggtttctaagggcttcccagggctcagatgtgccctcggtaaacacagcccacagcttgggcagggcctcccatctcagtgcagtgcacgagggcgggcgagtttcacttttcccagcctggggtcacgccccttgcctgcattgtctcctcggctccacacacagcctggtgagattgtgtgcctatttttcagtagaaactgaggctcaaagtggttaagtacctgtttacagtcacacagcccataaatgtcaggagaaagatttgccttagactcgaaggtccacgctctgtctcactgtcaccacactgcctcaggcagggaatggaggtccactcatgcaggctcaccttgccccgtagtgcctctggtggagtccagatgtttttgggctgcattcatttcaaaccactgatgccatgtctgcctccatcaagcagcctgcctaacagcttcccctcttctttggttttcaccacacacagtgtgctcaaggctgtgggggtctatggggcttcttgtagctccttctgtcctggagaacccactgtgagcctggcctggtgcctccctcggtcacaactgcttgcctctgggcctcctctgctggagcacagcgtcttcttctcacagatgtctcctgagagcctcaggcaggaatcctaggtggtagctgcccgagctgagtctggtgcttctgtgagaaaggcagaatcagtcctactttgtgtctaacatcagagtctctagaacatgctgaggagggccgactctgcagtggtggtggggcaggaaggcagcaaaacctcagtttcctcatctgtaaaacagctacaatgctatggaccctgcctggccgtggggaggaccagctaagatggtgcacacctgacatcttggccaaagtgtgaggctgctgctggaaagcccgccactcccccagcaaccactgtccccacagaaccttggcaccgtttgcctgatcctgaggtccttgggaacagccaggggcagggtgtctgtggcctatgggatctgtcctctacttcctggggagatgcttggttctcttccagagtgggcaagcacatattctgggaccagctcggtggttccttctggaaggcaggcactctttcttggtggggcctgcactcaggccttcagtcttcctctgtggccccttctccctgatgctcatcctcaggaagacagcagcagggagggtttggcctcctgactggatggacaccctcccagggcccaggcccctctgtcctgctttattggaagctccttggtcccccaatagatcagtgctctcagaactgtggaaaaacctcaggtctccctgataagattgtgctggggtttgcggggaagatgacagagctgcagggagggagaggccttccccttctacccttgttggctgggtcttttctgggctgggtggggggtgctccccattcagcctttctgccaataggccccagattccttgctgcagaagaaaagtagcaatgcccgtaagttcctgaatgcaaaggcaggaaggttttgcacttgagatttgggactttggtcttggggcctggctctggcttaactgtttgggaggtaaggaggtacttgggccagagcagcaacaaagcctgccgcaaatagtgtggaaatagagactgcccagcaaaagcttagacatggctgtgaggactgaggggaactgcattctgctcacataaaacctcctgatttgagaaagcagagatggagtatttggtcccacctaaattttaagtgtcagccaggccaatttatgctgtggcrccaggaactgggctgttgtggcagcaggtcctactttgccacttcccagctgtgccaagttactcatcctctcagaacctcattgtgcttatttgcataatgggatagtaatataggccttgcaagttctcctgaggactaggtgagaaaacatctgcaaaacacaggtaaagctgcacctcctggctcagtaaatgctgctaagatagtgacaatgtctgttggctgcataaatgtcgttttttgagaagtgtctgttcatatcctttgcccactttttgatggggttgattttttcttgtaaatttgttcaagttctttgtagattctggatattagccctttgtcagatgggtagattgtaaaaattttctcccattctgtatgttccctgttcactctgatcgtagatatacctaatgtaaatgacgagttaacgggtgcagcacaccaacatagcacatgtatacatatgtaacaaacctgcatgttgtgcacatgtaccctagaacttaaagtataataataaaaaaaaagatagtgacagtgatataaagaaccgctgagaacaacagaacgcacgtgatggaggctgatccatgggtctcatttactccatagttagccaagccgtaatgaatgtgaaatgttcccgtgtctttagcattttggcatctccctttgcgctaatgtccaatcagcatgaccggagcstcctccgattgtggtgggaaccgttgctctgcacaggatttctgggggtgtgaatgaggagtgagtcttacctcctgaatcccaggccctgctgaatgtcggttcctgccagccactcacagcgccgtcttgccctaaacagaagcttcccttggtttcctcccctgagcacctcctgggaagtggtcagtgggacagtttgtcacttaaaatttgggaaaacagggagggatggccactcaccttgatctcaactccaagaattctaacccttagaaccccaggcccagtctttataaccttaaacccaacccagaactggaaacgacttaccacccaatattggatctccctctttgtagactaggccagccacaggccgcctctttggccctgggcttcagcaggggtgggccctcagccctggctcaacacctcccctcttctcccagccctctgtctccaggaggccagcaagcaatgctgcagttctgccctgcagggtccgtgtgctcccatttccctctctgccttggtctagactgggcctggtcctttacacagaaaaagggctattcaggcattttcctccagaaaccttgagcgccgagcaacatagaaacttgcagatgctttgacacaaccatttgtcttggcctcatctcagatctagctcttcatcagggctttctgcccactctgctcctcctcctaccaccaggatgtaataaaggagcatgggaaatgtgcactgcgagtatccctccaggatcacagattttttttttcctctattggtcatagctggggttgattgaaaccccctgtggctgctccatgactgttcgtcctgacaggcacagtctgcctctggagcacacagcagggcagctgaaggtacttctgccattgttggactccccaaatttcctaccccccactgaacattcgcttctgtccactgttctttgctccatctctctggcctttggatgcctggtctgccttctggtccccatcacccaaggacatgctttatcaccacccatgctgcctcctccatgctgctgatgtgcccccagcttcatccactaccccttggggccccaagagagaggctgagtgagtgtagggccgactacattggagggaatggcttccatcggtcctggaggaagccaaaccttcagctttgttcatgctattccatctgcctgaatgttgttccctctcccacctctctgtacccattgcaaactcctcctccatgccttggcttaaactcattttcttgggaaactctccctgaccccctgatgaagttagactttgtccttgtttaactgtaatttaactatttgattgcgcaattatggacttaattacccttctgtttcctccactgtgctgggtgagggcagggactgtccctctaagactgtgctcagcaggctgcctggaacacagtgtcacttagtagatatttatcctgtgcatgaatgaattaatgaatgaatgcttcaggctgcggggttcagggctgggcctcagcactgagcgcttttgttctctgctccctggtgctgctgggggtgggccaccccagcgctggcatcctgggaatcttgctcacctccatggttctgaacctctctttccttctggttcctgggctgctgttccaggtcgctgggctggagcctcccccagattttgtcctttaaaactcattgattttwgtgctgacttttacagtacaaatgtcatcgttagataaaataattgaagcgggtaatctattcactgagctcacacagcccctcccactctgcccagcctggtgcaccggcaaaagtgctgccccggtttgttttgacaactgttccccacctggggtcctaggactatggccagctggagtgagcagcaccgggtggtgcaggggcctcaggcctgagacccttccttgccttgccagtagcttctgagatggacagggtgatgtaagcagatgggtgaggctgagcaggcgaccacataccagcggggggtgctgggccactcttcctcctctctgttcttcatcctctcagccatttggtggggataatcatacttctctagaaagaagattaagagaccacagatggactgcccccaccatccctgccaccgagtggggactcaacaaacattgtctgacccaggcctcccacacagagtccctgcttgtggctctgggccagaagagcagccagaggccaactgcaggggcaaggctcaaagtctyagcctctgaccgcttctctgcctgcctggtcggtggctgacgctatcagtccaaagtatcatgctcacagtcttcatcactggcttaacagctgacgtgttaacagaggatctttaagaaatgcgtcaaattaacgggtgcagcatcccaacatggcatatgtatacatatgtagcaaacctgcacattgtgcacatggaccctagaacttaaagtataatgaaaaaaaaaaaaaaaagaaatgcgtcaaaacatgctgctctggggctcatgctcataggacagctacrccccacagcccctagctctgtctctgctatgggcctcaaggacaggatgggccatggagcgcctcacctgggcttgatggagacagctggcagtgccatggcccagggcagccacaggctcagacgcaagtgccaggccaggctgtgctgctcccactcccgttgtttcaagtggctccagcctgccccatgacaacctgggatgcataaagggcactgagggtactggcccattggaggtccacagagtcactcccgctccctgcctccacctctccagcatcctggccctcagttttggaatctcagcccctgtgtttcctcaggttcttataccctaatgtgctacttacttagtacaggcctctccaactcaacaaccccctgacactggctttcagaaggctccttcaggcccatgcccatgatgatggatcagatatatgccccctgccaggctgccctcctggagagaaatctgcaaccccaggactctgttcgcaggagcccatctcagccctgtgcacagggcatgacccagaaggttctctctgggtgttgggacagatgcccaaaggccacttccaaagaatagtaaagccaagaggaatgatttctccaagcagtgggtcatggacaaccccacccaacaccctcacctgtccactagtgtgcaccctgctggctccagatccagacagactttttgcctctatacttttgaaaagttggccccaagaccctttttatgcacaggacacccctgtttttagggttggatttgcagaattgggaatggaaattgagtctgagctactatgtgccttatccatggaaagcttctgaagacaaacaagattggctgccccttgcttttaggtgagagaacacacagtttgcagttagctgtccctagtgggcttgggaaaggaggagctgtgtggctgggctttgggtggctgggatkrggatgtatggctcttcttcctgttccctgcatgggrtgagggtccctgggcctcagcagggacacggtaatgatggccccatgattttgcccttttcctgtctttgcttctgggtcagttccctccttgtgatggctgcaccctcttccctttttcctccctgggccttgctgcctgggacaccacccacccaaagccccaaaaggtgtggaggtccatctrgataaattactaaccccaggacacatttatacatattcatttgtttaatatttaattttaattagaagtgaaatggcattgcaaaaacaccctgccactgccctaccactggttgggtgtcttgccgtccctccagagcaggacagctgccaggagccctccctgggtgaccaccagcattttccttcggtaaacagacagtgacaatcggaaatttgtacaaaatacaacacacttgtttttctgccttctctattgatttggttttagcagggagaagctggatgtaatttttgtttgatttcctcttggtttctgagtggattgagatgttgttatcaattcctccacctccggccatttcagtgatccagttccattgtgaccaccaccacctgcttgcaagcctgtggctcaggcaagtcagccagcaagtcatctccacctgcttgcaaaaaaccctgcccagaaccagggtgatgtggctgagatgtgcagcatttttgggaaggcagattctgactgatgagagataagccctcctggagactccctcaagcactcatggcctacagagaccctcagttccccagcctcagctcctaagattactttttggcttagggcactcactgagcctcactgttctcatctgtgtaatggggttagggcatttctcatgggaggagcaggagcgctcggtgggggtagcacacattagcctgccccagagcctggcaccaggtgggagcttcgtaaatgctgttcccttcccgcagctgcctgtcctgactcagcttctcaggctgagtcactctccaagtgccctgtcttccctcttacaccaccccctatgcaggcttcagaaacctctagctacctgaatgtgcctgaatgtgctaggatgtcaggccccggatttccctcctgacactccttgctaccagcttattttctcatgctgtctcttattcctaaaagcatggctcacaccttagttctttgggtcaccggggttggacggccagggtgtgggaatttcacatcatgtagcctgtcygttgttgctggtgctatcagctgagaggtgggaggcctgggacaatgcacagctttcctgagagccagctgggtaaacactttttcacaagaacaccctcattcttgagtatttaggggagcacccaaacagatgctgagagatcaaggcaggattttggcctctaataataaggatgctttgtttccagcacrctgagcgtgtgctcagacagtgggctataccgttttaagagaacagcttttgggctggagtctcctagactccattccctgctttaccgcttataccctgtgtgaccctgagcaagtcacttcacatctttgagccttaggctactgatctgtaaaaatggggttattattcccccctggaaggactcttgcaaggactatatgagggagcacatggttcctggcacatcataggccctcagcacatgctgtggccttcttcctatggcactgggggttgctgatgatgagcttctttctgctcagcatgtctgggcaggcacttgggtctgaaaatggtgaccaccagcaggttgctggcttctggccattcagcctcctgaccctttgttgaccatgcctccttcttcccctccactctgaatgccagaaagtacatagtgaactttctttttgttggcataattctgcaaactcctgatgtcactggtcctaaagagttactccagagtggcgatgctagctagttggtctgcaggaggcatggcagctgggaggggaggggaagaataggtgatctggactgaactgggaattctacatggttgaaatgaaatttgtgctttggtgaggtgcatgcagcaggagggaggacaggcacacagtgagcatttgcaggatgccttaggactcagctgtggctttggcaagaccaagcatagcatacacatctatgggtggctcctttgtgtagaaatcagacccatcctggcttaatcccccagttgagggcttggtgttctggaggtatggcatggacagttgtgctttggctcacacgatgatgatgatgataatgatgatgatgctggtgttgatggtggtgatgttgatggttatgatgatggtggtagtagtggtggtgatgatgatggtggtgatgatgaaggtgatggtgaaggtgatgataatgatggtcgtggtgatagagctagttcagctcttaccacttgctaggtactattctacctgctttgaatgtagatttaattctcgtaagaatcctctgaggttggctttgttatcatccccattttatagatgaggaacaaaggcagagagaggttaaaattgttcattgccaaatggttggtaaggggtggagtccagtgttgaaccctggctgacttagccctgtgccccctgcctctgtcccatgaatgatgagcaggcatgctgagcgaagctgtgtcctgtggcacagacaaggctctggcccagctctaacagaaatatagttgtgcattgcttaatgagaagtgcatcttaggtgggctcattgttgtctttactgtgtacttacacagacctagagggtacagccacctatacacctagactatatgggatagcctattgctcctaggctacaaacctgcacagcatgttactgtactgaatactgtaggcagctgtaacacagtggcaagtatttgtgtatctaaacaaatatagaaaaggtaatgatgttactgtggctatgatatcaccaggcaatagaagtttttcagctccattataacctttgggattaccacgttcattgttaactgaaatgtcattttgtggtgcatgactgtatagtgtgaaccgcatatgtaatttaaaatttaaaaagtaaaaggtgaaattaatttagtatatttcttttagcccattattgtcatttcaacatataattaatataaaaataattaatgggaggccgaggcaggcggatcacgaggtcaggagattgagaccatcctgactaacacggtgaaaccccgtctctaccaaaaatacaaaaaaattagccgggcatggtcgcgggcgcctgtggtcccagctactcgggaggctgaggcaggagaatggcgtgaacccgggaggcggaacttgcagtgagccaagatcgcgccactgcactccagcctgggygacagagtgagactctgtctcaaaaaaaagataattaatgaaatattttgcattctttgttttgtactaaggctttgaaattcaacctcggctttacacttacagccgatctcagttgattccacctcgtttcaaatgctcagaagccccctgtggcttgtggctgccacattggatagtgtgggatcacccagactctgtctcagggtgcacagtctgagtggggacatctgctcatattttgcttcccattggtcacacaaacctctcagccatgtttcagtgtctcctgactcatcccatggcctcccagattgcctctttgaataatttcccatctctgtggtacctccgtgacctcacacatgtgcttgttttggtctgggagccctttcaagtggggttggagctgagtcctacagagcagagagagtttggaaaggtcaggagtcagggtgctggtgaaaaccaggacaggtaagtggcacatcagctgcttccagtggcttagtaggtgagtgagtaatttctgatgatggtcatcgtagctgcaattcactgggcacctccacaaatacctggcctttaattctcacaatagccctgtaatggagatacatttccccttttaattgtaatcagtgttttcattggtagggagactaaggtgcagagaggtgagaggcaccttagttgatggatggtgaagccaagactggggccagggctgtctgactcccagggccaggcccttcccctctgtcaaggtgcttagtctcaggccgatgaatggaaattcttccatggacccggagccctggaggcttgtgagcaggcctgtgtcagagcagaagcactgcgttgggggacaagtctggcatgaaatgacacagcagaaaatcctgagaattcatgctgtttatgaaaatcctcttgattattgtctaggctgtgctggttccatgctccaggggctcaacatcctttcagggagaccacagctcacctgtgggagcagctggagccggagctcaggcagccacacttatggacagtcccgaggaggctactatctcctatattttgcataatgatggagagggtgctgacaacaccttcactgactcttggctttcaacttgcgttggctgtcaacttgcgtttataatttaggaggattccaggttgtccctagggtaacctcactgtcactccctggactttccatctgctttcttccatggggcccacagaggtggcctaagaactcaggttactgggaaatactcccaattccaagctgtccgtgggaggggtcctgctggtgagcacctggaggagagacgtgtttagggagagaaaaggttgagcatggcatacaagcccttctttacatttctccatttgtcactccactagaagttctctgggggcctcgccagcatgcatggcataggcagcaccgttttgtgctcatcacccttgagccctccgagtacccagtggtcttggccaccctgcttactggaaatgcccccttttcctgcttggagggcatttgccttctgggtctcatgccatgtccttagccctcattctgtcttgctctgtatctcttcctgggccaacattcacatttgtggcttcagttgttcctctgtggtgaggacacagcaaattacatctgtagtcctgatcatgtttggactcaagttttcaagcatctgattaagatgtgctttaatacctcacagtaaacaagcccccatcagaactcgtagcttccatcctaagcttgttcctccttctctgtttcgtggattcactattgccaccttcaggcttccagaggtcctgtttggaagcctccaagccatcctagcctcccttttcttcccctctctccatccagacagtcagcttgttcactcttcccctgagtgcctcttctccttcatcctcattcactcctgatgcccctccccttggagcctgcctgtcatcctctcttgcctggtctgttgccacacctcccactcttgtccactgttctctccagaccacttctgttggcccagccctgtttatgtccttccacaactttagggtatccctcctatctgagggtacagacccatcatgctggcctttgagacgtgagatcacctggacatgacttgttctagacgtctcttctgacattcccttcctcatctgctgccacatagcaccattaatcacaagccacacatttcttrcttctgtgcttttgctcttgtggttctcttttggcaatgggtgacagaaactcaccttgagctaccttagttaaagygccagggccatctgagcctctggctttgtcaaaccagggacccaaatgtggccctttgttttcttcacctgtagatcggtcaattccctcaccccagcttcccccattggacaagaaacatggcagctctcacctcctgagtctcctaccagctttgtctagagcgccatccctcttctcttagttacagtttgaaaaaaatcagggaagggctctgacaggctgggcctgaatcatgtgacctcttctggactaatgagctgtggccagtgcctggggcacagggtgcatggatggcagcacccactagagctataaaatcggattggagcaggataaggagtcattcccccaaacaagagcagggagctgtttccagaggaagayggatgtgctgggcaggcaacaagctgtgcatgcatctgctgcccctctcttctccccttgctcacaccttcgctagaggccaggcattcttttgggctctcctaccatttacatgtggatggagttccgaattttgcagcttgttgcagctgtctctayatctgactccttctccagcctgcttgctggacagtgctcagctaggaaggtcagattgcggactggaacttgccttggatgtctgggggctttgtcctccccatcagcaggcatggtcacccttgatgccttgcacccatcctgttgctcagaggtttccctgccttcccatcctcctcaggcctgtatcctgccagtggattttcagagcttcctggaggcaagcacacagcccagccccggctagagattcatgactttcctccctcctgccctccctattcccctacacccactagagagtcctgaggactattaacctgtcccctcrtttagggctgatgtatatattcagtgaaaaaggcaggggagtggagacgagaatgggggacttcctccagagcttctgacacctctgattgccccaggaacctgtgctaacccacagacaattggatctcccctttatcctggtgacagggcttgtgatgaattgctcatattttattcctcaggaagttttattgctattccagaatggtaggattaactctaaatgctttctggggtgttcatttccctctaaactggaaatcactataattgcaatgaaaactctgactcagaatctgaatctgccctttcagttgctcttgcaaagttggttaaaaaaataaaaaggcagatgtgggttaggaaagagcccatttggtgtcccgggcagaggctgtgtggttgacatcttgaagaatggcaggttggccgtcgacagccaaagtgatcaccagctattggctgcaggcaggggctgcacagacccagggccaccagagggccttccccagccttcagcaagccatacagcccgtggtgctggcctgggcagagggcatctggcagagtgtggatttatttttgattattggattttctggaaggtgaagggggctaacaataatgaggggcttctgtataggaggcatgttcctaaatatcagaaagactcagggcaggggctttggagtcagactgacttggacttgaattgtggcattggcactcacctctccaagcctcaattttgctatctgtaaagtggggataataatagacctgccctcctggggttgctggggtgagtaaatgagacggggagtgtgtggggcttggtacagtgctgggtgcactgctggggtgtcccctggttttgctcccggagaggtggcagcgagcagaggtgtgtgctcttgcccagcttacgatggcagctctgtcaattcctcctcttcagtttgcacagcctagctcaggtgtgggcttctgttggactcgagcttctactcctggacaagaaattgcatttctgtaattaatttgaacattttttccatgtgacttttctgagctgctattgcatgccaggctccatgcttggacctgggagtatgcagtggtgagaaagattcccaggatctgcagccactctctagagacacctgctcctgctgggatggacccccttggatatggaggttggtcaagaagccgggggcccttctggagaccagggtgtggactgtggcccttggggctcgacattctgttgtatcactctcctggaggtggcagagctggacagaatcagacctcctggctcagcccttgttactagagtgcctgaagctctctaggccccagttttttcctctgtaaagaaggaatgaaaatcctgctcccgtaggcttgctgtgaggaggaaatgaaggggagagwgtgggacagtgcaaagaagggacttcataagccataaatgggggctcacttccctactcccctcacccagcgttcctggcaggaaggacatctacccttgggaggaggagaggggacagtgttggtctgggcaggtatttcccatggttgcagccccaccccactggcattgatcatactattagtccagttgtctgcaccttcctcggagcccaagagcaactctggcatttccagggccttccggcggcctgtgatggatggctccaccgtccagtccatgcttgtgccaggcctgggcgggtgcggcatgtgatggatcagcccgaggatggtattttggaaggaaaattcaaattatattttaagataataccctgcctccccgcccccaccctacatcccatttgtaatctggcccaagaggttctggcaggaggtaacgagtttgtgatggatgggtaggcagccccattaggcctgcagatcctgcctcttaattaatattgatgtggctttaatttgggggcttagcaggcatgttttggtggcggggctctgtggggttgcagaggccctgggccatctgtgttgctcctagcatggcttggctgcctgggctggggtatccagccatgtccccatgctgttcttgcagagctcctggcctctgctgaccaccagccccatcttgagcagcatgatgtccctagacatggaattgggaagcaatgacacccattatttctggtgtttcagataggatagacattaatagcctcaagagcgcagataatagtaaaatgcagcaaaataattagggaatgatgaactttgtgtatttatcaattttgtttgttaatataatttaattataggtttatataatttaatccatactggctatgtttaataactggcttgcaaattcctgaaaatttaacaataggctctggcaaggtggtaggatgggctccagcccactgagtgtgtgtgagtgcaggtgagtgtgagcactggtgagctggaatacctgagcgtgtgtgtgtgagtgaatgtgtcagtcagggaggccttcctttgcacccagactcaggcatggggtggagtcccagatgccacctgacctggcacccactgggctcaggcacgggaagctctgtggcaccctggagctcaggcagagtgaggttcctctgcagaagtggcgtcaggaggcccacaatgaggggtggtggcatctgtgggccccttgctgtggcttcacttctggctctggttgccactgtcccttcaaagacaggttcccgaggaaacaaattaaacccgagtaaatatcagaaagtaattatgtaaattaaatacataatttaaagaacacttgtcatgaggtcagtggaaagctgtgaaggcagaagcctccctgtcagggctggcaaggcacaggcgggtgaggggtggcagccgcactggagaggatgggctgctgttccgagcagcctgcccctcacacgggctctgtcccaggtgcttcatgtctgtccttctgtgtgcccctcacagtggtcctacccctagacagcctcactctgcccaatttagaggcagtggctgaggctcagggagcttaagagccgtgcccaggccagagatggctacccatgagtccacctcccctgtggcaggccccaaagcccaggctctttctcccacaggggagccacagccctgccctgaagtggcctccctgagagctaggcagcatctgctccagctatgggggctctcrggcgcagagcggggcttcagggctcactccagtgcagtgtctccgttgctgtcatcctttctctgcctcagagacaggaggcagtgggcaggagtggtgggcttggcatggctgggccctaggccctggtctcagggttttctggcatccctcctgcccagaaatgccactgtggctatccttctgtgggcacacaaggtcccacacccctcatacccaaacagaaccacacacaggtctacagctgggctgttgggttccatgaggcctttgatcctgacatcctcttggtctggaatactccctctcttgtccatgcagaaaatgcctcttcatcctgcaagttccaactscccactctctgaaggctttcttgagaccttccctctgtctggagaaacaaaccccttctcgtgcactccctgctgttcctagtacatcctcaaacactgttttcttgtctgtttcctgttgggctcctttgaagttggggacagggtctgatccttctctctagtatccacgatagggcatggcctggttgggcaccagacataggcttggagcaagcctgagtgggtaagatagtgtggggcagtcccatcagcctgtcactgagagggtgggagttgtgggcagtgaccagggcagccccacacacattccccaccagcgcagatcccgagacactgctggtcccagggatcaggaggtcccattgggtgggtgggtgacagcccctgggtggccctcagacaggtctgcagagggggaacccgtcccaggttgcttccaggttaactcggttggggctgctctttctagtagaatgggctttactcagagtgataatttacagaactaatgaagatgctacatttcactgtgtaatgtcacttattaatactgattgcaaattaacagctggtaatggcatgcatcatgttttcctcttgccattcttaaatgccaaactccagcatttgaccagcctgctgcacggtctctctggagctctatatgcctgcggtggccactagataggtctggggtggggatgggagttgctgtgtcttggtgcacagagagcagagccctttatagtagacagatccagggttggatcccagctctgttctgagccagtgacttatctgtgaaatgggcatactctggtaattccctacaggtgctcaggctcagaggaaatgtgtgtgccaggcacctacctcagcattgcaaaccagaccattgcaaacatgatggggtttgcaaacctgcctccttctcatcccttcccacgtgccttcagcttgttggtgaataagactaaagagctctggctctggagtcagaggccctggatttgagcaccttcctaggctagataaactcgggcaagacatgagggtgtcatggggactaaatgagacagtatatgcaaattacttcacatagtgcctggctagaagtcagacctggataagacgtgctgtgtgctagtcagcttgggctgcattaacaagatacctcatgctggggggcttaaacaacacacatttaattttcacagtctggaggctgagaagtccaagatcaaggtgctggatctgacgtcttgtgagggcacttttcctggtttgcagttggccatcttctctcagtgtgcgcacctsgtggagagaaaaagatctcgagtctcttattttcttataaggccactaattccaaccaggaggtctctgcccttataaccctaattacctcccaaaaccccctcttctaataccatcaccttgagggttaggattttaacacatgaattttgggggagcacaaacattcagtctgtagcatgctgttacgattacgccatcattggtttggccataccatggagagatgtcatctggctgtggcattaacaaaatccaaaggcatcagctttggagcccctggaaattcacatgtggctgtttggacaaacacttggaaattacttctctagatttgcttctctacttaaatgaaagaggaatccagaaaaatacccagagctccctcaaagcaatgatgtgggtcattcctctgtgttctgaaggaggagctcaacttctctggccttcagttttttcatctttcatggtatggttagccttcctcacaagccgcagagagggagaaaagaaatgaagcattgaagaatccagcagctcagggagagggcaccaagcacctgagggctggaggcgagcctctcactgggcgacttcagctggggtcttgctcctgccccgagrggcctgttgatgcaggaaagaagcttgtggggaaatgccatgccaattcctcatcctgaaaaaatggcatcaaagcagcaggactctgaaaaccatccctgcaaatcatagaggaagaactgctaaaatcattaccaaatacctcgtaagtgaaaggtgacaggaaaatcaaactttatttgtgaaaattctaaaaatcattagcatattatggattccttaaaaatatgatctcacttagctgatggaagggaattgcaaatcaaagggactatttattgcagtgggaacaagggacctgccagattaaaagaaaatattgaaggagccagagatttgaaacatgaaagacagtagcagataaacaccgcggaattttatccaaatactggaacccaacttggaacagaagttggtgaagaattattttataaacccattttcatcataacatgtgtaaaatgcaaatcttgataattatgtaaattagttacttggcataatttacttaattcaaagcacttaatgcagcgtggtgtgttttttcgaaagtgccagagtagacgtttattttaaattgtttttaatctcgatcttccagcctgattatttaaaatgtttttccctgtgtttgttttttaaatggaaaggagtagagcttggtgggaaattggaatgtggtgggattagccgaagccttccattgttagtgccccaggcagggggtgtgggtacggctcattcaaggtccctgtgtctgaaacagcacatgtgtgaacacaccaygtgaacgtgcccatacggagtcatccagaccacccattccctttcctgaatctgctcttatgtggttctgtggctggttctgaaacctgtctgagcagaaggctcctgggtactatcagcccttaktagaggcagaaacttgtttcccctctcaaagagttttcaatgacagaccttccccttcaagccactttacaactttggaatttccattatcacagaagggagagatgacctttttagttttctattgtgtcacccgattgtcaggatggcacctcccttcttgatgagactctagaacaagagagatgatttgctcatttgagagcccttttgggggcgttccctgtgctgttgagaaggttggaagggagctgacagccgctgaacatctattttgcactgtgccagctgtgatgtatgccccttgctgaaggatctaaggtctcctaggaggaaggtggggttggctctgctttgcaggtgaggaaataggctcagagaggtggttgtccaggatcacccagatagtgaacccaggcttgtgcttattctgtgcacccctgggggagcagggcagtggggctgcttctccgtgccttttcctaatctctgaatctcagactaccatggaagatagtgttttcctttttttttgacaagtaaaagttgtattttttttgtggtatacaacatgttttgatgtatgcatacattgtggaatggctaactcaaggtaatcaacatatgcattatctcacatgcttatttttttgtggtgagaacacttaaaatcgagtctgttatgaattttcgaatatgcaatatattgttattaactatagtcaacatttatacaatagatcacttgaacttatcctcttgtctaattgaaatttcacctcctttgaccagcatctccccagtcccctaactccccagcttctggtaaccacctttctattctctatttctgagttcaactttttcacattccacttataagtgagatcatgcagtatttgtctttctaggtttggtttgtttcacttagcataatctgctccaggctcatgcacattgttgcaaatgacaggatttccttcttttcaaaggctgaagagcattccattgtgcatgtacaccacgttttcttcatccatccatcggctggtgaccaccaaggctgattccctgtcttggctattgcagagtgctgcaaggagtatgggagttttaatacaggctttattatgatttaggtatggcaaggccaatagattaggagatgactaccattgaaaagactgtttgttatacttgcagattcccagagaagagggcctgccttgccagcaggtcccacagggaggcagaaaggaggaggggggaaactatggtcaagagtcggctgtgctttccatggggaggaacaggtgaggcagagtaggtgggctwaggattggctggtgggagtaagcccagtgggctctggggcatagaggtgtccttggttgtctggtacctggccctggggtgattaggacaagtatatagtggccctgagtgtgagatcccaatataaaatgtggtcggggttctgggctctggattggttggtttgcagataaaaggcatgctctggagcaagttgtttactaacgcagggagagacaggccctccagggtaagtgaggccccagatgtcaaagcatcaaaaggtaaaagatataaggaaggtgtccagttttagtcttctgcatatggctagccagttaccccagctccacttagtgaatagggagtcctttccccattgcttgtttttgtcagctttgttgaagatcagatggttgtatgtgtgcagctttatttctgggccctcttttctgttccattggtttatgtgtctatttttgtaccagcaccatgctgttttggttactgtagcgttatagtatagtttgaagtcaagtatgtgatgcctccagcgttgttctttttgcttaggattgtcttggttcttctggcttttttggttccatatggtacactctgaaactaaaataaaagttaaataaaataaataagtacgtatctttggaaaaatgatatggttaatacagagggtagagctttttgtggtgagggatgggatgtcactctggaggacctcagggccaggcctgccatgactgttgtctggggagctgggattgtgatggggacaggagagccctccctcccagacaagacgctctcagatgagaccttgggcaagtagacttagagcagtagccctttgctgctgaatctggcagracaccatcattctactcacctgaatgcagcccttgcctaggctctgggggaccttgtcaccctatgatgggggaggcctgcttccaattttaccaacagctgctggatgtgccatacctttgctgaattgcccctgggcctgcttggtgccccgctgacttccacagagagtcgcctgcatggatcgattgcagggacttcatttatttatgaagtactgtctgcaaatggaacacattctggcaataggaggtactcagtaagtggcagaagggagccactcctttcttcagggtcagcgtcagtcttaccctcaggacccagagctcctccaggacagggctgtgaagttttaaaattctgctgctctggaaccaagcatagggcctggcccaggacagtgttcaggaaatatatgaggaaggaaggaagagggcgggaagggaggaagaggaaatgcatagctgagaagctgaggtgtgaggtgtggggaggtgaggctccagatggattccagcgggcagagggcaagggtatccctgtgattggagccacagcaggtagttctttgggttcccttggaaatggcagacgctgctgccatcatacctgctccgcttgcaacaactatggtgacattaggagctggtggtgggaggggaatgtgcaatgaaagagaggaggctgggtagggctcttagaaatgaatttgaattatgggtaaagtacatctgggaagaaattcaaagcatatctttgggggctcaggtaagaaagaagtaaaaataaaaagtctatggaatcaaagttgtgtctcagcctttggaaaatttgccaataatccaaaaacacttttaactgtgaatttcttctgcgtgtgaggtggcagccttcatgtatatatatgtacattacagatggtaaaatattctctataagtactctcagtgcctgggcctttctcagaaattgaaaatagtrggggaagcaatttgaaatgtcttctttcgcttcaattacttttcagaaagaaagtattaaaaatacccagtgactatctgatttttttcagagggagtggagggatagtcacaattataaccttagattttgaaaaaattatttccccaacttcagttccttaccaagtagggctttgcctccaccggctacgtggtcatcgtgtggctgctgaagtcacgccgggcttcaggcaggttcccgctgtggttcaacttgattccataaacttttactgtttctgactctgttctaggcaccaagccttggggtttgataaagaacacaaatgaggaaggcctagctcctgttacccatatattatgatttaacgttattaatattgtttaatattattaaatttgaagggggcatgaatttcaacttgaggacctgagatggcctcagaggggaagtttgaactgggtcttgatggaggagtagggctctgtaaatttcaaattgggagcatcccagtggagggagggtgtgtgtgtgtgtgtgtgtgtgtatgtggaggatgtccaggagtgggcaaagagcttctttttctggatcccaaggtacatggtttgaggaggacgtggtggaggcaggtgatgaatgtaaaaacaaatagaaaatgctgttaggcatggtgaaaccccttctctacaaaaaatacaaaaatgagccgggcgtggtggcgggtgtctgtaatcccagctactccggaggctgaggcargagaatcacttgaacctgggaggtggaggtttcagtgagctgagatcatgccactgcattccagcctgggcaacaagagcgagactctgtctcaaaaaaatgctgttaggaccacagtctcttaggtacccaaaatgtctggagtctattttgtgcacaataatgaagtctctagaagactttttgtttgcaacttgattgactgatgcttttgaggatattaatttcttggcaactgttacataaattgtgttatttgttgaaggtttagaggagggctgtattgtgagcagatatgatctcaagagagaacattcttgtggaatgtattagagggcagatgctagggtcaggggaccctgcaggacactgttgcatgagtcctagggaggaggtgatagtgctgaacctgagaagggagagtggaactcgggaaatgtttaggaggagaagttgaaaggcctccgccagtccaggatgtgggcttccttagcacatgtgtggtgatgctgttctcagacacgtgagaacagacatggcaggtggtaccagggggaaacctaggactagtgggagtgtgaccgggagcgtgtgaaggaggagaaggggagcgggtgggagcagaggggcatatgattgtgcctgcaagcccagggggagagggcattaggcaggactgcaggctggatgctggagaaccgtggaagacaaagaccgaggagggcccttgtttgttgatgactggcaggagctttagagcagagtcatggaggctgatgcagggggagagggcgagcggccgggatgtaccgggcaagcagggccaggtgtcagaaagctggtgtggaggcggggagggacctgtgtcctctcctccccatggatggtccctggtgcccactgaccctcagcttcctttcctggcagttccacagtccagccttgtcatggggcgagcaaggatcttcttcatttgatgtcaaagatgcatcattctggaactttctgtgtgctgttcccctctcctggaatgttcttcctaggggtttccagagctgcttctcctcaccgaggcagggtctttcctatcccaccctgaagtcccctcccatccagcatttattttctttggggctcttctcactgttggaaattatctccttgtctatcctgctattgatttgttctggcttgttctcagcctctgaaatgttaagttctgcgataaagaaccccagggkttcattcagttttgttttcctgtacccggggagagacagacacagagtgctcagtgagtactaggggaagaaggaacgggtgggtgctggcaggactccggcaggcttgggtattgagaaggcctggtgatggggcccctgagagcccaaagagggtgcagtgaggctggcaggcagagaggcgatgtcaaggcctgacctgggcaccgtcaccttgcattccttgcaggagtggactggcccatgcaccccgagctgcctcctttctctaaggcgcaggactcctctctagggagctcctccctgtccctgcagtgtccagtggccttttccagagtccatgcctctcctgggtgcctggagacctggtggctcttgcctttctcatgccctttctggatcaggttgatgcgaggcctgacaaggcctcagtcagcaaacttccccaggggcaggtggaggtgcgtgtggttggtggaagctgcattggtgatggtggatggggctggccagtgtgtacagggagcttgctggggaggccctgggacaaagtccagagctctgtgggagccaagggattctggggaaggggcactaactgtgtggcccagtgggggaagtcccagctctgttcattgtctacctgcttggggagttctctctgtgtgagmagcagcagcagacagtcaggttttttggggggatggggtagggtggsattacaaatttggtttcttgaagggagaaaaggactttgcgggagaagtggggttccgtggccccattcctggagagtggcaggagggctgcagcatgggcttgggctcctcactgttactctgcctccagccccaccccaagtgcagctggacagaagcttcagggaaaggaggctgagagttgaccttgtcagccaactggagcaggcagtggtagccaggggctgctgtccctcaggaacactggcttcagccagcatcactgatttcaggtgtgaggagccaccgctggcaaggagcataaactgtctctgatggatcgtaaaccctcagtcccattaggggctgctggaatagaagccagaaatgcagcagtgggaggtgcagaggagctctgagggcttatgtcctcccgtttgcatgttcttgtgtactcatgggtgccaagacagttgctacttgcccatggcatctcctattccctgaagaaataaaamcgtcctgtgggttgagatggttttaggtagagggagctcagggaagggactgaaggagacttttcccccagactgagaggactggccatgctggcatgaggcataaggtccctggggccacatgggtgtccctaccatactcatggactcatgcaagccctcatggtacacatgcttatgtaaacgtgcagaaaggtgtgctctgtagacatggccagtctctgccattttaaagacttgcagtggccttagaaggtgctgcaaggagcagaagcttgtaaatgacaggtctcagggtcccacctttatgcccatcctgcagctgtgctcggatctgtgtcacagtcaaggccatgggcagtgaggaccactggtgttctaaggaagaggcagggctgcagaagccacctgtgcacatgtggccttgccctggggctgactagcactcagccccgtgtggacagtgccacaggtaagctgtgacagggcagttttttaaggtaaaggcattgctttttcacttaacgttttcataagctataccagatrcaatgcatccaatgacctcgatctatcactttgttattgctgggaaacaaaccgtcccaaaacttagaacagcagtcatttattattttttatgagtctataggtcaactgggcagttctgctctgggctcgcttgtgcatctgagttcagctggcttgcagctggggatggctgcctgggtgcctgcctgactctcccctatgtgtccccacattcctccagcagctggcctggagatgttctcatggtggtggcatggttcaagagtggaaatggaaatgcacaaacactttttcaacctctgtttgcgtcaagtttactactgtcccatagtcaaagcgggtcacttggctgaggccggagctggagctggagctagaggagtcctcacagtgacagaacaaaaagcctgggattaggagcctttgccaggggcctgaaggcagccagtctcccatatttaggaatatcgtttacaccacactggttaaaggcggtttctccaggcagtaccaggcaataggactttctgtgatgatccatctcatatgagctatatctgtgctgtccaacatggtagccaccagccagatgtggctgttgagtacttgaaatgtagctagtgcacctgaggagctgagcatgtaattgtgtttctcttcaattaattgacgttttaatggccatatatggctagaggttgtgttatgtacagcctagatccagggagaaaccctcattggcacccgtggaaggctgttatgtgcccagcacagctgcccactgctggttttggtgtgggtggccgctgggtgctgagatgtcctccagctgatgatggacagatttgcattgtgctgtgctccagagagggcaggactggggctgataccagtgctggtgtttctggttggggctcctgagccatctctgcacacttgccctgctactccctctgattggttaagaagaggtctttatcttcttcaccttttctttcaagaagcttgggagctacagatccccatggccctgaacagactgatggagactgagttgcctctctgggaaccccaagggtgttgacagcctggggcttgtgtgttgggggcctggagcactggggcaggtgtaaggcaccatattgtcctcagttggctacctttcttcactttgggggagccctgtgctggccacttcatctcggccctggggctggctctccttcctgtctgacacagtgggcagagcaacaccgagacccttgttctttgtgaagccagtgggtttggtcacatggctgtgctccagggaccaggctgctgatggacaaggggctggctgaggtcatggttgggtgatcatgcatttgccatctctagagagcccccagggttctcatttgtatgctgctgtgccctccccatgcaccaacaggaggtgggctccccgtactcccaggtgcaggctcctgagacacaagcaggtggcctgcacaggaagtgtggttcttcagagtcccaggaaaatggtagttggtgattttcaycccattttacagacagcccctcaggctcaaaagggatagtgatttgcctgagggcttcagagactgtactgagtcctaagtgtcggagttcgtggcaggtgctgaggccctagtctagggctttccctttgtagtggtaaggggggccctgtgcacagcccccagcaccctcattacgatggccatggtgctctgctcttctccctcgcgctgcttggttccccatgatggctcctgtcacacagtccagctgggactacgcttagtggtgagcctgtcctcttggcacaacagggagcctgggactcctgcagcagcttgcatggcacttggcatgagtgtataccagaaagtttgcaaaattagtacagagagagttttggagagggacaggttaggaacaaaccctggtggaactaacactgtttatttggattttgttcttggtgactgcatgggccaggccgtgcctgtgggcatcccagggcatggggacagtgcagcttgtgggtctgggcagacctagagtatcctttggagggtgtgactcaggcacggctcttgcttatgggaggtggaatgcaaggatgggccagacacaagaaacatccaaggctgtgaaaaaatggcctgtggattgagactctgggctgcacgtgacccaccttaggcaaacaaaggcattcactggctcatggaactggaaagttcgggagaaacaggcttcagcctcacatgcacccaggggctgaaaatgacattgtcaggaccgtgtctcactctcagacccgcctgcctctgttcctggkcatgtctctttttgggaaagccaaatggcttctacaaggctgctgctaagagatgattttggcactggatgaaaaaactttagcaccctcaggcctcacaaggatagatttgtagcagtgtgcagtgcaactatattggcttccaggtcccttcttgttgaatcgtccatccctgggtggtttgtgccgacagacctctctcccagtgatcaccaacgtgccaggatgggctctctctgtacctccttgaaccccctgctcatccctgatccagtcaggatgtgggcttctgactggacttggagtgagagtcactccagctggaaacaggcaggaggaatgttttatcaaggaaaatcaggtccctaaagccagacagggtcccatgcctcagggctggggtgccatgatgcaggctggggtgccatgatacaggctgtgcgttggcaggattggtgcagggactgagggcttgcactgcctatctgctgaggccaggcccgctccagtcaggggcctcagctggccatggttggtctaggagcctcatgttgggagcagagggaggtgaaggggactggggatgctagggccagggactgccagcaaatgtgacctgaaggccagaattgccgtgattgggcccatatagggaaagaaagagagcttgtcatgaatcaagggcactttctggccatagaacctgttggatggcatccaacctgtrgggggagacagtcagccagggctggacactggtgaacgctgctgggtctacgccggcgtcctccaacctctgtttacgggaatcactgaggctgacttggaccctcatttttcgtggtggcctgcatgggtggaacgtgttgcagttagacaccctccygggtgcattcccacttaaagatgatttttcttttcctcctcttctctcactgctcagatatccgtgggcttcaaagctttctggaccaggcctcgcggctgggccttgaygtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggtaggtcatgggggcctgaggcctcaggggcctggtgcccagggctctgcagaagatggttcaggtgggctgcagggcacagtcgtcttacgcatggcctaaacggacatggagacccgtaggtgctcggcccacagcactcagcctgtaaggggggattctctgagcactacttggctcctgatagttccctgacaggtgagtcaaggcctgcccagcctctgaaragctgtggggaggctggtggaagcctgtttacaagtcactgacagagatttctgaggcaagactcagcccttttttttttctttttaattttcctctctttgttgacaggtgtaagcctctagggataaaataaatttccagctttctgcagaggtgggtaggtctgccttgggatttcttagcacctggaggaggtgtctttgcctatcgttgaaggatacattagatgttcttatttttttggcacttgggctaataatcagtgtgaatttcttttaaaaacatctctgttcgaggttggagccttctaatgaagacagggcccatcagtttaagaatccattrgttagtaaagaatccattcatttgtaaagaatccattaatttgagaagaaactagaaataacctatgagttggctgattggcgctggcccaggtagtctaatggcagagaggtgagaggctggagttggcaggtctccctctggcctgggttggttttggggggtgagctggggatgtggtatgcctgggagcagaggcagattgaacaggtcacagggtggccaagggctccctgcagattctccagacaaccccagtcaccttgttggccctctctgattgaaagtaaactgaagtgaaacatgacattatactaattccatttgatgtactttgcttgcttattctgcttttccttctaattaattattactcagaatgctacctcatgcatcaggagccagcccaaagcccactgctggggaacttaaaatttggaatgcttaatgtggtacaactggccggcagccctgatgctctctgctaatcaggccccgaatcacgccggtggtccgccaggctgtgatgtcctgtcggctcccggcattttcaccagaacatgttgccctgtatgaagtgattcagtccagtaatggacagcctgggattagcagcactaacatgtccattctttctcagaatatacccagctgtgtgtttgcaaaagtctgctcaggggatggctcttcttgcagtatttccccagctggattctgtactggtgatggtrtcgactaatctcatcgctggccccctcccktcttgcttcttgccaattccttgcccgttccccttgcttcctttccttcttgctctgctgtgaagcttgggggtggaaagactattggctttggagttgaatggatgtgggggcaagtcccagctccttgacttattatttgtgtgaccttgggccatttgcatcaccgtcttagcctctgtttcttcatctgttaaaagggatgaaggagacagctatgataaagcatttagcatatagcttttcaagaagcatctgttttcttttcactgcacatattcatgcattttcgttctagaggattttagccccttcctgtttctagccctgtgaggatttaacacataactaagactggcctaaggatgttattgccaagtggttaattatgcaaacgcctgcagtggtggattcgctgggcttgctttgtcctgcttgcattgctgggtgtgatgggaatggggaaggctctggggtggccacttttttttttgtcagaccattattttatttttaaatttcaacttttattttaggtacagggggtacatgtgcagatttgttacatgggaatcttgtgtgatgctgaggtttagagtacggatcccatcacctaggtggtgagaatagtatccaataggtcatttctaaatcccccaccctctagtattctacagtttcttttgctggactcttaacgtcagtcaagtccctgggattgttggcaggagattgaggggaacgatggcatttggactttgggccaacagctcccaccgtagtcttcagtctccgccgatgataagagtcttgatccctgttctcatgcgcctgycattagtagggaggaagctgaggtttcttgggtgcccacgatggctctggccctttgtgcattctctaatcctcacactttgcagacagaggaaatggaaaagctaaagatgttaaatgacttacttaaggtcacacaaatagccacttaggcattgaacaggattcaagtccggattttactccctccagagcccctctcttccatctgtgatgattccaggaatatcagtgtacagcactgcacttgytggagtggggaaatagggcatgctggcttcatcggggaagatatggttccactgtctctggccagggtttggcagaggttctcagggtgcttatacgcaaagcattttaacgtatctcctaagtgtggtggggaagaaatgtggattctggagtaaacatgagctatctgactggctagcccagtaggtcccctaggaacacctgggaatgctgtccctgcacgaagccttcctcaccacctggaggcattgcatgggcttcttgagcagactgacccaacctcctctttgttgtgacaaggacaaacgatgttcacaaggatgacacactgccagaacatgtcctgaattttatgaagcccaaagcacagttaaggaggagtaaatgtctcctcagcacccccaacacatcaactgcatgtcaatgttatgcagcatccgggatggtacagatgagctggagttggcatgggctatggggctttcctagttgtaagttctcctcttccctactcaaaaagcctagccaaatgggagtgagtgaggaagacggagctgcttgaatcttttacattttgcaaaatggcattcattcactgaaggtggctgttggcctgggggcacatggcaccaccagcctctctgtgattccgcttcacgaggggctctgctgtcggggcctgcaggttctgtgagcctggccttggcagtgagtgggtgagtggaagagttgtggcaggccaaggtgctggggcctgcctggggaccctgtgggyttgtgtgtcaggccccacctagagacccctcacatccctcgctcagtctttattccacattcatcctctgaggcctcctcagcaccatcttagtagccaccacaacactgcatcatcttaaaaaggtgtggagaggctcccctcagggaggatggggctgagggtgatagaactcaggtctccggatcccaggcctgggggcaccatggggctgctctggggactgccaagggtacaggccatggaatgtcccttcctccaggggggcctgttctgccttgagcttgaccttggagccctccatgtgagtgtgggtggctctttccaatcataccctaactggggagtggattggactcattggatcctagttgggccttggttcttctctgggctacaggttgctaagtgggacttcagtgcacagtgacaactacctatgatgttctcctcatgcaagcccatcagcttcctcaccagctggggatcatggcccatgcaattgctgaagtgaccaaggcagcagctgctgagaggggccttgctctgggaatcctgctggtggctgctggagctttctctcttctgctcatggctcttcctgtcacttctccagcatttactgagccccagcctgtgccaagttctatgtgggcatgtaggctgttgtccctgctctcacagggctcccagcttggtggggaggactgaggtatgaacagacccttttacctgtaatggcagaggtgtggccaagtcttgtaagagcacggaagacagagtgatgtcctctggccagggagagatgggatcatcagaaggtcaacggaagcttcctggactaggtgactctgggtctgggtctgtaggaatgaacttgcactaactctgtgaacaaggaagggctggagagaggggtcaggggatccctactgtattcaggaacttgtgtgtgatgcagttgcagtcatgggtgtgcaggggagggagtggctggagctgaggctgggatgtcagcagggagggctccctagcctggggcaggaaatccagacttcaggactgatgtgttcttggggtccttttcagggtrttagaggttaacgccctacagtttacatgtcttattgttgttcttctccaggtcaggcttgatggggagaactccagtccacagtcatttggccctgggcttcatctcaacttcctggagggattctgttcatctattcatctgtcatccacctctctctccgttcatccattcatctgtccatctactcatccatcatccaatcacttactcacccagcaagtaccaattgggagcctcctatggatgaggaaccctatcaaatgctgaggggcatggaattcagaggcagtgcctcctcctstccaagactggctatgatatggaaagtcgtggccacacaccatgccactggtgggcattccagtggctggcagagcagctgtgccccagggctgtcatccactaaggcctctctcagtgtccatgggcattttgaggactccagggctttgtcctttcacctcttatttattggttctatgccactgtctctaccatacataggcctccctctttccttttgtttcctctgtatttcctcctctcccttctagtcttttgttccactggaaagagtggaaaaattaaatgattttaaactgtttgttttctttatggagaagagttgctgctccttctttccagttcacaaggaggcggggcagcctgcccagccctgatgtccaggcaccatccgtttctgtatgtcctgcagatgttggataatctgtccctgtaactagaacgtgctgcctgtaggccagggaytgtgtgatgttcaccattttatttcctgagagcagcatgggaccttgtctacagtagtgttgaaggactaaatgaatgggaatttaatatttcttacttccaatagaaatggggtcagctgtttttgtgtgtgtgtactttggttgcctgtttggctggtaaacaactcctaggccagcacatcagcaagggctttggtctgaaaactttggctagtgggaaggcttacatttgcctaagagtgctgccttaggcctgggtggctcagcaaatgaggccagggctgctcctgcaggtgggacrttcctgggcccagctgtggcacatggcagtggagtgtggggtgcagagagatcagcgtgtgtggtggtggtaagcagcagtggagaaaggtgtgggagaccaggcatgcatttgtgcacacacacacacacatgcacacatggacacagcttgatgcaatgatacaaccagcagccacatacactggtacaaccagaccctcagactggcacagcccaacaggcactgacacacacacaaacacatgcacctgtgcagatccacacatcaatatgcatacacatccaccaggaggagagcattgctggtggcagaacagtctgggagaggtattctgtctttggaaaagaaatggcagctacccagtgacagttgcagcagatggcattgacctctgcagttagataccagtgatctctttctgtagagggaagaacaggagaaagaacagcagagagaaaagctggttagttggacagctttccgttgctctggtacaagatgtcacttttcatccaggctggatggagttaggttaaggaaaaaggtggaaggggccactcccaacacctctcccagattggcttcccaggcatggagtgtgcctggaggtcaatttgatccttcatagaagcccagcctgggtttagtcctgtcttcaaatcaattgcttctcagagtttgctgcagtgagtgaagctcccgcaatttgaatataaagactgtgctttttaatacatttatagcaaaggtaaattagcaatctcaacgttctgttgtcccacatgatatatgcaaatatttctcactctaacaaggtaaatctttagcagacgactttatcactcagagctaggataattctgtgccatttaagtatcatttaccagaatattttaaattactaattaattataggagattaatttttgaatatggccctgcatttgcatttaattatatcccactgtttacagattttaaagccttagcactttagcaaaagtgcttccagtctgagaaatttacattttctcttagaaattcttagaaataaggtcacaagaaagaaatgtttctagattttgttcagatgggcttggaactcagcggcttcaagaggcagccagaacgcggggcctggctgagttcaggaagggaacagagagctgtcctgttaggatctgtgtttgaggctctacatggctctgtccctttcctcctctgtccccaccatcctgctcatctttccaaagcccctgagtgctggggaagctgctgtgagctctgtcccggtgtcarccagcactggtcttgcaggcctctggcatcctagtccactgtcccctctccatgacagcactgtcacatccctcagagcctgctgcctcctgaacacacctccattgccacctcatcccagagctagccctgcacccactgcttgtgctgtgaccctctattgcatctccctccttgtgtgatctgggaatgctaagggcaggaactggggcctgttaatctttcttaatcacattttcaggggccatgcattatggttggtaaacagatggagggtgggaccccaggagcaccgacttctgtccccacacaaacgttgtctagaacttcgattgcccactgggcaaatgaaacacattcttaacactccagccaagcaggagtgcccaagtaaaacattgtaagaatttaatgtttgatttttgatatttcaaaggagcatctaagcaatcatcaggggaaaaaggcctgagtgccgctggactttctggtgtttattttctggttggctgttgtttctattttgagttccatctcaaatcatgccatcccattcttggtgctctggggtgctgaaagccttacagagactgtctgggaggcctgtctggggtcaaagagaactgtgaacctgaagcatgggcctgaagacacctggtggcctttccttcctttgtgggtcattaaatagcggagcagagtgtcagctcctccctgcagagtatctatggcttattagcaggtagcccctttggccaaggaggcagcagacatgagaaataggcatttacaaagggaaacagcctgcagcagccgaaatggctcaattaccctttctgctcccggatccccaagggtgttcagccttgggggggcctcgcctctgagcctgaggtgagtcagcctgcttgttgactgaagagctgattggggagctcagcggggaagctgtaagaagacgtggtgggatgcagggggagggggcgggtcatgagaggcagaaatgagagagattatctaaattggtatgaatttatctcagagaagctatctgtgccatgtagtccacatctggtgccattctctgcacatggcatccctaaacagagccctctcctggtgccggtgagataagagagttcyctgaccccactcgcaggacgtgtgatagggacgtggctcctttgtttggctgcttgctccttacgggatggggggcacgcagacgggcaggtgcaggaactggggtgagcgcttttgggctctggccccacggtagcactaggggtgggtgcctgtgactcccaaagccccagtgggcatgttacagtgctcttttagctcctgccatctgcagatggcttaagcgttaaccagctcagcgccctcttggtactcagatccttgtctggcaaccaggaagaatcaggtcacacagacaagttaaaggatggtaaatgcaggggattttattgccagatggaagtggctctcagtaggatggatggggagctggaaaggggttggagtgggaagactatattcccctggaattctaccatcctgcagctgatcttctctctgaccgtctccaaccgaactcctctcgacattcagatgctccttctctcctctccttctctactgtgtcgctcttctgttcctctgcccttctgcttatggagcctgggatttggggtttatatgggtacaggcatggcaggccaaaaggcaacatttgtgtgtgaaaacaggaatgactgttcccatttagggctgtgagtttccaggcttgagggtggagcctttgctggggaacttccctcttctacccagtatttcctggcctcctgtctacatcactggtaggaatctggccttggtcacctgccatctgtgcttgagctgccagtccccttggagagaagaagggctctgcatcagctagctgtgtgcagtgtaacaaaccgtcctaaaactcagtgtcatgcaacagtaagcatgtgttgttactcatgaacctagtggtcagcagacctgggttagattcactggatctcagctgggctggctcatgcatctgggctggctggtgaggatggcactggccagctgtaagctggggtgatgagcctgccccttgacaagcacactagcccaggcttattcatgtggcagcagcggagttccaggagaccaagtgtgagtgctcagggctgcttgaagcctgagctcagacctggtgcattgtgacttctactgcaatctcttgtccagagcaagccatgaagtcagctcaacaggcaggggaaagagactcctcctctagatggaagactgctcttgaggggggaactggaaagtcacattgccaagggagtggctgccttgaaggacagagagttgggaccattttgttgtccatctagcataggccctagtgtgcagatgagcttcctgggtggaagcagatggtggcagttctgcaggtgacctggggccatgtgccttctcactcttactttgcttcaacattgttcaactttggggtgaacatggtaaagagggggatgtggagcagagggagggatgaagacaggctttatttatcaagttcaccatattcagaccctgaaactcaccgaatcttctcaacaatgctggaagagaagggctaggatggagctttgagcctgtggggattttggggtttgctcatggtctaaaagatgaaaaatgacagagctgggctatgaatgctgaacaccctgactcaaagcccagcttttttctactatgtgctgttgggagaggaggcttgttgccattgacagatcaagggagagcccatttttctcctggagtgtgacacagagcagactaggtgaacattgccacggagtagcaggtagcatgaggagggggactggacacctctgaatgctcatatggagatggggacaacccccagtcctctctcggccaacacatctgcagagagcctgaggggatggattggctgcctctgtgtctccatggtcaactagaagagcagtttctacaacctcccaggcacccgagagtctgaggacattttatataggctttctgtctacagggcagggaagggcagagtccaggcagacccagcccctttcttgccccgctttctcaccatgtggctttctgagctctggttcctcatctgctcaatggagtcaatacttgattcacaacgttcytctaagtacagggtattttggggtgtaggctttcctttttcctttctcacagtgcttgacatgggtatgggtacccagaacatgcccagtgactgatgtgtgagtggggagatcgatgagtctcagaaaatgtaaagatatgggcatgaagggcgttgagaaaagtgaaaaaatcttctgtgaccctgggcaaggtcaacattctgaagtttgggatgtgctagtgcttgacatcagggattgggctggtgacctgctgctaggtcggtggacctaggagagaagtggcaaggttggtgggccgttaccaggcgtgtgtatgcttcacctccctgttgcctgctgtgcagggcgtggtatggcctctccctctccccagtgcattactcacatatctgcactatcaccaaagtatgctgtgagcagtgtcagggggaaagcaatgtacagggttgtggtccacagttcgagtcatggagcctgggggaaaggagctgctgtaggagacaagtgtgaaggtaggggagaaaagaactggagggaggtagatcatcacaggaaaagcacacatgaattcccccaaccccatccaagaagccctgggtacatgggcacagggagggcagatggagggtttcctaccccagggagatgcaggacttgaaccacttcgatttaaataagaaaaggcagggcagagcacccaaggatgtccctctcctcccacacccattctgcccattctcctctcacagaggaaacctgaggctttcagatgctcagctggggccacgatgatgcttttctttccagggctggggctgctggtggcacagaggaaggggcattgtccttggagcaaatggacacagaatcagagcccaactcttctatcagtgccatctttttgaggctatttactggtcataagctggagtattaacaccttcccagagggttgccatgggaattaaatgagggaatgctcttgagagggcctggtgcaggggtggtgctctgcaaatcgtagtttcattattgtgcctgtggatggtgtttggctgagattgtagaaccaatctggggctgttggggtcaaacattgggaggtatcagtggctcagagatggggagctgtggccagcctggcagaaggatagctcccactcactctgtgtcaggaagcatagctcacagagccaagtgaggaaagccagatgtggggtgcacctcgggtggtaaggaggggctaggaaaaagtgacaaagtgctcacgatctccagccagcccagctggggttgagaaccagcttgtggtccagcactcagctggagaggatgttagagtccaagagagagsgggagaagaggagggctaagtgctgcctgggctccagatgctggctaggcactttcggatctttttcaggagcagggtgagagttcacagggcacctcccatctgggctgttattggagcacatgagcaggagcagctactagtggcttctcaggagtgctagttactgggctgatagaaggagggacagccgcgggtgctttctgcctgcagagttactcttcagatgagaaggcatctctcagcagcctgtcggtggccagtacgccactaagatagaatgggctccatccctggacctcttacactgggtgctttgggggagaaagacatggtctctgcccctgaagcaccgccagactacactagagagagaaaacatacactcaggaagaacagcgactactcagttggagactgccctgtgcctagcgaagcagggtgggaagggggccgcatagcttccccttctctctgccctataatgatcaaatgggaccatcccatccaggctaccacatgaactactcttggataattctgtaacttggagcttgttaagacaatcaaagggtcagagaagaatggctaaagccaccctttggcgtgacagccaggtcataaatccaaatgcctatggcatccaggcagggatattaaggcagacagcaggtgggctgtaagaactgagagtattgcagctgcaggcacctgggggaaacatccttctctgaagaggactgtcaggctctgccaagattcccctgagaaggcctggtgtggtcactatttcttgtgtctcaagaggagccagaaatttggacttcctgtgaaatctcttagtttttaaatgtttgtagctaattacaaaaattctgaactctttgttggccaactctgcctgtggcagggctgataaggcttgcaggctgccaagtggtaatgtctgatttattgcatatatactgtcaacttaagctcattaactatgagaatagtgtgaagcsagccctgttctcctttcccagttctttcttgctgaggataggcagtcattcttagcacagtggtcctaggagttcctatttcttttctttttcttttttttgtttttgagacggagtctcactctgtcgcccaggctggagtgcagaggcacgatctcagctcgctgcaacctctgcccctccaggtttaagcaattctctgcctcagcctctggagtagctgggattacaggcgcgtgccaccacgcctggctaattttttgtatttttagtagagacggggtttcgctatcttggccaggctgatcttgaactgccgacctcatgatccacccgccttggcctcccaaagtgctgggattacaggcgtgagccaccacgcccggccgagttcctgtttctttccttggctcctcaaggtaccacccctgttttctgtgattccaacatccttcttacttttgttggtgggtgtgacctgccttaggggtctccctcatgcagttgacccttgaacaatgtggagattaggggaaccaaccccccatgcagtcaaaaatctgtgtataacttttgactcccccaaaacttaactcctaaagcttactgttggccagaagccttaccgataacataaacatttgatcaacacaaattttgtatgttataggtattatatactatattcttacggtaaagtagagaaaatggaattaagaaaatcataggaagagaaaatatatttactactcattaagtggaagcggctcatnnnnnnnnnnnnnnnnnnnngtcttgctgtctcatgggtggccgaggcggaagagatggaggagggaataaggggaggaaggagaggcagtcacattcagtgaaacattgattgaaaaaaatccacaggtaagtggagcctcacagttccaatctgtgttgttcaagagtcaactgtagttgccagaagctcatgttctttttatccaccattgctcaaattctactctaaatgtgaactgagctctttaaccattacaggcacttttggtctttcctgtgtgaaggccagctctttagatgggtggtgatcattggtattggtttgctctacctagcagtactccacaaggctgctgctggttgttaactatcctgggactggcagctttcagttcgtgggtcttatagctttttcctttctgcatttggggcacactgactctgccggttcactctctgtgctgaggtggggagggtttcggcctgcctgaccgttagcatgagaagtagcttcctatttagggcctgagtggcaaagccttgcccattggcagtcacgtggaagccatggtgcttttatgttcgactgccagattgtcttcctccagtccttgctgtgggtgcagcacgtccagggagcctgtccatgccagtgctcaggcattactgcattgggctgtggcctcaattttcatgtttttctaaaaccatgtctcacttgcagggagggaccaacctcatcttatgattgctccctgaagttcactgaaagggctatgcagagtagatgctcagcaagtcactggctgtatcagccaggcccggagggaactgcccagttccccatatcacacccaggggctctccagagcctgggactaaggtttccataagctcccgccctggctctgtccagttccctgtatgactatagggcactgtcttgcctttctgggtttcatttgtctgtcttgaaatggattcgatattaattgggcagtgaatatggactaggctctgttctagaccctgagaatataaagggactgagacaaacaaggtccttgtcttcaagagctgacatcttagtggaggtggtggtcagacactaaacaaataaatgagtaaaccaaaagtcatgtgggtagtgacaacccccatgaagaaaaatacagtaaggtaagaagagagtggtttcgtgggggcaccactgtagagcagtggttagggacaatgatgccaagaagtaggcgtttattgagagactggaaggatgtgatggagcccccaaaacaagatctgctgcagagagattgtggcatctggaatgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagccagggggagagtggtggcaggtgacattgggcaggtgtccaagatcaaagcactgggggctttcaggcctttgtcagattttgggtttggtttcagttgaataggaagtcactggaggtttgtgagcaggtgagcagcatgatctggaaagggaccagggttaaggtgttgtctctgccactctctgactccatgggaagcagctcagggacacagaaatcctaagggaattgtactctatagttgtcagctgacagggagcctgggagctgagaatggctaccctggggaggtgctccctctgtttccctgcttgcctgggccacgaggcctggatgggtagctccctgcctggcagcctcattctgggctccctgcactcaggccgcctgcatgggcccttggtgtgggaagccacgctggctcctgctttgtgcctcacagagcaagttcgcaggggtgagctcagcctcatggcagccaccrtggcagcttcctgtgaggagcaagcaatcagcctaaagagctttgcacattattaatgtgtgtgcacatgggcctgccttgctgctccaaggactctccttgtggaagggctgagagaggacgtgccccttttcagtgcatctttcctctttctttcagcagggaattcggagaagcagcaaaagcaacagcaataacaaaccccaaccacacaaaccttccgctcatcacctaatgagaatcaggcagggctgctaccaagcccagtgcagggcctcgcctccccagggctgcgatttgtttgcccttgtgccaataggtaaacaaatcagggatgccagtgtgtggacatgtgtgggtgtgggggtgggtgcagagtttgcatgtgttccacctttgtctgcctgtttccacactggcctttgaaactgtgtgatgcccctacctccaccataaaggactcactgacattgtgggagatagtgatatgggacatcccacaccacatcccattctttgttgctcccaactgcttcccctccactctcagcatcaccggtaggttccaggctatggccctctgccctctgttccctaggtttggattgtagctttgcctttaggacaaggtggtcttgagtaggtcccccttctcctcctgtgacccagtagactccaatcctccccaccrttcattccagatcccccggggcactggcagtgttggggcggagtagtcaggcctggcattgcacggaaccaaaatcatgacatgacttgattcaaaactcaagcagttgcctggttcatcctcaaagctgggcacctttcagagcctttgcaatgatgcttgggtcccttggttctgctgccatggctctgaagtcctgtgtccctggactctggacttgagcactgcccaggcctgcacggcagggcactaagctgcagaaagtggggcccaacagttccaactgggctccccccttgtctccacccctccctcatgtgtgctcacacgtcaggggtggccctcagggtcagtcccatcagaggtagcagctgtggtccaggcatactgggagacttcagaggccagttaaaaggtgaggaaaaaataaatttatctgtgaaatggggaacactatttgcacatttaattcagtgaccaatttaaaaaatcatgactgtttctttctatgaggggcagtgtcctttcaaatctggctacttttagcttccaaaggaagataggtaaagggaagttgtataagttatccaggcacccagtggagctccagtgcyagggagaggctgagcaggaattccagctccagggctgctcattcctcttccagctgttgggtatttcttcctacgcataaggggccatgcccaggatggccgtcagcccctggaaatgcaaagcaagcacataccctggctcattaattgctctaagtgaatgtgcagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcctctctggacctggctctaagggacaatttatttggtggtggattgaaggcttgtgctacattctgggctggcaggtgaataaggcttgggttccctgttggtgagccttagcccctggccacatagtctgtcctcaggctgctggtgctcctctccccataaatggtggtggtggggggcatttgatttaacttaattaaattcaagtcaaccccacaatcattttttgcatgttgccttttgcttgtgtgtcagatctagggctcacctctggaaatagatgagtcagaggtactctcagccctagagaagtctaccacttatggatggccatcgttctcccacaagcagcctctgaccctttggcctctctctaagacaagttgaagttggccacctgatccttccagctgtttgggaagggcagcttctcaccctgggctcctccctgagtgctcatctggggagttgcgggagagagcagccttgttgctgtttgagtatgtgcctgacagattctaggggtagaggcattgcagatgtgccttggccttaacactccaggctcaatgttttccagatacttatttttcatgttattttattgtttgtgtgaaataaaattttgtaagcacttactgactacagccaagaaagtgacaactgcacttggttgatatttctgctgtttactcttgagctattagaagacatacagtcacgcatcacttaacgatgaggatacatcctgagaaatgcattgttaggcgatgtcatcattgtacgaaccccatagagtgtacttacacaaacctagacagtacagcctacaacacacctaggctttatggtacagcctatcgctcctatgctacaaacctgcatagcatgggactgtgccgaatgcaatagtaacacggtggtatttgtatatctartggtatatgtatatctaaacacacctaaacagaaaaggtacagtaaaaattcagcaatataatcttctgggaccactgtcttagatgcagtccatggttaactgaaatgttgttaagcagtgcctgatcgtacacatgttttggcctcccaggtaatagaccagcaggctccttctgccaggagcagctgggatggggctggccctgtgtgctggggtcgctggctctgtcggtccttttaggcaagtagatcacctcacgggttagcagaatggctaagcaaatgggtcaggacccaggcttgagttggaattctgtctaatcacctcttactaactgtagaaccttaggtgaatgcctcacttttttcacctgaaaaatgggggtaatgagattacctaccttgtaggtggcagattaaagaagttaggacatgtagagcacttaaaggtgtgcctagcacatttacctaggggtgttagctgctatcgtgtttaacataggcaggagagacttgggacttagggaactgaacagtggattccaagttttcattcatctgttcattcattcattcattcattcattcatctattgtttcattcatttgtaatccaaatataagtagttgtgcctcatgcagcagtggtgcctcaatgtctatgtagagtcacattagaaaaagaaagtagtggcatgcaaagcaatcctttactggtgttctttgaagaatgtcaaagaggatccttttcataactcacagccatgcttcttagaatactcctgtttctgtctcttccccttgtctctcacaagccgccgtctccccaaactctccaggtatgttacctttcatagcccccgggagctcttgcttctcctgcctgctcctctttctgttcctctttccctccaacaaaagtccaggaagcctgaggaaatggggaagatacatgggccaatactggatcccaggagcaggcagggagagaggtggattcttacctgctgtcactacatccctgctgagtgcctcctgtgagagtacctgtactgggtgatggaaatgcaggtttatgatggagccatgccctggaggagactgtggcatcacagctctgtgcctgctaatgctgggaggtgggagcctgccaatgctctggttctaccagtttccctccgaataggtctgtgtcagatgacagagtgcggaactcagtggggttccagttagggcttgatctaggaggtttaaggggcttccttttctcagaagacaggggagagggaaagacaggaggagttgagaatgtttccaactggcaggtctgcagtctgaggggagctgcctgaccttcgggggtcaagctgtcaagaatgcaggctgtggcatcagtcagatgtgagcgcaactcccagcatctcccagacccgctgtaggacttggacaaataatgtgaccttcctgagccctgagtttcttatctgtgggatggaagtcatgttctccttcacagggctgtgggagcactggcagaggaacagttagagggcagtttgtggtgttccctgactgccacctctccactgccttccctgtccactccccaggcttgtgtccctggaggaaagcatagaccacaaggttagtccctccaggaaggtgcctgcctccacatggtggccccatggatttagcctggcctggagcctccagcttaccccttaacaggagccaggaacgtatactgcactccatgtctggtggacacctgtgctccatctgacacccccgccccaccctgtgcagagagcccctgctggggaatgaggccccaccctccttcagggggttatgatctcaccgagatggaggaaaccaatgtgaatgctgtggactcaggtgcttagaaggatgctcatctctccactacacaggctccagcagtggcctctgcttacaaacctctgcacatggggaactcaccatcgattaaggaaacctattttgttgttgggtagcttgaagtgagaaaattaccttatgttaggcaaaagctgtcctgtggcttctacccattagttctggatgggtgttcttgggctacacggcaattttactttcttttcccgtcagcccctcggttatctgaagatagatgcatgaactttgtggtcttcttgatgagcccagccccaccagctcacccactggcctgagttcatcagtagttactgagcacctcctgtgtgtcagatgccctgaaactctgcagggtgtgggggtctggcagggggtaaaccaggcgaggccaccacacctatggaacttgcattttatgtgagagagggagaggcaaaaaagcaaaataatatcatgtggtgaagagttctgtaaggaattagaacagaaccatgtaatgagacatgactggggctactttcggctatgtgaccactctgacttttcagctaacatctgattgctggagtcaggcctgagaaggcctttgcttttgtaagggagacctttaccattgcaaaagtcccaagatggaattaaagctggcctgttagaggaacagagagagaatgcctgtgnnnnnnnnnnnnnnnnnnnnnnnnnnnnnnnnnnnnnnnnnnnnnnnnnnnnnnnnnnnnnnnnnnnnnnnnnnaaacatgaaagcagaacaaatatcattgcatgcatcagatgagtaagacccttaaagcctcactttaacaagtattggacaaatcggaggctaaaggtctagtctctggcaaaggctgggtcattgagggcttctgagtcttggtactttaaatacccaacttctaggggtgtcttctactcataaactttgtgtgcatcttttcccccctaattttgggtaatcctggccaatgcaaaacatgcatccctcagccaaagcccccaggctgtgagcatggccaggctcacagggagaagaatgctgcatgacaccatctcatcagcagtccctggagttgccttggttctcatgatgtatcgttagaaaacatatcagtggaaattgctctttcatcttcatcagcatcacttttgtgttgtggagaaggcccgtcctcattaggagccgaggaggaggtgagatttgcagcaggagccccctggcagacaccacaatcacaacccccacccccacccctgctcggccgcagttgtcattaatctgtatttcactcttgctttcatccttcacttgctgtttgtcatttttggagaaggatcctctctgttagcacatttggaacctatttcattgctgaggagaagggaacaatacaggttttcatctcagactaattatgcctccagtacactgatgctaaataaaaccaaggggaaggtaattggagattcttgacgtgacattcacagctttgagaaaaacagatgttcacttgaggagctgggaagagaatacatatccctgtgactggccaatgagattagttccaggaggttttgagacagagctgggccacgcctcatcctgcagatgtggcgtgaggaatctctgctaagcctgcctgctcctggctggcctggcttgacctggggtcctaggtcccagcactgtgtcccctgtccctagtcatagggaygaggtgctgtgtcctcacctgggatgacttggacaactcctgtgttgagtcatctaagacactttgtggcaactcaggtcttacacctgaaagtgcctacctgcagccttgcctcagccactcaccagtgtgggactctgggcctggactgtagcctcatggtggcccatgtctttattgtcgggtggagactacacctcattagattcctggaggacttggaaaagacaatgtctgtagtattcccagaccatggaatgtcatccagagattttatttctttgcaaacaatggcactttccagcaggttaaggctgcacctaatcctcagtgcctcttcctatcaggttgagttctttgacttccttcaatggcatgactgattggaccagccaaacactgatatctgttagcctgggaagctgtgaacaccagatcctcatcctctttcatgtgaacactttcaccaggtgcaaataataatgaaggcagttgaatgtagcttgggttaacccctttatccctccaagtcccttatattccacctgttaagtgagtgacagctcttgcccagtttaatttatagaacacatatatcagggaacaggtgtccttccctgagatacatacaggtatctttcaggctagaaaatactctggatcccaaataacttcagtgattggggcaaaatcatgttgtgttgcaactattcctgatgcattgctttctctatccaggccagggggaggtctttaaggtcagtggctgggcatggttgattggatggttgccccaagttcctcacacagccctgcatccacatgcttgctatgttctcatggtgggtggattttagtagggaattaaaaaccctgtgacttgctgtggccaagggcatgtaggcagagatgacaaacttccagttctgagcctgggtaaaaaaaagagatattggatgtttccacctgtcctcttgagtttctatcaccttcatgttcttgaaaatctactggtccaaggcagatgagaaacataaggggcctacaggagccactgagctgagctacaaacttgcagtgaggagcagatctgcccaagcaacccacaaatctgtgtgaatagatgatgcttgttttagctactgagttttgagttgtttgttatgcagcattattttggcaattactaactgatacgctgggctttatttgtgtctgcattctccacatccagcaaatctgtgcctggcatagaggaggctcttagaattgtttactgaataagcacatgaatcaatgagtgaagaattttatttggttgttaaatcttattgtgttaattctttctttacattgacacacatggacactctgaacctgagggtcttctggggtgcccacctcatctgattaactctttccaagttttgttaggatgaaagctgtgggctagcctctttcccaacgttacagctgggaaagaggggaagaagagtggtgcctgagagcagacatggaatgctaagcctggtcctgggatggccatctcagtgatggcctaaggagggcagtagtgagccccaggcttctgggtggtagaggctggaagtccccctgatgcccagctttccccccattgcctcttcgcaatggtgccctccttctcaataggtggctgctgtagggaggtgttcaaagaggcctgtggcaggtgttctgccccaagccatcttcccctcttcctgggccagccagcacagacagacccagcagccctttccatttctctctaaaaagcagagccacatggtagagcagggagagaagtggacctgggatgggtgacccagggggtgaataaagaatggaaggccgggggcggtggctcatgcctgtaatcccaacactttgggaggccgaggcaggtggatcacctgaggtcaggatttcgagatcagcctgaccaatatggtgaaaccctgtctctactaaaaatataaaaaattagccaggcgtggtggcacgtgcctgtaatcccagctactcaggaagctgagacaggagaattgcttgaacccgagaggcagaggttgcagtgagccaagatcactccactgcactccggcctgggtgacagagtgagactccccctcaaaaaaaaaaaaaaaaagaatggcagagtttaagatttattgaatgcttactttgtgctaggcccttgacatgcatttttttctttacctatgaggagtgctgtaactgaggacactgaagcctagtgaggctggaccacagaagcaggatttggaccccagccatcttcctctagagttccagctcttgaaagcccatggtctcatcctggcctgcaggttagaatcacctggagagctttcagttaggatcaaggcccagatcccatctagaccaactaagtgagatccctagggaggaggccagtcaatgagatgcttaaacatctccccagatgatctgatgacatagagaggccttctgcgacctgactatcatgctatgtccaatggcaggcctggcttatagctggggtgtgcctgcagtggcaacctggcacaaagcaatgtgtgtggttgtcctgtggagttgagacatgagagggagccagcatgggcttggagagagccctgtttggccactgagatgttgaggcaggccattgttcctcagcctgatgacagcaattcctagagcccattaacaaggccccttgtgttgggggctcaagacctgtgctgagttttgtaagccttgttcaccctgggcggtggcgggagcatatcatcttctgaacactcagtgtttcattttctttgcacgtcagatttgctctttccttctgttgttcaccatgtcttattagctgctaggctgaggccctcgctggagttaagggaatggttgttttgacttacagaggagggaaactaccttgaagcaagataaacaggagagcagatacatattgtgaaatatactcaatctataaccacagctggaagaacgtttgcttaaaaaagggtcaggagaacagaagaaaaggtcgatgaagggaaggtggaacgaatgtttgggtttctttaatgtgggaggtgtgcaggctgggctgcagtgagaactcagtgaaggcagcacacgctagggatggcatgggttggggaggggctcggagagggaagccggacagggtgggcacttatgatagccaacctcggtggggtctgccctaagacaactcaggaaaactgagtgatcgaaacacaactgccagactcacaggcattggtgtgcccttaggtgcctgggcctttttcaaaacatgctggtgaaattctgaaagtgatcaaagacctctcttgttaaacataggacctgcaaatcaaaggaagtgggaaatcagaaagactagaagggaggcagataaggaaatgcaaacaatcccaaggagaaaagcagagcagagtctggtgctggggatggcatgtgagggctggcactgctccatcccagggattctgctcttttggggagatggagctccttctggaatattgtgtatacatgtctgtgtgcacatgtgtgggtgtgcatgtgtatgtgcatgcatgtgtgaacaccttctgtcatggaagtttccagtcccagaggagaaaaataggacaaagctccattccaagcaggcagaataataacagctaataaccttttgaggcttaccacttttctgagcactttttttgtttatcttgtcgaatcccctaaattccacaaggtagggttttgttaaaatctctgttttactgggggaagctggatgcaaagaggttatattgaagtgggaaaagttctcttgtccccctcgcagggtgtgcgatgggggtgtggctcgcttcttcagtgccccgctgctcaaacctctaggggagcatacagacgggcaggctgtggggctccgaccccatggcgatgtctaggagtgaatgtttacagctcctgaagccccagtggacatgtgttacagggtgctctcttagtttgctgtctgtaggcggcttgtgttaaccagctcaattagaccctctaccttgtcgcacggacaaagggctctctgtatcccgggttcttgccttcatgtactggaagaattggatcacacgtgggcttggagaatgagtgcaaggttttattgagtgggagtggctctcagcagatgggggagcaagaagggagatggttttcccctggagttgggttgtttggcagcctgggttctcctctgagtgccctggccaaattctgcgttgttctgctggtcagtggctggctggcctcccggtacctgctgaagtgctcctctcgatgtccagccacctgtgtgttcccccgatgatgagctcctctcaatattcagctgcctgtgtgtttgcctgttagggtctcagcatttttatgggcacaggataggggcatggcaggccaggggaggtcttgggaaatgcaacatttgggcaggaaaacaaaaatgcctgtcttcacttaggtccatgggcacaggccagggagtggagccctagccagggaccacacccttcccttcccccattctgtatcatttaaagggcccatgcccttcccttcccacctcctgtatcaatataactaggccaaggtttgggccaccctgtggggtttgccactgacatttgtgaggcttgtacatcgtacctgccragggacgcccttcagatcacggtcctcatggctgtgcattgttatcagggcacacctccagcagtcaaaggtctccagcagaatagctgtttgggccagggcagggccacagggctccaggttccctcccagagcagctatcgggcagtgagaagaaggcacctggataggatgcaggtgtgccgtggtgccacctaaggcaaagcgctaatactcagtgagctgtcaccaggcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttcctgctgtgcctgcactgggaaagcttccttttcctagacttgtcatgcaggatttgtgtcacttggtgttctccgtaggcaggtctggccctcactctccacaggagtctggattctgtcaccacaaagacccatctaggcttctgatctagaagtcctctctcgtagaacttcacctctctcctcacctcctccttgttgtcarttcattttcctcttcacccctgggctccttcacctccccagctccattctctatcccatcttagccgccacctccaacggcctcatcctggagcctgcccattcccggaactctccattgccagcggccatgcagtcctgcccttcgttcccttgcttccgtagacatgcccgtgcacctcaccaagacccctcttctcactgcacattcctgatcatctctgatgatcaggaatcagagaagtgaatgacttggcccaagtgtgcagcccaggaagaaatgtttgacttgaactcaaggctccctcctcccatccccgcacmtgaagcaggctcctccctctatccccacacctgaagcaggcccattctcccatccccacacctgaagcaggcccattctcccatccccacacctgaagcaggcccctccctccatccccacacctgaagccagaacctccctgtattcccacacctgaagctggcccctccctccatcccataatctagatgagattttgtgttttgcttttttgacctaacatcctgggataaacatttcctgtgtggttgcaaagcctttctaatcgtcatttttagtgattgcattgagatgaagaattgttattgcataccctacctaatgtttcctgttgttggacattgtgactgtttccaatcttcaatttttttttgacggtgttcagtgtaaacctgcatgtgcagtgtttgatttttctcatttggattattgctgacaggaaatttcctagagcaggagcaaagggtcagggaaggacagacacttggggagctctcagaccctggagctcatggtccccaagaccgtggtcttgactgccatgctgagcagtggatatcatcatcctcctttgcaattgggaacactggcctttccaacatcttctctcacaaggcttcctctccctgaagcagcccccatcctcttgtcccccttgcataccatgctaactctaccatcattttcctctccccatcgcggctcctcagggcagcattcctgggtgacctgtggtgcccaggccagttagacacatgcacagtgcccgtgcttttccctcagggtgcagacttcactctgcaatgatctgtctgtcacaggcttatttgactgatgtcaatctctcccctagattccaacctttgctggagaggggggatggcatctttctctccacagtgccggctctggtgcttggcacacagaagaggcttcagtgcttgctgaatggggaatgaaggctctgtgtgccccggacactgctggggaggggcagctggcccctagggctctgctttcattgaagagcgtgttccccacccaatctagatgtgtgcctcagaaggctaggactcaagtgtgggaattgtgtgagagccacaggaggcaagaacagccagtgctgtgtgttctgaagagatagcgtggtgcagaatcaaacagggcatctgtaacagacagaccatgcttctgaccggctctgtgctccacaactgtgagaccttggccagagcgctacaccctctgggcctcagtttcctggtctctgtggtgggcacactccaggccttaatggacaggcataaccttgcccaccctcactgtcttcytgggcagactgaagctatcccagtgcctatttcatgcagctctttcctcaggtatttggggtaacagttcttgagaaaacatggctcgttaaattgaaaagtgcttctccaacttcctgggaaagaggatggcactaaccctgtccagatcttcagagccaccgtaaatcacttccttaaaaatcccaaacttgtgtgtaattatgkgactatgtaatgaagtcagaagtgggtaggattgatttgtcaggtgaattaatctccacagcaagtggaggcacatgggggcacgaggcctgtcacagccttgtcacctgctgcaggcttcactggcttcctgctctcaatgctgtaccttttgcccccctgtccgctgtcgcacaccctaggcacttcatcggccatgcatgaaggtccagtgcactgtctcaggccgggtcctgggaataagataccaggctgaattcagctggacctgaccatggtgcatgctagggtgtgggtttgtgtccaacattgaagggacagaggcagagccctgtggtcctgagggcctggagggtggggcagctgggccaggccctatggaacaaggcaggaatgactctgggcattcagtctgccgaggattgcccctgatgtatggcatggaaatgttctctggccgcagaggagctggtgctccctttgtgtcatgctgcctgtctgctgccagctagggctgggggccttgtgaagcactgagcatggtgggcatgcacctgtctgggccatccttgcagcagggacctttaccctgggagggaatcctatgccctggctaagcaagtgggtgtgagttgtgcccctcgtgggttggaggaaacaggtgtgggatgcctgtgccgggccttctcgtgggtgtctggccacccctgcacctgctgaggcctggcttccagagttggagggaacttcacagagcaggcgtggttgggtctggggtcccaactgcaccctgagctctgagctgggctggccagcagctttgcaagaggaactagccccttctacctgccaggtttggatttgaaccctggtccgtatgtctccaagcctgttcttgttaaagaacagggtgggcagagagtggagtggtgcctaccccgtgggataaggcacctacctctctgccagactggaacaagtatgcacatgtgcacccttacacatgtgtgtagctgaagagagtctgaaggccacatcagagagccatgcttatgagggaagtgcggcagggggagctgtcctcctgaggccaggaggaacagttgtgatgaatgagattgggaggcaacaccatgagggctgtgcccagcatctgtcactggatgactgattgattgccccatgtgcagggttcagcccaacagtggttagtaatgattctctctctctctcgtgacatggttgggccaggggaggtgggcagtgtcccagggtggccttaccctctgtccttgctacccttgaggtacaaggcacacacctttcctaagggccccccactgtggcaaacgtttaagagccatggctggagcagaacgtgagatgctgtggaatgaaggggagcctgttcctgtcccctaagaaggcattacataagcagcatcgggagtcctcttcctccggggcctgtctgcagtttcactgcttgtccacatgggctccagctcccatggctgaygcttgcttgggggagcctaggcctgtggcctgggggtgcagttgagcctccttacatggcataatgtgaatctagccctgggcactaagctgaggctgagagggtggcagggaactgcgggcctcatcacaggctcacagggaatgactgagggcctcagaattccccacctgggccctatagggaattgatggccagctctggtctctggccccaggaggtcagcctcaggtggcagagtggcagccgactctggtgctgtcctctatcctggctccacctctgttgcacacaggggcttagtgggctgaccagtgaggggtgtggtcatagctgccagccccttctgcttgcccatgctgactttgtcctcttgctttcctgctgtattagcccatttcatactgctatgaagaaatacctgagactgggtaatttataaagaaaaagaggttaaatggattcacagttccacatggctagggaggcctcacaatcatggcagaaggtgaaggagcagcaaaggcatgtcttacatggcagcaggcaacagaacgtctgcaggggaattgttcttttataaaactgtcagttctcatgagacttattcactatcacaagaacaacttgggaaaaacctgccctcatgattcaattacctcccactgggtgcctcccatgacatgtggggaatatgggcactacaattcaagatgagatgtgggtggagacacagccaaaccatatcacctgcccttccataggcctcgcagtctggttttgaacagaaaaagaggtttaatagattcacggttccacatggctggggaggcctggctcccgtcccctgggcctcttggcactgctcccaggtagggcctttccaggactgggcacatttatgttgtggggatcaggcctgcattcctccttagaggaagaatgattattctctgtttaacataaagcaaatggtgtggcagcgccgggcagggctctggaacaccagccccagttttccctgtcaatgagtgggcatggggtaatgccttgtccacactaagccatctctgtgaaatgggcctgtgaccctttcttcagctgcccaggcccaacatcttgatgctgtctttgctgcttcttcctcatgcccctcataattagtccattagcagttctgacaccatgtgtctggattctgattacttctcaccaccccaatggctatgtccctggtctaagccattgctggcatcagcctcctgacctgccttcctgcttctcaccttgctccatgcagcttgtcattctgaggcagccagagtggcctgttaaaattctagctgatcatgtcattaccctgctcagagtcttcctgtctcactggggttatagctggagtccctgtgtggacaaagcagggcgaacacacttcctggtctatgagggatggtccccacttatgccttttgttccagaagaaatattcgttctcagaatcatcctggtttgctctttgtgaatgcttatagcggctttgttgtaataaccgcaaactggaaaccatcccaatgtccttcagctggtgaatggataacaaactgtggtacagccatacaatgraatattattcagcattaaaaagggagtttgagaccagcctgagccccataatgagactctgtctctacaaaaaaataaataaataaaataaaattagccaagccaggcatagtgcatgccatgtagtcccagccactcagaaggcttaggtgggaggatctcttgagccaaggagattgaggctgcagtgagctatgattgcaccacactgcactctagcctgggtaacagagcagagtgagactctgtctcaaaaaaaaaaaaaaaaaggaataatgaaaaacaaaccaggaacaaactcctgttacatacagcaacatgagataattctcaaaagcatatgctgagtgacagaagctgcactcaagaggcctcatactccataatttcaattatgtgatgttcctgattggcaaaactataggggcagaaaactcattggtgttttccaggcctagggataggaggattcactacaaagagccataaggaattgctgtgggcaatggagctgttccgtatcttgattatggtgttggttacattactgtctaagtttataaaactcataagattatacattcaaaataatgcattttgctatgtaaattacactttgatttaaaaaacaagtcctagttagggtgataaattatacggtcattcaacctctaacatcttacctgattcatcctctctttgatgtcacctcctgctgctcctctcctggatctgttattccagccacccaggctaccttgctgtcccatgaatatgccaggtggacccctgcatatggatctctatacttgttttcctctctgcttggaaaaatcgacttccagatagtcacgagccccttctctctcacttccttaaagtctttacccaaaagtccccctatcagtcaccagtgaccatttaatggtgcataacaaacagcctcaagtctcactggaatccagcatctcatgcaccctacaggttggtggaggtgcctcatccaggctgggcttggtgggctctgcttccagctgtgggtctgtttgccagcatctcggcaaggccaagattggaagagcagcagctacccaagagacactctcttttggccatggcacaagcacaagaagacacgtcctgcgtgtgcacatttcaagcttttgcttgtgctatgccagttaacatcccattggctacagcaagtcaagctgtgcagtatacgccacctacagggaggggagtgaatattaccaataatccaaacagtccccatcaccttcccaatgagggcttctctgaccaacctgtgaaaactttagcccccagcttgccattttctctccctcctctctgctttattgctttcctaacactcctgactgtataacttattatacatttcattgattaatcttgtttagtttctgtcttccactcactggagtgtaagtttcaccagagcacaaggacatttatttgttttttttttaatcctatatctccagcacctaagaaaaatgctcagtagatatttgactaaatgattgaatagggttatgctaagaatttattgagatgatatatgagacatgtttcaaatacagtcctgcacacaagaagtgctcggtaattggaggctcttatattctacagcctgcatgctgttgggagagtcaaggctcagttatgtgtgtgattacaatactttgcacaataagcctttgaagccagatctgctttaagtttggcttcagagataaggcgctgaggcatggagaggctgttatttgcccagagtcacttggtgagtcagggtctctttgccctgaagctcatgcacttctccccatgctatgctgcccccacaccttcctgcatgctagttaccaggctctggcctccttccctgcaccagcatccctgaggagtcaaaataactgatgatattagagccccagccccatgagggtgctgaagttggccccagatacccctcccagttatctggaagccagttgcaatgcagggcctctggaacactgagggctgtcctgtgccacccccagccaccagtggcccctgtgcatggagaccccagagaagctgctgtctgcagactctgaagcagtcggaccctgaggatggacagatggctgggcctctggtctaaggagatcacagacacacatgctcaggaaaagcataggccccttctgccaggggagagtcacagagggagggcttgatggatgggatgtggggaaatttatgagagtcatttcatttggtctgtgaccctttatggatgacattgggttggaggagccagactgtgctccaatgtgaaacttcagaaagatgaatttgaccttgagtggcagattctgccctggtgaagggacaaggggcctgggtcgtggcttctcggtgccttgtacacacatctgtgagggccctgccatgatgattttcttgtagtggtgtgttcgtctgttttctctgccagactctgaactactggtctctgtatttccagtgctcatcaggatgcttggccccaacagcatctgcatgtgtttgtgaaatgaaggatttatagagcagtcaccatgggcagggtgctcagcacccctcatctatgattcatttgactcttacctgccccaggaggaaattgctgttatccctggggatggcagagctgggttatagatgtggactcagaaccactgtgctaccttgtcccctgaaattgaaagaagttctggtaccaacactggtggttagtggttatgtgaccctggaaaagccagtgtaatcactttggacctttgctttctgctctgtaaaatggggattacgaatcccattagtcttacaaagaagagggttgtgaaaatcaaaccagagtgtgcttgtgttgagtgctctttaggtctgaaattttattactaatattatttcaagtgggcatcaatggcagtcaataaataggggagttgtagcagaagtgtgacaaaagagagggcttagagaagcttaagtatgacactgatcatttccagtaggtaaacgtgcaaagaacatgatcaaacaaatcacaagaggaaatgcagcttgttagcaaacatatggaaaaccactaaaacttcagttgtaatcaaaacaatgcaaattaaaacaggatgccgtttttcaccactcagttaaagaacatgcagtgctggggagactttggtaaaatgaacacttgcccgtaacctggtggagatgttctggaaggtaaattagtaatgagtatctggaactataaaaatgtttgtaccttttgacccagtaattcaatttctaggagtctctccagagggattattctaaggaagctttctgcatgaagttgttcaaaacagctgaataaaaaatgggtgataatctaaggagccaatgttaggggtgtggttaaggcaatgacagtatccaagttatagaggatcctgcagggaccgatgagtgcttgccaaatcgcatcagatgactgtgtaggctctaagggaaaagcaagacacaagaatgcacatattttattacaactatgtaagattctgtagggatctttgcataaagccaaatatggaaagaggtaaaacagaaaatgttaacaatggttgtgtgatggtgggatgaatatgagtgatttaagatcatccttttaatagtaagcatgtactcctttcatatcagaaccataatatggtaactacattgacttgaggatataaaaggaggccrgatgccactggaacagaggtgccatggttagcaaaactgagtcaaagaactacttatcttgtgtggtatttttatctaaaatccactttgtggaaaacaaagggatgatttctgaagataagccatgctggaaaataaccactcgattgtattttcttcatgtctggaatttttttttgtttcacatttggttatttattactgtctctttttctcaagaagtgattggaatgcttttcttctgttgaaaaacaagagaaagttatattaacttcagccatgatagattcacatgcagttgaaagtggacttggctttgtctcaccctcttcagagataaccactgtcaagagttcaatatgtatctgtccaccttttcccacatacatggtgtcatatagttattatttattctttttttaaaacaaagattgtgttatagtatgcatttttttttcatttagctatatatcctgggcatttttctatttgagtttgtattaaagttctccagataaagagaaccaataggatacagatagatagattatagatagatagatgatagatagacagacagatagctagatagataggtagacagatagatggatagacagatggatagataggtggtagatagatagacggtagacagatgatagatagatgagaggggataaaagtgttccttttaccagtctccccagcactgcatgttctttaactgagtggtgaaaaatggcatcctcttttaatttgcattgctttgattacaactgaagttttagcagttttcgatatatttgttaatcccctaataaatcctctctcatctatctatcatctattatatatctatcgtctgggattggctcacatgattatggaggctgagaagtcccatgacaggctgtctttgagccagagacattgggatgctggtagtgtggctcagtccaagtctgaaggtcttaggaccagtgaagtggatggtgtcactcacactttaaggccaaaggcctgaagaccagggggccactggggtaagtactggagtccaaaggctgggaagcctggagttgttgcccaaggacagtccctttgaaactaagacctctaggccagcagagcataaagttgcagtaacaggaagcaaaaattttgctagtgggtcacttggggtaatggtaagtggtgccactcccatttccatcccttgattcctggacccgtgaatcctggctacggaagaaacagtaccacatactgggtgctgatttagagcatatacagccttctggagaatgttgtcccagctctgcaaggtactgtcacctagctggtggtgtaactaagtatttagaaggctatcccatcattctgtcaagctggctgcttcaagatgatgggtaacatggtaagaccagtgaattccattagcatgagcccactgccacacttctttggctgtgaaatgagtttcctggtcagtagcaatgctgtgtggaatactgtgacagaggataagtccacggatggtagcttttgcagaagcattgtgtgcaggcatagcaaatccgtatctggactaagtggctattccagtaagggcaaaatgctgccacttctctgatggaagtggtccagtataattaactggttgagcaagattgtgcctttaatggagataaaactatggaaacatttgtggggctggaacagtctgtggttgtgggcaactccttcagccattatttcttttttttccataagttattggggtacaggtgttatttggttacatgaataagttctttcgtggtgatttgtgagattttggtgcacccatcatccatgtatacactgcaccatatttgtagtcttttatcccttgccccctctcactcttccccccaagtccccaaggtccattgtatcattcttgtggctttgtgtcctcatagcttagctcccacatatcagtgagaacatatgacatttggttttccatttctgaattacatcacttagaataatagtctccagtctcatccaggtcactgcaaatgttgttaattcattcctttttatggctgcatatatatactacagtttctttatccactcattgattgattggcatttgggttggttccatgattttgcaattgtgaattgtgctgctataaacatgtgtgtgcaagtatctttttcgagtaatgacttcttttcttctgtgtagaaatccagtagttcgattgctggatcaaatggtagttctacttttagttctttaaggaatctccacactgttttccatagtggctgtactagtttacattcccaccagcagtgtggaagtgttccctgttcaccacatctgcgccaacatctacttttaaaaaaatttttttttattatgaccattcttgcaggagtaaggtggtattgcattgtggttttgatttgcatttccttgatcattagtgatgttgagcatttttttgatatgtttgttggccatttgtatgtcttcttttgagaattgcttattcatgtctttagcccactttttgatgggattgttcatttttttttcttactgatttgtttgagtttgttgtagattctggatattagtcctttgtcagatgtatagattgtgaagattttctcccactctgtgggttgtctgtttatgctgctgactgttcctttttccatgcaaaagctctttagttcaattagttcccagctttttatctttgtttttattgcatttgcttttttattcttggtcacgaaatccttgcctaagccaatgtctggaagagtttttccaatgttatcttgtagaatttttatagtttcaggtcttaggtttaagtccttaatccatcttgagttgatttttgtataaggtgatagatgaggattcagtttcactctcctcctgtgactagccaattatcccagcaccaattgttgaaaatgaattagggaggttttctttccccactttatttttttgtttgctttgtcaaagatcagttggctgtgagtatttgggtttatttctggtttctctattctgttccattggtctatgtgcctatttttatatcagtaccattctgttttggtggctatggccttacagtatagtttgaaatcaggtaatgtgatgcctccagatttgttccttttgcttagtcttgctttggctatgtggactcttttttggttccacatgaattttagaattttttttttttttctaattctgtgaagaacgatggcggtattctgatggggattgcgttgaatttgtagatagcttttggcagtatggtcattttcacaatattgattctacccatccatgagcatgggatgtttttccatttgtttgtgtcgtctgtgatttctttcggcagtgttttccttgtagaggtctttgactcctttgttaggtatattcctcagtattttatttattttttgcagctattggaaaaggggttgagttcttgatttgattcactgattggttgctgttggtgtatagaagagctattgatttgtgcacattagtcttgtatctggaaactttgctcaattcttttatcagttctaggagctttctggaggagtccttagggttttcaaggtaaatgatcatattgtcagcaaacagtgacagtttgacttcctcttgaccgatttggatgccctttatttctttctcttgtctgattgctctggctaggacttccagtactacgttgaaaaggagtggtgagagtggacatccttgtcttgttccagttctcagagggaatgctttcaacttttccccattcagtattatgttggctgtgggtttgtcatagatggcttttattacattaaggtatgtcccttgtatgctgattttgctgagagtttcaatcataaagcgatgctggatttttgttaaatgctttttctgcacctattgagatgattgtgtgatttttatatttaattctgtttatgttgtccatcacatttattgacttgcatatgttaaaccatccctgcatcccatttatgaaacccacttgatcatggtggattatctttttgatatgttgtaggatttggttagctagtattttgttaagattttagcatctatgttcatcaaggatatcggtctgtagttttcttttttggttacgtcctttcctggttttggtattagagtgatgctggcttcaaagaatgaattagggagggttccttctttgtctttcttgtggaatagtgtcagaaggattgatgccaataattctttgatttctggtagaattctgctgtgaatccgtctggtcctggacttttttttgttggtaatttttaccatttcaatcccactgcttgttgttgatctgttcagggtatctaattcttcctggtttaagctaagatggttgtatttttccaggaatttatccatctcttttaggttttctagtttatgtgcataaaggtgttcatagtagccttgaatgatcttttgtatttcagtggtatcagttgtaatatctactgttttgtttcttagtgaggttatttagattttctctcttcttggttaatcttgctaatggtctattaattttatttatcttttcaaagaaccagctttttgtttcatttgtcttttttttttttcagtttcatttagttctgctctgatcttggttattttctttctgggtttggtttgttcttgtttctctagttccttgaggtgtgaccttagattgtctgtgctctgtcagactttttgatgtaggcattaagggctatgaactttcctcttagcaccgcctttgctgtatcccagaggttttgataggttgtgtcattattgtcattcagtttgaagaattttttaatttccatgttgattttgttttcaaaccaatgctcattcatgagcaggctattgaatttctatggatttgcatggttttgaaggttccttttggagtttatttccagttttattccactgtagactgggagagtgcttgatataatttgaattttcttaaatttattgagactcattttatggcctatcatattgtctatcttggaaaaagttccatgcgctgttgaatgtgtattctgcggttgctggattgaatgttctgtatatatctgctaagtccatttgttccaaggtatagtttaaatccattgtttctttgttgactttcggtcttgatgacctgtctagtgctgtcagtggagtattgaagtccaccactattattgtgttgctgtctatctcatttcttaggtctattagtaattgttttataaatttgggagctccagtgttagctgcatgtatgtttaggattgtgatattttcccattggacaaggccttttgccattatacactgtccctccttgtctcttttagttgctgttgctttaaagcttgttttgtctgatataagaatagctactcctgctcgcttttggtgtccatttgcatgaaatgcctttttccaccctttaagtttatgtgagtctttatgcacataaaggtttggtcatttaacataatcccagacttcttggcagctttgttcatattttcttagtcttctatctttgtctttgttggattgggttaattcaaagaccttgtcttcaagctctgaatttgtttcttctactttttcagttctattgctgagacttcccagagcattttgcatttctagaagtgtgtccaaagtttcctgaattttttttctttaagctaactatttccatgaatacttctcccttcatttcttgtatcattcttttgtatttccttgcattgggcttcacctttctctggtccttccctgattagcttaataactaagctcctgaattctttttcaggtaaatctgggatttcttcttggtttggatccattgctggtgaactagtgtgatttttttgggggtgttgaagagccttgttttgtcatttaccagggttggtcttctggttccttctcatttgggtagtctgtcagagggaaggtctaggacttaaggctgttgttcagattcttttgtcccatggggtgttcccttgatgtagtactctcccccttttcctgtggatgtggcttcctgtgagccgaactacagtgattgctgtctgtcttctgggtctagctacccagcgagtctacccggctcggggctggtattgggggttgtctgcacagagtcctgtgatgtgaactgtctgtgggtttctcagctatggataccagcaactgttctggtggaggtggcagagggtgcagtggactctgtgagattccttagctttggtggtttgatgctctatctttgtgctggttggtctcctgccaggaggtgatgctttctggaaagcatcagctgtagcactgtggagagggaccggtgctaggcggggctctagaactcccaaggttatatgtcttttgtcttctgctaccagggtaggtagggaaggaccatcaggtgggggcggggctaggcgtgtctgagctcagactctccttgggccagtcttgctgtggctgctgtgggggatgggggtgagattctcaggtcactgcagttgtgtacctaggaggattatggctgcctctgatgagttatgcaggttgtcagggaagcgggagaaagctggcagtcacaggcctcacccaactcccacgcaaactgaagggctggtctcactctcacggtgcccgccacaatagccctgagtctgtttccaggcagagtgcgagatgggcttgaaaatttgcccaaggctatctgcctcccacctgggagagaaaagggcttggttcttgcccagcctgtgaagtctgaacaccagatttgtgcccttccccaagttctggccaggagtcttctcaccccgctcaaattgttaaaaagttcagctagagaattccttctccctgtggagttttaccccctgcttctctgtctgccatcctgatggatccctgtggttccaggaaggaatgggctactaggggacccagtgagctcccagggccttctgctgcttcctatacccctgtatttcactcggtcctctaacttgattcagctscaggtaaaggcggaaacttctcccacaaacagaccttcagcttctccagtgggggtgtgttcaggagaggagggtctccctttcccacttctggagttgggatattcacagtatttggggtgtctcttgggtcctgcagaagcagtttgcttccttcagagggtctgtgggtcctctcggaattgctggtttgttcttggagtcaatctggagctaaaattcacaatgcaagcctctgtattgctctgtctagacctgcagtcttgacctgcctcctgtctgtcatgtttccctgtagccattatttcttcaagtactttttcagccccatcttctttctcctttccttccaggactccaatgacacaaatgttagatcttttttttttttcatagtctcacaggttcctgaggctatgttcatttttttaaaatttcagtctattctgtctctgttgtttagactgggtaatgtatattattatatctttttattttttattttttaagacacagtctcactgtgttgcccaggttggagtgcagtggtgtgatctcagctcacggcaacctctgcctcccaggttcaagaagttctcccaagtagctgggactacaggtgtgcaccaccatgcccactattttttttttttttggcatttttagtagagatgggatttctccatgttgcccaggctggtcttgatctcttggcctcaagtgattcccccacctcgacctcccaaagtgctgggtttataggcgtcaccaccaggcacggccatatcttttagtcactgattctttctgctgtctcctctttcaactgagctttatttttggttattgtattttttagttttaaaatttccaggctgggcacggtggctcacacctgtaatcccagcactttgggaggccaaggcaggtggatcacctgaggtcaggagttcaagagcagcctggccaacatggcgaaactccatctctactaaaaatacaaaaattagccaggtgtggtggcgtgtgcctgcagtcccagctacttgggaggctgaggcaggagaatcacttgaacctgggaggtggaggttgcagtgagccgagatcacgccattgcactccagcctgggtgacaagaatgagactccgtctcaaaaaaaaaaaaaatttttttttgtttggtccttctttatatattgtatttccttgctgagattttcttttttcatttggttcaaatacatttgcaattgcccatggaagcatttttatgctagctgtttaaaaatttttgtcagattgttctttatgatttcatcatctcagcgctggaatctattgattgattcagtttgagttcttcctggatctttgtgtgaatagtgatcttcatttgaaacctggaaattctggggaattacgttatgaggctcatgggtcttccttacgccttctgttttagctggtttcttctgatactactctggtgagggggttgctgtctcattattgtcaaatgagggttccaggttccaaatgaagtccaggttctcctcttggtttcctttgaaacctgaggtggaggttctgtgttgctgctgggaagatgtggaagttctggctccctactgaagccaccactgacccttccctggctgggagaagtagggatgcatcgttactgctccccagatggccttcactgacaccatgtaggggggcggtgtgtttgtgaactctttatggcagtggtataaattctgactctatactaaacccttttggatatgacccagctgggcaaatggggacttcatttcagcctggtgaagatggggagtctgggatctgcactcgggctttgctggtgttggggaggtgaaaccgcacttcctttctggagtgtttggctggagtgtggtggcaattatctgaaagttttctgtcttggtagcctacccctttcctggacctttggctagatagagcaggacttctgttgatagcatttttttttttgcctgcatctattgatctttctgggttgctgagttttctgctgcaagtctgcaaaatatgaggcaaaaagaaaactccagacctcaacatcatgtcattcctcaggtcctgaggtcctgagctggtctgccttcttctcttcattgaataatccccagactcttcttatgtttgttttctgtacaatgtttgggctttttagttgtacttagtggggagaataaggaaaaagtatgtctactccatttccctgggagcagaagtccccactctggcctgccctcaaccatgaacccccaaagttttcakctgaagttcctcccagcaatctctaatttgccctggagaagtggagtcactgtttcagagctgggatccccatgctctctgggacgtgacagctgttctttaagcagagagatacaaaattagtcaaagtacagttgctcatttttcaaacatgtttaatgacagaatacatttgcatgctaaacaagtatatctggattctaagaaagtaaggaatctcaagtgggggatatttatttagttctgaattaacagatgtgatctctctctctctctctatccctctccctctctctcttttccttcttatttaccttttatcccattgttgtcttttaattaaacaattccttcacaggatgttccttcattgagaattattaaagatgtaagccttcctttatcaaacagcgggctgtgttaattattgtatagactttacatttggctctggggaaacttgagaattgggtgagagaaggtgcttcattaattggttgagcaagattgtgcctttaatggatacaaagccacggaagcgtttgtggggctggaacagtccgcggttgttggcgaggacagaggcggccagtgttgggagctctgcagacagttcctgcttctgcactgactgtaggacgtgctctgcataagcagatagaggacagagggggtggggaggaactagcactataggggcctgacccagagctggtggctgcaccaccatcctgagcagagccatgaaaacttaggctgcctttgcacggtggggtctcagtggttgcgggctgggagggaggtgggccagcagccatgtggtagagaatgggagcttctcccttgtgctatctgtgctgggctgcacatctctgtgatactgggagattgtgtggacagggacccaagggtgttctgagctttccttctgttaatgaacaaattagttggttgtgattattggacacataggagtggccagtgaaggaaaacagaaagagctggcctggtctctgtcttgtcagttttcactctggaggggaggcagaaaacacacacacacacacacacacacacagacacacacacacacttggatcttcttgtagagacacaggtataaacagtctcaggaacaacctatcacaacaggtctgtacacacacatacacagacaccccggacacacacacacagactccattatgcagacactcacaamacacacacacacacacacacacacaaacacactcaaacccacakgtacattcatgccatatactggcatactaacatattacacacagacacatagatgctcagacacaagagctcccccgacagacacacagacacacacacatccatccatcttctaatatagaggtgagcatagaggcaggatggagaagacccagatgggaagtgtgtataagtgtgtatagccattacaaaggaatcagaagcttgtattggttccatgccccatgccttccatgtaaatacattcattttttaaccctaaactattggtaattttgtctctagagactcaggtgtgttcattcctttgacatacacaggcaagaaagcaaaggaacttaaaacaacgacagtgcatgtatgtacagctcttgagtttgcaattagttcagccaacttttactgatgctcaactgcaggccctgtggaatgtcctgggcatacagctgtgaaaaagatgagctccttctgttccatgagctcctggactttcaaagtgaagtcatgttcaggagcctgggggcactgacacacactcacacaaacaccaacacacactgtccacacacatatatctgtgcacatatgcacacacacagacacttgcacacaagtacacacctgcacatgcccatgcacacacatggacacttgtgcacactcctgcacatatacatgcacacacatgcttgcacacacacacacttgcgcacacaggcacactcaattgtttcatttgcttataaccccctgtgggttctgcagaaccctcagacaggtgtggctttgagtcccagccctgtcgctgactatctgtgtgatggtggcactcagtctccctgggctcgctttcctcatctgtagggtgggaacagtcgttcctatttaaaagcaatctcctgatagatccaataaaacaatgggtgcggaagtgtttggcagatcatattcatctgttcatccattctacaaatatttttgactcctaagtgtctagtgccaaatctgggtgccaggccaaaaataacagacaagagcagaccccagccctcatggaaccacaaagtagaaggaggagagmcagtaaatgaataaacagagatggtataagtggagcagacaattgtggagggtggtgagttctgtggcaggaaggagccaagggatgtgatggagaatagctaggtggtcagggagggcttcttgggggtggtgatttgagctgaagcctgaaggaagagcataggtcagccctggggacatggggaacagcactctgaygggaagggacagtgagtgcaaaggactagaggctccaaagagtttggtgagcttgaggaacagaaaggcccagctgggctggggtgtggagacytgagaaaagaatgggctgaagcaagctcgggatgctgggcaatgcccaggccatgggtcccgatggcagtgggagagcctgggttctgctcttggggctcggtgagtatcagaactcttcctaattccccagcctgttcctggtttgatgccacggrctgtgggatcagcagggacyttcggactgatgtcccctgcctgcaagtcctgaagacccctgggatccccagggatatggagaccattggatggaggtgacagctctgagctgccacctgccttcctggtgaccaggaaataaaggagatgttccctgtgactgtccatttcattctgtgagaagactcaactttatttactttgttcctaggggtcaggcaggaggttacctttgagggtattcatcttccccacccaggtccctggagcaccaggactcttggagagtacaattgggagagtacacatgtctcagccggcccaaccagctgtgctctctcgacctttcctgctttcatgcctgttttccacattttctcacacttgcctgcatctgccagttccaccctaacttcttgcccttgggtgcctgcgccgtccttctgaggctggcactggaggtccacggaatggcagtggcagggcagagcccctgtgggcaggcagacactggctgagccccgaaagcccagggaaacaagccgaggacccaaggttccaggctgcctctccagctattcctggaggggtttttcctgctcactccaaaggtaggtgtctctgccctcccatgtctggggctcatcgaagcagtgagagagaggcttatcacgggggtttcttcctgaaatgctcttccctggaaactcctcttctttctttatttgtttaaatatacattgcatgcgtattggtaaaatacataacataagatttaccaygttaaccatttttagggcattaggtacattttcagtgttgtgcaaccatcaccaccatccgtttccagaacttttttattagcccaaactgcaactttgtacccatgaaacaataactccccattcctccctcccctcagtccctggaaaccaccattctactttctgtctctgtgaatttgactgctctacataactcatgtaagtgagatcatacagtattctgttgtgagcggcttactgcacttagcataatgttcttaagagtcattcatgttgtagcatatgtcagaatttccttcctttttaaggctaagtcatattcattgcatggatagacaccattttgtttatccattcattaatccgtcaatggacacttgagttgttttagctattgtgaataatgctgctgtgaaagtaggtgtgcaagtatctctttgagaccctgctttcacttattttgggtatatgttcagtgttgaattgctagatcatagggtatttctatttttaactttttgaggaattgccgtactgttttctacagcagaatttttattgatagaaattttacatttctgtcaatagtgcataagggttccaatttcttcacctcctcaacaatacgtattttctttctttttctcccttcctctcttcctctctccctcccctccttccttcctttctttcttttgatagtagccatcctaatgagtataaggcctcctcatttttaaagacacaggtcagtcatcacctcttccaggaagtcttcggtggtgctcacagcctggctgggcacctagggtgcctccttcagtgccctaggcttccctcgattgcatttgtgtgtgtacctactaccccgtcactgctttgtgagtcccgagggacacaccagatattcagtgcatgtccttcctgccatgccagggcctgatcacaggaggcacacaggacatctttgtggagtggatgcacaacaaccagaccgaggctgatgtccagcagggactccggatgcagtgaaagaagcctcgccccttcccttgggacacctggaaagctttttgtgggtgtgggtgcaaccctagaaagcagcctcctgttgctgcaaagtctcatggctgaaaacacgcaagtacaacttacgagctgaactggagtttggtgtgcactggattggggtattcaggtggaaagctgcctgcagggtgcatgctgagtggaggtcattggctgtgttggccaaggtgacctgattcctgaaggtaatgctggcagatttatcattcttcttcctagggatgaagatagcgacataacttatattccttgtgatttaatgacagacccttcatttctcagaacggaccagagacttggatctgaagataggatggacttttactatcacttggaaaaggaatataagttgtagttgttccccatcgcttcgtgcaatgtctgcttctgaaacaagatttaaggatcagacttcttgacaacagttgtctcatgacagcgaggagcgaaattcactggctgcggttgagaccaactgtgtgtcacattgtgcaaaaccaccatgcacttcactgctgttctacagcagcacaggagatagcatgagcgacaccacgctgggcttagaagatggaaacgatggcatggagctcccaggtggccacacactcagggacaagttctccccgccagtcctcaaccgctacgagagccctggtacccttctmagaaagggcatctcccaataagtgatgctttagatacaactgcatgagaatataatgttcaaggggagaagaaaatgctgctttgaattccaagttcagatgggagccaggccacgtgacatttcagtccacttgcactcacctgttcactcagtcatttcacagactttactgagcccccactatgtgtctggctttgtgctgggtgtagtgacaaagatgagcaatgtgacatctttcatcctccagaaactcttggtctagtggagtgaaaaggcagayaattccttgcaggaatagaaacagaaacccagagctgagatcatcagctgcttccacccgctctgtccttgcctgctgggaacacactacaaaggaggaaacatttgagccacatttcagagaatggaagcaaagaaagggggcaggacagtgcaggcagaggggacaatctgtacacaggtgcagagtcatggtttgggcagcactgagtggtggggcagagggaggcgtagggtggggacttgaggttggagagtcagctttggcctggggggctaaaaagtttttgtgggttgtgtgaaggagcctgtgctttatcctgtgggaaacggggcacctccagaacttgggaagaggggcagtggccctgttggatgagttttctttgaggctgtctctggcagtaacatggggatgggttggagtctgagggaccagttagaagttattgcaatggcccaggtgagagatgatgaggacagggtgcaggggaatttccaaggaggcatgcttgcctagagcaaccacaattttgcttaaacccaactccctccctgctctgcacctgccgctgcccctgggcaatggaatgctgttggcagaaaacacatagccaggctgcaactggcctctaggaactccacctgccctcaaatgggtccttcatgctgcaggattattctactgcactgcccagggctatttatatcacgtgttccctcccctcaaacctctgaaactgcttcttctgtagttacgtcttgctattatttttccttttttgagaaaattaagggactttactttttaaagcagtttcgtgtttacagaaaaattgaggaaaaagtacagtgagatccatgtaactgcctcactttcccccaatttcctctattattgatatcttgaattaatgtggtataattgttacaaccaataaagcaatatctgtacattcttattaacaaagttcatagttcacattaggattcactctttggtgctgtaaatgttatgggtttggacaaatgtgtaatgacataagttcaccattattagtagtatgcagaataatatcactgccctgaaaatgctctgtgctctgcctattcataggcaaccactgattcttttactctctctatagttttgccttttctagaatgtcatatggttggaatcatatagtatgtcgccttttcagattggcttctttcacttagcaatatgcatttaagtttcctccgtgccttgtcatggcttgatagctcatttatttttagtgctgaataatattccattgtctggatgtgccacagcttattcattcacttactgaaggacattttagttactttcacattttggcaattgtggacaaagctgctataaacacaatgactttgctttttaatttactgagaaaacgggaatgatgagggcagagctgatctgtgcattcactgccatgtctatcagcttccatcgtctgtggccatgagcctcctcttctgtctgatgttgagcagaaacaccgtgtgctccttctaaaggcaaccccttggatactagaaataattccctgtcacctacataagggtggaattcttgcattgtcagtttctccttttcaaatggatcatatcagtcagctctcaggcacactgtaatacccaccatctctgcacggccctctttgcatccattttcatccccagccccatttctctgctcctctttgagcaaaactcttcaaaatagttaaccttgtcttgaactcctgggccagcctgggcgacagaatgagaccatcacaaaataataataataataatgagatagttacctttacttgctgtttccactgcagctcttcccattctctcaggaacccctctgcagcagatgytggcagtgatcaccgcccatcctcctcctctcccttgtcagtgggctctgcagcatctgcctctctgtgtctggggctttttctggaaccttaaaggccatgttttgcttgcactcagagcaggttggaagtgagggaattagtctacctgggagcattcttcaatcagagatggttggagttggtgtgtagataccctgtcccctgtcccttggtggtaaaatctggcggtccaaattctgcattgtttccctactagaggaagctccagtcgtctgtgtggagatttcttagtgtgctgcttttccttcccacttgcctaatccccccagttttccctgcgtagcacaaatgtacctcttgcacttgactccttgtgtcagagtttgcttctggggactcccactcagacactccactctccaatcaggaggatgccgggcatcctacagatgttgctcctgggggccaaacctagtggtgaaaaaccctgggcttcatcttactccatttcttccttttttccttccttccttctttctttctcctttccccttttcccttttcccttttcccttcccttcccttcccttcccttccctccccttcccttcccttcccttccctccccttcccttcccttccctttcctttcctttttctctctctttttttgtctctctctctcttttattttttccacatagccttgctctgttgcccaggctggagtgcagtggcacgatcttggctcactgcaacctctgcctcccgggttcaagcaattctcccgcctcagcctcctgagtagctgggattacaggtgtgtgccaccacgcccagctaatttttatatttttagtagagacggggtttcaccatgttggccaggctggtctcgaactcctgacctcaggtggtccacctgcctcagcctcccaaagtgctgggattacaggcgtgagccaccgtgccaggcccttactccgtttcttaacagccttcggccatggtggtcacttccttgcacttgtcctttgggacatggttcccttttgggtttcctcctctaccgaatggtcctttcagatttccctgctagctgcttctcaccttcctgccccttgcacccactgctagggaggttaaccagagtattgtctacagaaaggaaataacgtccgcttaaagaagagtgggagttaatttactctataactgttaggtcaaagggggaagtgaccctgtttaagtgtctgacatgctctggtcactttgcacccattaactcgtttgatcttgaaaatagccgcatgatggaggtgctttttatcaccatggacagaggaggacacggaggcccagagaggttgcatgacttggtcaagggcacccagggttggtgctgggatttggagccgggtgtctgtcacattccatttcttttaaggagctgctgactgagacagctgtgttcaaagtggaccctggtttctttcttggcttctatttccctcacttcctggtctgatggatgttttattccctccaacccagtgcccaagccccttgatttggctaagccctggagccctggagccctggagcgaaatgcatgattaaatcatctacagtgaggagccccagggactcgcaggcagcccttgcccccaccagcctagaacattcagcctttatcagggagaaccaggatgacttcagagattccttttcggaactgtgttcaaagggtaatcagcccctatccaggccatttgctaaaacagggctgagtaattcaacaggccgctccaggaggctgctgtgactcagctggtgctgttgagctgctaatgggcttcctggaagtgttgggccccatgtccccacactcacctctctgaaacctgtgctgcttcagttcaaggtactgggtacaacagggagtctgtttatgctgtgtgcgggggatgagcagctgctgggctgttacccagtttctgagtgctgtgctgacgggggtagctccgtcccagccagaggaggtctcccttatgcctgttgagcccccttaagggtggacctgagtctacacagcttctgacatagagctgggtccagggagtctacctgtcaggtttgcacaagagaggaaacccttgctggctcccctcaggggcatccatgctgggtgctgggggaaggcaaacacagtcccagggatttagctgcaaggccagggggctgggggtcctaggttccatggagaaggctggggccagacaccttcctgcctctcccgagccctcatgcctggctcccattgcccagccagccctaggcccccaagcgttctttgaacagtggaagggtccggtgctgaaggcagggctgtgtgttcccattatcaatctcatgtcttattccttgctcagggaagacaagacaggaagcaaggcttttgagaacatgaagtcttttgagaaagaaggtatgagtcccaggtttatgtgacagagagatgagagtgtgagaggaggcagggcagggggatggcttgtggagaagctgctgcaggccgcggagcacccgttccacccactgtctgtgcccagggcagccagctgctgaccgtccccaagaggacatttctaatttacagatttcacactttgcaataaagaagcagctgtgcattttagcaggaaactggaaggaggcaaaaagcccaggcagaaatggatcaattgtgttgtccattaaaatcgttccagggctttgctaagcacatccctggagttgtcgctgtctcctggcctctgggaaagataagctgtatgatcacwgccctcttctagctgtggagatgaaaatcaatccgtatgcatttccttggagatggcccatggatgggcaggatcaggcctgccaagggaggcatgagtgccggccctggcactgccagttccctctaagcccaggtcctggagaacccttgagtctcaaagcggccaggctggccatgcatcaggatgttggctcctgaaagccccttgggcagcctcacaggatccttcccagtgagccttggagtcaaagcttcttaggcttgctttgtaggccaggccaagtgaaccattttactgtcactgtcccttcagtcacttaatgtccatgccctgtttcatgcagactgtgtgtggggctgaggttgagttttttttcccatccatgatttgtctgctttcaatctatgtattcctcagcttcccatcctaatatccagctcccaatataggttctcagagggctgcaaagagctctcagtctacaggtggggacagtggtcaaattagagtggggacagactcctttttctttcaacgcacacgaatcactggccatagccacacaatatgtgttcgaatggaggtctgtgcaggatgtctacacacatggagacgtagcagatagcatgattgcgtctgcagggagcagggaatgctttggaagaggagccctagtgcactaggtttaggtgggaccgagctcaaagtgggaagggcactccaggttggaataatggggtgtgcaaaggtgtggttgctgcagattgcagggtgtgttcaggcagtgggtgtgttttggaattcttgaatcagaaggtttgttggaagacttggtggtgaccagatcaggaagggctttggagactgtcctgaggagttgaggcttattctgtaggtgatttggagcaagtgtgggaatgagccactgagtatcactgtgcagctgaatgaatgaccaaatgcacaaaaggaacgagcaagcttcactaagcatgacaccccacagtgagaggcctgggaggagagtccagctcaactcacccaccatggtccccgcggaaggctcctcgtttgtcactgtcccaccctgccagtttgactcagtatgagttgaaytgtgtccccttccaaaattcatatgccagagttctaactccagtacctgcgaatttggccttatctggaaatagggtttttacagagataatcaaattaaaatgaggtcattagagtaagccctaatccaacatggctggcatcctcataagaaggagaaattgcgagacagacacagggagaaggccatgggaagaagaagccagagatcagggtgatgctgccacaagccaaggaaggccaaaggttgagcaaaccctcagcagctagtacaaaggcagggacaaatccccctcacagccctcagaaggaaccaatcctgccaacagattgctcgccatgatgtgggtgggcctcacctaatcagttgaaggactgaatggcccaaaatgctgacctccaaccagcacaagagattttggccggaggactgcctttgaacttgaactgcaacatgaggtcatctatgggtctccggtctgacagcccccctcacagactgtggacttgccagcttccgccatcacatgagccaattccttaaaataagcctcttcctctctcaatgcacacacttcttactggttctgtttctctggagaagcctgactaatacatcaggtttggccagactgttgctgagagcagcagctgccgagcttcaggtaccccagaccagctggcctgaactccagtgattcatgaccgacttccacatttttatcatatcttcatatcacctgttaattacttactgtttctttctttaaacttactgtttcattacttaaatgttgtctcatcctcaatcataattttcttgaaatcatggcttggatatactagcagggaatgtttacccaattataattaattaaaatagatagatcactattaaaaatgtttgcccatgtcctacccatgtttaatctgatagaacttgtggcagctaataacaagttgagaataggtgagcctttcccagaaaataggggccatttgatttagatttcacaagtctttcctccttgcttccctctctcctttaaaactttactaagcacctactaggtgccatgcctagggcatgagctggggataccagcatgagtcttggccccaacttgcttggctccgtggggagagtcaagacaccagccattcgtgtgctggggaggcccagtggtaggcctatttctagctgccctatggtgcccttcacatacaatttcatctgaagtttccttacattcctggccaaactcactgtatgtggtgttttctgtttgcctatgagcagagggtcctctgcgtgttctctgaggaagtgccatgtgcctcatgcttgcctccccttggacatctcttccaatacaagccctccatcctgttgatttatggtggccacgggcagtgtctaggcatgggaagcacctggaggaaccttgctgtgcctgtgggatagtttgctagggcagctgtaacaaagtaccacaaatggggtggcttatgcaacagacatgtatcatctcacagttctggaggttggaagttcaagatcaaggtgttggcaggattggttccttctgagggctgtgagggggatttgtccctgcctttgtactagctgctgagggtttgctcaacctttggccttccttggcttgtggcagcatcaccctgatctctggcttcttcttcccatggccttctccctgtgtctgtctcgcaatttctccttcttatgaggatgccagccatgttggattagggcttactctaatgacctcattttaatttgattatctctgtaaaaaccctatttccagataaggccaaattcgcaggtactggagttagaactctggcatatgaattttggaaggggacacagttcaactcatactgagtcaaactggcagggtgggacagtgacaaacgaggagccttccgcggggaccatggtgggtgagttgagctggactctcctcccaggcctctcactgtggggtgtcatgcttagtgaagcttgctcgttccttttgtgcatttggtcattcattcagctgcacagtgatactcagtggctcattcccacactgatttgctcattcacacattatgcacttcatttgttcattcattcagcaactacaataatattcaatgacttcctccttccctgtatcattcatacatcgacactcatcccatcattcattcatttgaacacttctcaagggcagatggagccctgtcctgcaccatctctgtgtaaaagctgaagccaaattttaataacacattcctttccatcagagtgctcttcagggctcagaaagtgggagcactgctgagttctatccaaggaaagggaatcattatatcaaagggttacttgacccctatgtttactgtggcactgttcacaatagcaaagatgtggaatcaacctaagtgtccatcagtggctgaatggataatgaaaatgtggtatactcagtggactattaatcagccataaaaagaatgaaattatgtcatttgcaaattatgtcaatttcatcatcaatgacaatgaaattatgtcattgcataaattaggtcattatcttaagtgaaataagacgggcacaaaaaggcaaatatcacatgttctcatttatatgtgggaatgaaaacatttgaacacgtggcggtagcgggtagaatgatagttctcagagactgagatggacgagtgggagggagaggggaggatgaagagaagtggattaaagcgtacaaacatttagaaagatagaaggaataaattcaatgtttgatgtcagagcagggtgactatacttaacaaaaacatattgtgcttgggtgatggacaccatggcttgatcgctacacataacatgcaagtaaccaaatttctcacgcaccccatacatttgcgcacgtaagaaaataataaaaaagaaagtggagagggatttatttttgtctactatttgttttgaacagatggactattgagctatctccacttcttcaaagtggctgtcacttgatttcttggctacttctactcagaataatgggaatttcccccaccctcccccagactggtcagatggagagctctgtcctgggtgcatttgtttaaaaccagagcgcctgtctgctgcggtcctgactgtccatatctctgagcaagaggagagagagcccaggtgctcagtcctgtcagccaggcagggcatgtgggtctcttctttttgaccctctgttgtgtccaggtccttaatcttgctctgaggattccagccaagtgatgatgtttcatcactgatcgtggtgccttgggcagcttcaccctggcatcaagtggtgcccaccttatgatccggagctcaatggagcttgagagtgcccttagttgtccctggaagacaggtgtgcatgccagcttcctgccagcagggccgggcccagcctccttcaccccctggatcattccagcaggaggcaagaaaacatcatcactagcaaaccctgtttccaggctgcataaccacacccccagggaacccaccagacagttatactgttggggtgcacaatggaaagcaaaactgtcccaggaagaagccagtggcttctgtgcgatggctactctcccagcacacagatgaagtctggcttcaccctaccccagtgtgtaacagggaataaacaccagtccccctgctgcacagagctggagtgtaactgaaaggaggttgtgctgaataaattggtccctccctcaggggtgctctgttggagagaaaggctgtgtgatgagtatggattcgtctgtttagatgtttctggagtctccatttggctaatcattttaatcagaatttatttcacttactgcaatatctgggggtgttaatgcctcctcctaaatcccttcaacaaacaaagattttttaattactaacaaacaacttacaaactggaaacatgagtggaggttgtagctctttatttattctttattctcaatactcacaaagccacacatctggatgagaatttctggaaaaattccatcagctatcttcatgtttccaaatattatggctttggcattgggtagatgacataacagaattaaaaagcatttcatctcacctccgtgctgtgtaggcactagcgtgtgctatacaggcacctgcgcctttcctagactgcagcagtgtgtgtgcagtgaggacaagtaaaccacttgtttttgtacactagcaaaggccctatactatctccttggtgtagagttaggtctgagaccgtggaaaggggtggggtaggtggatgaaaacccatgaagaaaagctgacgttaaaaaggagagatgttcactgtgctgatcagaccgagctcccttgggcttttgagggtaattattttctccttactaatttggaaagaattcatcttactttatttctatactgctatctttaattacctctgctactgaaaacgtatctgtatttcctgagatgtgtttacatttctttacccaataaaataaaaaaaaacgaaagagtagttatggactcctctgggtaagatgaggaaataacttgtattgtctgagaaaaaacatcgactggcccgaaaaatggctggacattgcctttcccatgagtcttcttttagctccctacctgtttcaaattgcagaagcttctcctggcacctggcccttggttagtgataaatcttagtttaccattttcatcctcgtgtgagctatgatagatttttttttggaggaaagttgactgaggtatggattgttgccagacactaccttaaacttgaacgtctgaaatataaaacttaccttgttcctctgcataaaacatatccacacttcctgacgaccccagaataatgtcctgctcctttagctcccagaaggcccttagagactaggctacctttccttcacccccggttcctcccatcttcctctcacctgacagtaacagcaaatgactcacagtttcttcctcgcaccagccccttctcccctctcttggcatctgctcacgcaggtgtctctgcctcccactctctttcacttcactattcctttcacccttcaacatttactcaggttctgcctcctcctccaggaagctgttcctgaccacctctcccactggctggggcagttcctctcatggtagtctgggtttccctctcctttactagatcccaaattatatgcaccacaatatggatcatttatgtatctccaagtagaccatgagctcttcaaggctgcacttgccccacctccccaccacctccctcagcatgcctatagcacagaacctggcaggtaatgagtgctctgaaaatatttgttatcatctgtaaaaagaaagatgtcaatgttggcttactaaaaaaggaaggcttatgagtttaatggagcaagggcaaaactagaaaaaggcaatggcttggatttgcagaaaggtgttgctttcagaggctgtaatctgagttattatttgctgagcatctcacgctatatcacgttgcacctgtgagagtattgtggacgcagttttgtggatgatggaccagagacccagaggttaaggaacttgccgagcttctataacatgaaaggcagagccaggatgcaagtcattgtgctaccagcctgttgcatttgagatctgtgcagttataccaggtggggtggacattctgagtggcagcaggtctgctctatcttcccaggacagtgagcccatttccctgctgtcccagtgagctctctcagcacaggctggatatgggttgtctgtacctgtgtgtgcctattgtgaagcgggggcattctccaattgagcctgttcctaagcagttattcttgttggaattttaaaatcagccaaagcaatgaaaaacattcacataagttacctcaatactggaagcagataagctgagggttgcacacccagaggccaccttttttcaaattcacctgcagtgtgtcagcttggggtcagggtgaggtgcaggattggcccctggagatgcaggtcacagatgaatgccttttcagtggcttgcagggagggagatgtgcatgcagtggttctcttcccagatgcttccctctttattggtttctctccattagcctgagagctcctccagggtaagagcaagatgggattaatcctgttactctctgtatcagctgggcctagctcagtgcctggaatagtcaatgaatgtttgttgaaagactacttaacacacagatgagtgggtggatgtaggcatgtgtgcagggatggatgaggggccaggaagaagtgtctgggtcatatcacagagatgctttcttgtgggctgtcctgaaggttctgagaaggctgatggatagttcccagtgtccactgtggagagaaaggagcttcggcaccctgcaggattcccttcaccagctcctgttccagacactaatggcaggcaggatggatgtcaggaaaaggcatctggtgcctgtgcccatcccagcctggtcagggcagcatttaagataataatcttaatttatgccaggaagaaatagcctccctatggaaggtttgattctggaaagacactctctggtagagatggggctgggcaaggggtatggaccacacagtctgaccctgctcccatcaggggtgcatgctttgatttccacaactggcacagacactcccagtgccccaatgccttcttccaaggctggatggctgttactcctctggttagcccagcccagaggaatttaattccagaaacgcttccaagctctgaggaggaataacaggccaatggggaggtaagcatgagatgcaggaagcataaattatcggctttccattccacatcacttctgagagatggtctctcaaactccaaagagctggcacaaccacagcacctctctacccaggctcctggctttccttctgcaagctcattgccctctacaggcaccatatcacgacccacaatgacccaggagtttcttcttcggcatccctgtcttcccatggccaagagtgagtggcccctctcccctcacccatgcaccactcacttggggctttctgggtcttctgcaccaggaatgatttttatctacacatcacaccccagctgaggcatagaggagtgttatggctaacaggaaatgaagacgctggctggactagcttgccttgtaacttcccggacatcttttccactgaaaacaaggttcagcatggtcttactgatgaagcttcttggccgttcaggatgtcggggaaggaggcactcttttatttatttatttatttagagacggagtctcactctgtctcccaggctagagtgcagtggtgcgatctcggctcactgccagctccgcctcccgggttcacgccattctcctgcctcagcctcctgagtagctggaactacaggcacccgccaccacaccgtgccaattttttgtatgtttggtagagacggggtttcaccgtgttagccagggtggtctcgatctcctgacctcatgatccgcccgcctcggcctcccaaagtgctgggattacaggcgtgagccactgtgcctggccgggaagcactcttgactgcagccctctcagggcgaggctctctggtctggagcagctccatcccctggtccccagcccctgaaagctgggttctgattataattctgctcacatcacctccccttggcaactgttacatcatcgtgtctgcagtggcaggtttgcagcaaacctggcccaggtgagcagagccccctcctgccagcagctgtcattagagagcctgaagtgcataaacacctccacgccctgcccttccctggcccatcctcagtcctcccaacctaaccttccccagcagtctgcatatactcccccttcccacagcttctccaggaaattgttgggtctaatcaagctggagactaggggcctgtggagcagattggagtttctgactgtggcaggacttgctggacactgggcagggggtgattggaggcagaatggcaagcccgtgagaaaggagcctctctttcctcccaactcctgatcacgcatgctgcctgccagcagagagggcacttggacagtaattaatacctacaaaggggtggcacatttcactgttggttttgttttgattggagtgaggctatctgccttcttaggatgcctgtgtccttgggtgacaccatctgagcaagttgcctccctagacgctcatcacagagcacattttaattcagctggagcgtgtgtgacagtatctgaggcaccgtcgctggcagtaggcttctttacctttattgaagctgttagctctttaggcaggagccccacgtgggaacatttgcctcaatctattgaccagtgaaatatacattctgaattaaaatgtagggtatgttttataattgggaatcagagaggtggcaagtggttagtttcttgccaagcaatatgtgaaggttctatttggggatggcgaggaacgcacagaatggtgatttgaactcctcagtggggggaagttttctctctccctgctggtctttcagctttcagtctggtatatattttcagatctttttttagagctccattctctcttctcctgacttcacatagccccttgtaaacatggggaagtaacgtggtgacatgcaaatatgtttgcatgaatttcagcatcaaccacacctgggtcacatcttgcctttgccactgaggagccatgtgaccttggccaagtcactgtcccattccgagcctcagtttccttatctgtaaatggcgacgttttcccatactccacaagtttgctgaggaacgttagtgaaatagtgaatggaaagtgtctaacacagagccaggcacaaaacagtgttccaaaaatcgtagttctaatcccctctccttttctccctgcttaagtctgactccttggaagcagagcctggcattgcagaagtgatttatccagggagagctctctggtaaaatccttaaggatgtggaggtagcaggatggggcaggggaggaagcttggcacagcggggtctcagctgagttcaggccttggcctgatcttaaggggagctctggcataggaatggcaccacagagtcatcatggcttgaggctaaagggctggagttttgtgccccatagtgctcactcactgactgtgggccaccccagttggagggcatagccttccaggcctttctgtgtgaggcagaggcctttgcagttctcaggggcctttgccccagccgctggggatgggcacacccggtggtggaggggatctgggtggggaaccgcagtgcctgtcaccttccccttgcctattttaaaaccttttatcccaagagttttaaaaaatcagctgtaaatataagcatgctcaagaaagttttaactacattcccaaatacctgatgcctcccagtttgtagattctctggctttttggggtgaggtctgtgaaacgctctttacttacgcagtcccttggtgcgcaatatcctggactagccacagggcaagcctgacctgcctcgtgactcaaaagtggtggagatgcaggctgctgctgtctcaggatcagttccaaattgagaagctccccaggtttaattggccaaccctccagcgtgcatgcagagcgcggaggctctgtactgctggagccgcctctaatcagcatttgctaaggtttattaacaccttatcagtacttgggacggctcagtgtatactcccttgtcagtggcattatctcacgctaggaaatctgaaaacattagatggcgaaggcatcctgcgtgcctcattagttgttcaaagtgtgcatggtttgaggaccattaagggggattccatcagctctatgcgctattaaggaaggggtgattgataggtgagtcctatctggaggctttgtagtttcaagggcttcatgacaggtgtgacagtggcccgcggaaagccccaggccctaccagcacctatgggatgcttgtgccggcgcggcccctaccaagcgttctgggctgtggctcttggtgtttgccatctaagcccattgccactctgcagtgacatctaggcacatttccttaaaggggaggaggtggcctgatgacaggaaagagcacacagagcctcctaacttaggcaatggcttgaatttgcagaagagtgttgctttcagaggctgttaactgagttatcatttgctgagcatatcacattatatcacatcacacctgcaagagtattgtggacccagttttgcagctgatgggccagagactcagaggttaaggaacttgctgagcttccatagcatgatgggcagagccaggatacaaacttgggtttgacctccctcagctctgccacttataaactgtgtgaacttgggtacttgggtgcattcttcagtctcctcatctggaaaatggggatgagtgtcctctcttagggctaaaaattgtaatacccctggcacacagcccattggaaaattctagacacatattagctgctcaactgtcagtaacagttcttattatcactcctggatttcaactcccagcttgggtttgagcttgtgggatgtgtgcagtccctcctggcaggtccttgggtcggagccaccgtggagcaacatccctgaattcgtctctctgggaaggggctgccgggctgggggatgtgataaataactttcttccgaatcgagtcttacatttcagtcaactcagcctcctgctatgtgtgggcaattgcaccatcttaataccgctcttccccctctttaatctgtcttttcagaatgttctgtcaattagaaaatgcttgtcagctaagtgactactcaggaaaacaacttacatgacttctccagcacttgaagaatttaaaataatgtcaggggattaacttgcagggaaaggcattgttaggaaggagggctgctattcagaactgcctcccagtctgtacagtttcattaataacacctttcattctgtagcccctcacatctagaaggatcttgagtgattaacagatgctttgaataggaattacttcatcttctgctgaaatatcacttctccttggagctgcaagcatttgattgtcaccatccttgtcatgccagacatargagggctgaggctgcctcgtggtcagtcttgctgctccaaattagaggggtataaataatcaccaagtgaattagtttaattctgcagaagttcctgagccctgactaagggcctggctttgtgttaggtgctagggaggcaggaatcagaaatagctcctgccccaaaagatcccactggctaggaaatagacaggtaaagagcacctggccacagggcaggggagtgcatgcaacagaatttgaatgcatgtggctgggagctggcccaggactcagctgtgctggagccaaggccggaaggatgggggtatgaggtagagaagggtggcagagggcacagattggccttgctgcttggaccagagtccacagagctgcagcagaagttctcagaggggcaggtatcataatcccctggagggcttgctgcagcacagacttctgggctctaaccttggagtttctcactcagtagatctaggacagacctgggaatttgcatttctagcacatttccaggtgatgctgacgctgctggtccaggagcgcacttggagaaccactgtgccagaggattgccagagggttgcaatctcagatagatgtctatggaggccagtgagggaggccgggtggtggccctagtggggtgctcagccaagtgggaagcatgcaccccgtgcaaagagaacagctgctcctgagccacagcctctggctgctacatggtaatgtgggatgagcgttactagattttctgctcagtctggaaagaatgggaatctcaatttttaatataaaatgttatttttatgatgccacatgggtctgaggaaatgcatttgcaggcttcatgtggccagcgagttttcagtttgtcttctttcttttaaagaatgaataggaattttccaggcagctggggagggaaaggacttttatgcaaaggaatccacaggtgcaaatgcctggaataagatgctctgagtggggaagtgtgaggctttctgattggctggagcatcatggttgctgggtactggggagtggaaaggaggagttgtcggagaggtgagaggtagcagggaagggcccatggagcttggagaaggtttagatttgatttctgactccagcatggccagctttgcctaccaaccttggttcctctgtgttctgggatggaggaaacatttgatacccattgcagctggcccagcacactgaggcaggcactgtgccctcagggagccatgcggagttctgatgcctagcacctctggtaacttgcatcccttccaggccagcttctgtgaggcagcggtgcctcccttaggggagggacctcttgtccctgtctccccagaagaggaaccaggaggccttttttcatcacagacgttgtgctcaacatcttgtcctgagagggtctttggatcagacagactcaggctgggtctcatgtgcactttgggcaagttgctagaactttctcaaactctgttcctcagctataaaatgggaaaaatgtttgtgaacattgataaaattatttttaatgtaagtaggccaatagattgtttttctaagctatgtgctttttaggagattatacattatcatggcagagaaaacataaatatataaacagccataaaggaaaaaaaacgaacaatttaaaattacacaagttcccagtaccttgagataaacatcattaatatctttgtatctcttcttctagatcgggggttgacacactcttttttaaagggccaggtagtaaatagcgttggtttgtagcatatatggtctctgctgcaactcttcatctctatacttaggcctgacagtagctacagacagttcatgaacaaatgcatatgggtgtgctttaataaaactttatttataaaaacaggcccctgagttgagtttgttgaccctctttctagactttctacaaagttccatgtatcctttattttataaatatggaagtattcctactttttcttctttggtctgacttttcacatcacagtatatcatggaagtcttccatatcaatatatattcacttacatttttatttctaaaagctgcaaagtatatcttacaatagcagattggttaagcacattatggttctattcataatttatttaagcatctggtactgttggatgcttttccaattcatttttactgaaacatgatgctgaggataagatgtatcttacactgttgcacacttgcccagttttgaaataacctttttggagtctgggcactgtagttattggagaagtgcaggctgctctctctgggccctctcaggttcccgttctggcatttcccatcagtccatgttctccattgtccagttcaccatgagctcctttatgcttcccagcrgctggcgtatgtttctctagcacctgtgggttttccactattactttgtcaattttatgtacattgtgtgtactcaccatttccacctgagcacaagcatatggacttcaggctttattttctccttgcttttgataagtgtgttccagggcagttgcctcagttgtcctgcctctgacaagagggagtggcattgttgccctcagtagtgaagacacatgggtgccaggtggggtggaggtggaggctccatcctgtctctcttcctgggctggggcttgtgacagattcctgaacggacccctgtattcatcccagagtgggtccctcccaagttctgggtaggacccaccaccctgaagaccttggagatgctcaggcaaggggagaggggtcctgttgatctgtccccagtgagcgatagtgagggaaagctttgggccccagtgagaggctgctgttagccctgggcatgtggtcagccacggccacaggacccacaacagccctgcctgtgccagacgggtgctgggcatggggttcacacagatgtggaagccatagtctcccctttcaaggagcttacggtctggaagggtaggtgagagcacatgactggtgggatatgagtgaagctggtgactggcatagtggcgatggctctgggagctaataatcatggtggggactccaccaggtactttgtattcctacacagactccccatgacagtgcagcaaggtaggcatttgtctagggcaggcttcttccaagcagaccttgaaatgagggttctggtacaagtctttcctaagaaggtgctcgcagaggagtctgggaagggtggggaaaacaggacagggaagggccagaagcaggggtggaagcgaatctgagtgggacctccggagaagacccctagatgtcagaccgagctccgggtgctctggggggtgagttacaccctggaatgtccccgaggcaaagggagctgggccatcataccctcaccctcatcttaagtgtgcgtgtgtgtgtgtctgtgtgtgtgtatgagatgctcaggcccttccaggcctctctgcctgcgggcaacatggctccaggagccagaaagccattctctgaataagagccccaggtaggtgccgggggtaagatgcaaagcacaacaaagttttgccctcatttaaccagaatgttgctatccccattgcacagttggagaagcgaaagcacagaacagatggtgggctcatctgcagactgtgggaaagccaggattgtcgctcagcctgttgagtgctttctctgatgtccataggggtgtctaagggagagaatacagtcatgggctcttagtttctatttctggttgggccagtaaagctgcttcctcatctcttttctgcttatcactagagaaagaaattaagaacccctgcttcagcctgctaaaagcccaaaacaaaaccaaacagaacaacaacaaaataaggcaggttgaacaggctcgtgacatagagaggtgaatctggcctttggggaatgggagcactccaggtggattcctgcaggaggagtcttggtgaagcctgagcatgcagggatggcccttggagcactggcaggagggacagaagcaggctgggtctgagggaggcaggtgagtcctgcatgatggggacctccagaggggtctgggggagcagcagccatctggaatcacagtgccaggctttgcttcaccttgctgagtggagaggggtcttgactgcatctcactggcttttctttgaggaataggaacctggcagtggtgagcaggacagattggagagggcgagccagacggcagggctgctattttgaagctgatgtctactgggaggtggctgctttcacaatggaaagggagtcctagacagacaggatcctctctggatcccttcctgggaaggggccagggaagagggaagagtcagaggccaggccaaggcttgagggattctttgcagtgccctgcagacgtggaactatagtgggagctgggagttgttatttggttctcttgagctgcctttggcaattcaagtggtggagctgctcggagctgctggaaggtaattggattggagggtcctgagctctgcagagaaagatgccagtgctgcagatgtgagtggaaagtgaagcctgtagagtacccccaggaggtgggggtgggagaaggatagtggaggcaccaggaagggccagtgccatgggggccaaggtgagagagaccactagaaggatggtgcaggcaactggggaggcatagggagtcctgcggggtggaggctgctctgccttctctttggaaaggggcgcattgtagagtcaactgatctgctagtgcctgccagctctgttgggaggtggatacccagaggccttgacatctgtcaaggagggagctgcctgtggacaggggaccagtctatggagagtacaaggcatccaaggagcttgctggccatggtgcagtagctgtggcctggaggctggagtcttgagcctggactaggtgccgtgtcctctggagggactgagtgagacacagcctgaggttctgttccccacaaactcaggagcactgttcatgtgctgaaaccagtccaggccagcgccctgctgtggtggagcatccgacacccggggacacctgacatggttaagtgacccgggctttagagcggggcagatggggctataatcctggctgtgacttttgtgcctgtgcccctgagctgctcagcctccaaggcctccctggatgtgatctctcaccaatatactggggatatgctccctccaaagtctgggtgcccacattgggtgctctggctggtgggttcagatctatcttgtgggtagaattgggcaagcttcccacttcgcccctgtagctagttcctataaatgctggaatacagaacatctcctaatagaaagtgctttatgcattttcccagtggggaaatcctatatttaggggagggggtcaacttgtagttgaacataaaaactcttagggaagcagatgaaagactttatgtctatttgtagcatttgatttattaatttagttacacatacatatttaaattcccatgccatgtaaaatagtatttaatttagaaatctgctttttttccccttctggcagttatggagcaattttattcaaagccttcccaggccccatcattgccagagccactgtgcgtagcattgaacacaattttccagggcacagaatctccacttccatcatagttgtttgagacccaacactttgtggctttgtgtaaaatgctgtcactggagaatttatcacaagctacgtatactcgtttgcataatattaggagagtgttttttttattttcatttttttctttaggtatatatctatgatcttcatagtgtaactacttctgatattgctttttaaagtgatttgtaaaagacttgtttagaacaacatccccagcttgtaattctaaggtcaaacccaggaataattattaaataggggttaaatatctttgccttctcttttaacgattccatcaagcaaactcttatgagcatccaaaactagcattgattgaggtcatttcaggctaatgttttttccccaaatggtactttgttggttaaaataaagtaaatgagagaactgccctttaacaggagagtttgtcaggaatttgaatataagttcactcactcttcttattgaaggatgattttggaaaaaaaattacctttgccttttgcttggtcacagagagtagcagtggctccacaggtaattgttgttacattgaatgaatgcgcaaatctaaggatttcataaatacctgtgtatggcagaatgcctggcacatagtaggtgcgaactgaagacagttcttttctcttcctgagccccactgtatctttamcatctttgcatttaaggagtgacctgcaggttacttttgtctaccctctctcactcatgatgtaatcaggcccctgacaagcaagacctcttgatatccactcacacagcgagactcagaacgcttgtggaccagccgcacctgctccctttgcctgccttgtctgagaccacatggatcctcatcctccatgggtccgctttgtcatgacttattcaagggctttgcacgtgctgcttcctctgctggaatgcttttcccctgcctcctcctcctcatgagctcatatccatctctggtgacttcctctggtccctagatgagatcagtcatccctgctcaaactccatctgctgcccagtgttatgtcctcacagggcccagtacctgttcttcctagcgtttatccagctgcagtttagcatgcatttgggtgattatttgattgatgcatgtgtcctcccctaaattataagctcctcaagggctgggacctggtgtcccttcacagctgtgatccccatgctgagcatggtgccagacacacagcgggtgctcaagaaaatatttgctgcatgtttggctgagttcatggtgcctgcagattaagaagtttaatggaagatgaagggtggcatcttaacatcctgacctgcttcttgggtcttgaatcccctcccgcaggtctctggcagatgtcagtttctgtcattttgcacagatctgatgggctcaggaaatgaaggtacatggatgcccagaacttcgagctgtggtcattgtctctatacaatgtgtcacttctttctctggagagagtgagttggaccttttagtttaatcagccagttttggtatttctgggactcaggagtgtgggctgaaagttatcttaaaagatcactgtactggagaagctgaagttgtgggctaatggggaaccagttgtaatgaacatggagaggttggacttgatagctctcatgtcagcatgcctggaacctggggccggaaccatccaaaccaactagaaggtcacacagaaatgagctgagttctaccttgcttctacctgacctgttctgcacacaagtgttccatccagcctcttgctttctctcttcctttccataggagggctgggggaggaaggggggcccaggggtctcatttgtgcactccagcttcctcccttcctctctcccttccttcctccctttcttccccacttccatatcagatttttctggttttacttccccaaagctgatttctactcaaattttgatcccaagatctgcttctggggacacctaacctatgacacaatggatcctccatttcccaaggcaaaactcctagttagaattccacgaacatttctggagcgcacaccgcatgcctggcatagtgttagataatcaacatgcatgcgtaagccaaagcaggcatggctcctactctcctggggtttactgacttgtgggaaagacagacattaactaaacagttccatggccaggagaataaagtcaagatgcattagagtgtggagaaagaaagagatgtggttctgagagggagtaactgaggaaatggcccgaaactggagggtcagggaagacttccctgaggcagtggtccttgaggtgagacctgagagtgggaaaactgaaccaagtgggaaaactgatccctctgtgctgagggatgttagtcgaggaactgaaggaaattgggatgttgggaacccagcaagggaaggctacagtgaacacccgagggccaatggagtaggcaaaggttgagactgcagggtgtcgtcaaaggttatcatctttatttaagaacagagaagagccatggcttggttgatgcagtgcagctgcactaagcaggatggggatacaggccatgtctggccattgcagaagaaggtcatcccagacactggggaacctggcacatctgggaggttactatgtggtaccacagaaggcagagttctcatccacctcattcctgacctgaatcctaggtgacttctgtgaaatcttcagagaagtgactgcaggagggatctccttgaagacccaaatgtcctgttctctgaaaaggtttctttaatgctccttctactctgtctctctctccaagccaggattagttgccctctctgtgggctcacaaccctgtagaaacctctgtagagtcctctccactcactggagggttctcgagggccaggaccatgtcttgttagttggaatgcagcctgagtcccagggacagcagccctttatggatgtgctgaaggaacttcaycttcgctaagagttctaccacagtctaaagccaggcraggggcagttcgccagctctgcaggaagcacaaggcatcttctgatgcttcgtggcatctcaaatgaggctctgtctttgcactgcagatgggcccgaggccctaggggctcctgattgctatgtggttttcaagcccttggaagggcctgccaggctgccatatgtatgggcaacagccaaatagcctccttaagctacagtctctgctataagatccaccacgtggctttgcagaggctgtgcgtgtgacctgggggctctgtctgctgcatgcagggagctgctgcctcaatgatgctggtgggcggaagcaacttcatttctttggctgtaaaggagacacccaggtcctaccatctgtctgtgctatgttaactgtgtggctcggcagtctgatttatggggaagggtttgggaatggggacaggtgggagtaggaattcataagcagatcctaagagttctggcttctggaactcaagattggcacccttgggacacgggttggaaatgagatgagaattcttgaaggacaattcttccttgttcttattacacctggaaaagcagatcagcttggtttggacaaatgagcacttccttgggagatctttgttgcaacatttcttttgcctttctatacagtctgaccttggccaattcatttgaatcatctggtcttcagcatcatcatctatagaaccaggaagttggagttaatgccctccaagtctgtttccagccttggaattccatgtgcctagaacatttaggattctgggacaactcaaggcaggaggcagccccaagggtgtggctgagaaatttgaagtggagtggagtccacctgctctggtcacagccctgaggctgggcaggaagctgtgaactccttattaagctttggaatctaactttgtcacctaccagctgtgagacgttgtctgcttagtgtgccataacaaaataccatagcctgggtggcttaaacaacagaaatttgtttttctcacatttctggaggctgggaagttcgatatcagggtactagcactgttggtttctggcaagggctctttttctggcttgcagacagctgcctcttttctgtgtcctcacatgagagagagagagagagagagagagaatgagagcacaggctctctggttctggcgtttcttctccttctccttctccttcttcttcttgttgttgttgagatgaagtctcactctgttgcccaggctggagtgcagtggcacaatctcggctcactgcaacctccgcctcctgggttcaagcaattctcctgtctcagcctcctgagtagctgggattacaggcgtgcaccatcatgtctgtctaatttttgtattttttgtagagacagggtttcaccatgttggccaggctggtctcaaactcctgacctcaagtggtccacctgcctcagcctcccaaagtgctaggattacaggggtctcttcttaaaagagcactaatcccatcatgaaggccccaccctcatgacctcatctaatgttaactatctctcacaggctacatctccaaataccatcacactgggtggttaaggattcaacatatgaattctgggtgtcgggacacaaacattcaatccataacagaaaagtttctttctcaacttgagtttagcagcaataatggtactcacctgtatccagttatttattgccataataatgcagtgtaactctccccaaacttgcagttttaggcaacaaccacgttttatttctcgtgatactacacgtcagctgggtaggtttgctttcctgggtcaggcttggctgatcgtgggtgaggtcactgatgtctgtggtcagcttaagttttggctggttgagggtggccttggctcatgtggcttttctccacatggtcttccatccccagcaggctagcccaggctcattctcatggaaatggcaagattcccagagagtgagtggaaatgggcaagagctcttgagatctaggctcagaagtggcacgtcacttccgcctcattctattggccaaagaaagtcacaatatctgcccaaagtcaagggatgaaatgtagaccccaccccctaatgggagaagctgcaaagtcacatggccaagagcagggatacagagaggactgggaagtgggaccatttttacagtgaatcttctacaccacctcatatccttgctgtgaggcttaaataagattgtgttcttatagtgcttgatagtgaaaacacattaagagatagctgctattatgttattattacacttaagagtttgcagagctagacacagggtcagccactttatgcagccaggggccaaaatgagaagtccctctggcctgagcctttgcagggcacactgctctctcctttacacccagggaggaaagctgtggataagtgaggggccctcacccagaagggggttggcaggacactgcttttgatcttcttttagagttaggggaagatcagcctaaatttgttgcctaaatccagcaacaagtcatctttgatgagagaagagggtcagcatattctcaaagaccaaccgcatcagctggagggggcttgactcccttccaggaatttctcttgtctctgatgcccactctggtttcaccttgcctgctgggtgctacccaccccaacccccagccccaactcgagtagacagaaaagcctgctctctgcctccctgtgagtcctgtggtatcgcactctgggccttcagagttgctcttttgcctgcctgggatgataacacttctggcttactatatgagttctgagaaggcattttcagggggtcatgagagttaagtggctttttggagcctggactaggcataaggacagaacttcatggcatagtatttgtgttttttttccatctacagactcctttattaaggttccattttaggcagaaggcctatttacaaaacatgggaaagtggaattactctggctgactgtgtgtgtaagagagcttgtgtatgtgtgtaaacgtgtgtgtgcatgtgtgcacacgtgtgtgagcatgtgcttatgcacacatatgagcatgtgtgtgcccatgcatgtgtaagtgtgtgtgtgtctgtgtagggatgggggccagcatgtggaggacagcctcaaatcctgcatctttcccctttccctgtctctcttgccctcagcagcccctgaggaaagcctctgaggaaagcttttggatttcaccatagcacagttttaaaaatattgcagtaaaggccaggcatggtggctcatgcctgtaatcccagcactttgggaggccgaggcgggcggatctcctgagttcgagaccagcctggcsaacacggcgaaaccccatctctactaaaaatacaaaaaaaattagccaggcatggtggcgcatgcctatagtcccagctactcaaggaggctgaggcaggagaattgcttgaaccagggaggcggaggttgcagtgagccaagattgcgccactgcactctagtctgggtgacagagggagactccatctcaaaaaaaaacaaaaaaacaaaaaaaaatggagcaaagaatcgagacaagtagatgtccacgagagtagctatctcagatatcaatcaacaaagctcagctttttcttttttctttgtaaataacttttgttttttattacacaaggaatatatattaattgtagaaaaattagaaaatattaatgtgcaaaaagaataaaagtcatccattaccccattccctgggataactgcagtgaatatgttagtgtatacctttgcagcggagggtaaacatctttttgtatcactaaatatgctgcagcataaatttggtgccttggcattccatcgtatgggaggccatgacttactaaattaatcacctgtttctgagcatttgtgtgtgaggtacagctttgtacctgtctttgagcacattcttagtgattttctttaaaaagatttctagatctacaattgctggggacaaagggcattcattgcctattgaaatgttttgaattatgaaatctgcatatgtgtgcacatacatattagttttatgtartgtatatgaatagttcaaacatgttgtggtgtatawttgtatgccttattccttcacaatcccaattatctgcctctagcactttgctttagttccacagagtttgactccctttcccattcttcttctctatgtttgttctttatctctgtagtaccagagtttcttttatttttgtgttctctgtgatctgttccattaacatttagttatctcattttttttaaacatatgtatctatctgtctattcatttaaaaagccgacagcacctggtattcccaggcagtctcccattcaagtactaaccaggcctaactctgcttaacttccaagattagaggagacaaggcgtgttcagggtggtagggccacagacatcatctgtctttgaagaaataactttaacatattcatttaatttttgaaaagtttcaaaaattaacagtgtaaaaaggtattgggtaaaaattctcccaagcttcactctatttcacccctccccactccctcagataaatatattattaattttttagagggggattttctagatttttaaaataattataagcagataagagtataaattcacattccttcacttctgtatgcaaatacaggtatgctatgtatactttttcttcacattgatttttttttattccatagcacgtcttaagaggtatttccgtattagaaaggcttgcctatttttctcaggtgcacagtagtttattgtgtagatgtgccataacctacttaaccagcttcctaatgataacatttagattccacccattcttgtgctatgaaaaattgtgctgcatagaataatcttgcaattaggtcagtttgcatttttgcaagtgtatctataaagataaatacataaaaatggaattgcagagtgaaaggatttttgcatttgtaattttggtagatactgcaaaattctcttccagaagggttgtgccaatttatattcccaccagcaatgtataagcgtgcctgtttttccatagttttgtcaacagaatgcgttatcaaacttttggatttttgccaatctgatggataaaaatagtatgagagcacagttttaatttgcatttctcttttgaacaagattaagcatcttatcacatgctcaggagttatttgtatttcattttctgcgagacatgtgttcatgtactttgcctatttttctactgatttttgggaaatctttatagcaggggttttataccttgatttttggcatgtgttgaaaatattgaaccagttcattgattttttttttttgccttttcccttcatgaaacagggtttgatttatatatggtaaaatcattggttcctttttcttttatgtcttctgaattttagttcataggaaaacattccctagtacaaagttataaaatatttccctcacttttcttacaagtatttttatggttccattttaaacgtttaaatctgaggtcctgttaaaggtttttttttttttttggtatataattatctaaatcccgtttattggaagtttatcttttcttcattgattttcattgttattttatagtatactaaaatcttgtgtatatgtgagtctgtttctagaaatggtattctgtttcattgatctttctgaggtctttcacatgtctgtaccacactgttttaattattgtagctttattctatatatttttaaatatatatatacacattttttttttgagacggagtttcactctggttgcccaggctggagtgcaatggcgcaatcttggctcacggcaacctctgtcccctgggttcaagtgattctccggcctcagcctcccaataatatgtatattttaatacttggtctgattaggtctctgtgcacctccagctattcttttttttttttttttaactttttttcctggttcttgtgattgtttgtttttcctttagagttttaaaatcagctcatctagtgcccaaaacacagcctattgacattccattgcaattgctttacatttataagttattatagtttagggaaaaccaatctttatgatattgagttctacccaagaacttggtgtatctttccatgtttttcattcctttttttgcacttttttgctgctatttaagagactgacttcatatagatttatgcagtcaaggtcagcttattcctaggtattttatcttgctatctgggtttgtaaatttttccccttctgctaaatcttcaaattcatcattgtttgactatgagaattactgaccttttaatattgattttgtactgcactcttgttaaattttctggtttttgcttaccagaagtggatcagcatttcttcatgtgtttttcagagttcttatacaagttcagccatgggtacacatttgaaaacttatccacacattattaaataaataaatgtttaaaatgtgtaaaattatttattaatttaatactaaacactacatatatacacacacatacttcttacaaatacttttgagcattgtaaattccaagtaggttttgccaatagagaaattgtgtgcctccttttaaaatgcttaagtggctaaatgttagaaacacagacatttcttataaagtgttactgacgccctgtctccttggtcacccctcttaagtgtattgacttgattttccagtgatccctgtgagccatctgtggaatcacgcctggctgagtctggtaggaacacacctgggtttgtgtgtgtgcatggatgccatcatttctcctttgcctgccacacattttgacaaagatggatgatcagaaaatcagattgagctctctggtgggtgtttaacatgtacacacatgtgtccctgtgaacggaggagagtctcacctttgcaaaccagctgtggaaggggcaacatagacattctattaaagaaacactgacaatagcttgctgggcttaaacgatgacaaaaagaagaagaagaagaggtgagttgcaggcagagcccaaatatgtctccaagaggaggttatgtatttctcaaaggcttggacaagtaagartcatggatgaatctggtcccagaggtagtcaaagccaagcaatgcagccataaccactgacaggcctagtgccctggaaaatgcatgtcatctagagtcaccttgattctggcagggttcccattgctgggtaatggctggattttctcagtgccagtgagaagcagcctttgccttatccagggattaagcacgtctcttcctggtgtggcatagccggacttgctttctagttcagtcccccaatctcacaatcaggccaggcttttcctgggccatatagtagccgcatctccaccagttattcttattcaggaaataatatctttaagaggaaattttatgggtcaaaaatatctacactgctggaacgttgggtcaagtctaacaagatacaatttgatatggatcaatacaatgtgtaagagatcctcctgcaccatcccactcatctaatcaaagtatgttggtaggagtagagggggatgaggctgtggctgccacttaagaggctgctggaggcctggtcaattgctcagacactcagcatcatgtgatggtgacaggcctgttgtcaatacatgagttcacttctcagtcctgccgtttactggctaatgacttcagtaccaagttgcttaacttccctgagcctcctctcctcatctgtgaaacagggctagtggtagctccagcctcatggaatgacagaaagcaagacaacataggtaggaacttggcacaaggcttgatgcatagaagggctctttctggtttcagttcttgcactcattctgggagacaggtcaattaccatttccattttgtagagaagggactgagcttcagaaaggggaaggaaccaaagagccaaagcctgtagggcctttgagcttgcaaacctcccagcatgtcctccagtgtcccataatgttattattattacatgttgacactataaataaggtgagtcttcagtgggatgtgtcctgaataaaaagtgagtgtggctttaagccatgtggatctaccattttcagcttccaccccttcacatggtatttccaaacacaagcactcacccagaaccctggctccagaggggagaggcctttagcatcagctgggagtgttgccatgagcctcatgtgctggggcttcagcccaggcccctagcctggatctccttttccttgaaatgattttattcccaaatcttttggcatgcctctgctcctgggcctggaagagccactctggcctcccctgacaagtgcctgtaacttagaatattaaattgcaggtattggagttttggtgcctcttctcttagaggcctctgtaaggttttgaaggctccaaaggaagtaattacgtaaatagactcacaatcccaagggagtggctgcctctctgccctacttttacctaagatgggcactcaagtgatcctctagaggtcaaagaagtcaatgtcttctattctctattaaaaaaaatatggtactctgcttcgtatgcctatgaacttgaaatgaaataaatgcaaattagagccccttcctggtgatctctgatcctggaacctcaaaatactttgacttcttcactgggcatctggaatttgcttcccaaagtgaggaaaatgaacacatgttcatttgtgtgcaaggatggtgaacttgaggtcagggccaggagagcaaaaagcagaagctgacaaagggaatgcagtcaccgcattgccacatcaggtgtttccaatgaggacaaaacaaccgttattttcctcctgggaagtttcagtcggccagagaacaaaaatccaaatgccttcatcagcagagtttacgcctaagttcttgctaacctctgagaacagaagctcaatattacagcgagctccctagtttgtggttttgtggttgtttctatctaattagacacgtaatttcatttcgcagtcttgattaaaagtcatttttttccccctagaaaccacatctctgagtgcttctgctgcaccatggagggcactgaggtggctcctccgagattaacccaaaaatcatctccagcatcattgctgggttccaattaayccagagcttctttgatctcctcagtccttaatgtttacttcataacaatttgaaggcaaggagagggcagggttaggaactctgtttaggctgggcaatgtagcggtgctccccgcaaaagtactaattaaccatgaaattgtacacaccaccctattagcaacaagtcccttaacatccccattcactgggaataattgcctcatttctcagggctgcctctatgtcccaggaaaaagccaactctattaatcacctaaagcagaataagtgattttcagcttatgttttaataatgtgtgcccagctccagtctgtgtaagcaggggttggctctgctccacacttgtggattacagttctgcctgttgccagactaccttctcccaccagggcccaggtagctcaggaggctgagtcatttagatgagtatgtttcctgctggggagctgtctttgatgatgaactcaagtttggtattttcagtcattgaaggtgagacttcagtgagcttaacaaagattaattagttttgagaatgagcagctaattagtttcaaggcaatcatttgttctgatgctcagagaacatggtactgagccatggagaagtcctgcaacctctggtgtggccactgcctgactagagagagctgggggagcgcatgtggcctttttgctgccctgcagacctaggtggtatccccacttgactgcttgctaaccgtttgatctctctgagtctctgtcttttttttttttttttttttgaaatgggcttaaaaatttgtggcattattgttgggattcaaagcacttacagakgtaaagagattgcacataagtgatcaaaagttgtgagttttgtagggataattgtccagagatgagcaactggtatttccttttttgatagtttcacttgtcaagataacaatcccttcttcctctggtgggatggggagatgaatccaggtgtcaaggtgaatctagggttaactgttatatccaatctttattagaccaactcatggggggcaataaactttgggaggagaatgaagagagaaatttgtaattgtctacctgatgtgatcatgctgactattaacctggaactcagccacaggccactaagatctaggtgaaattgatatagggcaggcaagccccaagtggggcttagctcatgaaggttcctggatttgcccaggaaagaattcaagggcgagctggtggtagggtagaagaaaacagctttatggaagcagcagtgttgcagctctggtggtggtgcagctcagtgactgctcctgcaaagtagggtgctccacaggcagtgtgctgagattagcagctcagagcagttcgggagtcatattcacacctacttttaattacttgtaggttcgggggcggtttatgcagaaatttctaggggaagggtagtaacttctgggtcttcaggtcattgccatggaaaggggcaataactcctgggtgttgccatggcaatggtaaactgacatggcacaacggtgggtgtgtcttatgaaaagcatgcttctgccccatccctgttttagctagtcctcaatttggtccggtgtctgagccctgactccagagttgagtcccacctcctacttcaaaatcacctgaaaatcccctgctcaagtccatggccagtggaagtccaaagctcactcagagatctccccaagagtttgtaaaccactggcatcctttctctctaaactacggtttcagccagtgcagcctctgtcttgcaccacacctttcccaatgtgaaccttagtcctcctctgtttccaaccataacaacggccttcacaccaatgaccagtcattatgacaattggtcatgaagattgatagatgttccttaagatttgctggatggagtattcagagacagtcaaccaccactcggtgcctcgccttccttccaccatctcactctctcactctctctccccactctctctccatctcttttgcttatcttcatcctcccagagggtctcaggagccccatatgcttctcttgtattatataagccacattcctctcctctgaagctttggagccaggctaccctgaggaccgacgtgactcgtctgttgttgccctaagtgtctcttcctaaggaaaatcgcagtctcgcttgtcaaaataatttcccctaccatattactctgttgatcgacacattgtatgtccattttgctctacagtactgctccagcatgtgtagatgtggtcacccagtgcttcgagacctcggtccaaaaagccactgcagtggttgcaagtgaagatttccgaagcagagtcagggtttgaattccaactctgccattaatagttgcataaccctgggcaaataacctaatctccccatgcctcagtttcctcatgtgaaactggaagcaataacagaatctaccacaatgtgttattgtgtggattgaatgagttaatacaaatcaagagtattgactcttgacaacacttgctacatactctttgcatatgaacaatttcccctaaattgcaggctgcgccggagcaaggatttgtggtccttgcatcccagtgtcaagaggagggcctggtacatagtagttgccaataaacatctgaggaatgaatatgcaatgagtttgtgtgattctgcctggcactgactcagggccctgggatgctcttgcgctccaccaaggctccttgctacagcatccagttcggcagtctacacagaatgtacttttggcctgtatgagataacctgcaaaacgagccaccaagttctacccaagaacaaagggtattgcttctcctctagcagagaaaagtgtgatttctgcaaggtcccccgaagcctggaaatcactcatgttgctctcttcccctgccacatactatggttgcacatctctaagagttggggattccatgggggaccctgtaacggcacctctgtgatatgataaatagatgtgcctcttttgagtaaggtttttaggggaggtgaggtctcaggaccctgggaaaaccaggtgggctataattcaccctcggtggacatgcagatgagagggtagcttttatgaatgcctaattcttctttactaagcaaatcgggtatcttctgttgatcagcaatgtcccagttctagcactgcagaaagaccagcaaaaagaccagcaattaaaatgtaaccgaggtaaagtcactcactagcatgtcaaaagccattaagccaatgctggtttataagtttatgtgctatgattagcaagcaagtagggaaacgaagcaggtctttacctagaattttaaaaataaacaatgcaatgaaatgccattagccacttcaccccttcattcagcaaacatttatatggcacttattatgtgcttgccacttgctagactctggggatggagtttaacacagtgtagttcatttcctgaccttgaaaaccctgctatcttgagcagtgtttctgtgtgggggcttggtaaaatatctgacatttctttagtggactattgaaaacagatgtaaaactggtattatataataatctgtaactcactttcttactattgagcacatgtaggtaatgtttattaagtctttcaatgatcatgttaaaagagcttcattttcattttctattggcatgcattaatcatcactaaaatttgaaatctcacatgctcatatcgcttggggataattcaccttgtaggtaaagatccagttatttaaagttctagaaaatgcaagtttttgtagatttgtgagattcagtgtaagggctgacatttgggaaacaaatggaggatgtgagaagaaactgtatttgttaaagtgttcaaaaatcctgtagttggattatttatgatgcattgtacagttccggagcggttttattgaattcaattgagctgtgaatttgccagagatcagattgaagctctggctggatgcagagccaaggtaggtcacctayagcctgcagcctgcccacctgtgccctttcctgctcctccaggccccagcctgccagtaatgagggcaaggatcaccaggctgccagcaacaggcccgcaggagagctgcaggctcaggcctgcaggatgcactcccaggggaggactgccttgggctccctggcttcctccaggtgcagctccatgcccctggctgtcaggaaggtctgccttatgtcagtctaattccatcgaggtatagagggagctcttttccagtgtcttgtccccagattcttgatagccttcttctgaggggtctggcaagatggaggacaagggctggtagagaggagagttccgggagaaagtccctggctggttgcctgtgatgaggggcttggggcttgggagaatgttccccagttggggatttcaggtatatctttgtgtgtacgaaggtatgtaactccactctctgatgtctaataaaatagacactttctttttttttggaaactcagtcttgctctgtcacccaggctggattgcagtggagtgattgatctcggctcgctgctgccttgacctcactggctcaagggatccttccacctcagcctcccgagtagctgggaatacaggcacacaccaccatgcccagctaatttttacttttttgtagagatggggtcttactatgttgccctggctgatcttgaactcctgggctcaagtgatgctattgccccagcctccgaaagcacgaggattgcaagtgtaagccactgtgcccaggctagaataaacatcttgatggcttctcagaaagttttttctctgtgttggcatcttgggctttctatgatgtttagaggtaaagatgaagatgctctgagtacagcttggccattcaagcaagggcagggccaccacctcctcctggcaagtcccctagttcctgtggagttctttggtgcatcctgtaggtcttgagtttgctgttagcctacagtttgggtgttacaataccccctgctatttccaggcccccatgctccagaagcttcttggaccactgagcttccagttgatgcccacagagcccctgctctccccttggtcctgggactctgctcaggtagggctttatctctcctggtgaagcccctcttcctggtatccctttcctccaggtactgtggcccacactgtgcacccagaggcttccctgactctcatggagcctcccagtcttcagcatcctcttgggctgtgagcctggagtctgtggggccagaggcgtgagtatcaggccaggctgacttctctcagctgaggagagaccccagggacacagaaaaacctcctgtctgtcccaggggggattgcgaaagccatctttctggaaggaaggtggctttaaggactggatgaacttctttagagaatttggctgaagccctcataaggcccctctggagaccctcccagtttcccccttgcatggcgagggctgtctgaggagctggtggacctgttcctctttcagcttggtggttgggaaagggctgccactaagcaagagggttggctttgattggtccccttaaataaatccccaggttaaagctggcagcaagataggaaggttcacctacccaggtgggaggcctgacagggtcctcagtagcaggcagcgtgaggccagatatccatggtaagggacatgtgaacatcctgggtgaaaagtggtggaaattgtcagggctccagcaggcagctctacactcacrctcctcctttcagatgacaaagctgataatcttggggtttacatagtgactcttgggtcacagacttgatgttagtgttctgtctcacacattgtaatagctctgagtgacacaacagattttacagattaggaaaccgaggcttgatggtcaggggacctgtcctgggttatctagctagaatgatggggtactgggctttgaacccaggaagagtgactcccaagcctgtactcaggatactcaggctgctccaggtgcatcccctgactggccccactatggaaagcaatccatcggcacctgcaagccccctcttttcaggtctctacccaatacacagcactggccagggaggtttctaaataaggtcagctttcttgtggatcatggaacaggatgtggctaatgcacttgcagctcaaacatgcttgcatttctccctaagcccttggaggcagtaatggtgcaagcagatgcacattttgctctgttgttgtggtgtttgcaagacttcacgccttccaggaggcctcactagggctcaagggcctgcccaaccactcacaccctgggttggtttgcaggaaacagatgtcagcagacctgccttaataatggctggaccaaggagctctgggaggtctccgtgtggatgaataggtggagtgaagtggttagcaccaacacaaatggacagccacatcttgcatgacacatgtaagcaagtgtgagagagaggctgagtgggaaagaggacaagtatcaggaactgcgcaggagaggagaggcagaaggaggcagagcccagagagagccgagttgtgcagctgcaacctgaattctaccattgtggagacagccccaccttgggctgctgagcacttggatcttgttgcccagagaccaactttaaaaaaaaattgacacataataattgtacatattttgggggtaccgtgtgatgttttaacacttgcatacattgtgtaattatcagatcggggtaattagcatatccatcaccttaaacattggtcatttctttgttgtgggaacattcaaaattctctcttttaattatttgaaatatacaatacactattgttagctatagtcaccctactttgcaatggatcagaagaatttattcctcctatctaacataacaaacgttaacaatgtactcattggccaacctctccccatttcccccttgcccttttctcctcagtctctggtaaccacaattctactctcaacttctatgagatgggcttttttttttttttttttttaagatatgagtgagatcatgtagtatttggctttctgtgcctggctaattcccttaacgtaatgactcatccatgttgtcacaaatgacaaatttcatcattttttatggctgaatagtattctgttttatatataacacattttctttatctgttcatccattgatgggcactaagtttatcttgactattgtgaatagcactgcaataaacgtgggagtgcaggcatctcttcaacatactgattttatttcctttggatatataccctgtagttggattgctgggtcatacagtagatctatttttaagtttttgaggaaactgcatactgtttttcatgatgactatactcatttacattcccatgaacagtgtataaggattcccatttccagagaccatcttaactctgctttttcaggccccacaacagtggatgccctacctgaaatgcggcaggcactcagtgcttctcagattgcatcccgttctgtggagaaaagactcagacctctcctccaggggcttctgatccacagggggagagtgacaagttgacagataattaccactccatgtgctagtcttttcctgtcacacaagttctggcttccaagggctaaktatttatacctgactcttctgtgagttctgcactaattcagaagcatacatacaagtgagatagagagaaacgtctctattttattggtggattaaagacctgttttggagctgagaccaaaaatggattttccactatttcccgacaaatgcattgcttaggacctacgcgttgagacagttggtctgtagatctgatccttgtttggtcaactgctgggggatcccagcctgggcctcagctcgcccttctactcactcttgctggccaccactagagttaggtgagccagtggctgtcaaactcttcccttctcaccaagcaggtaaaacctttctcttcccaaggagagaagcttgtgaaaggtgaagaaaaggacaacagctttttaaaaatacatttaaggggtaaaatttcttaattaaaatctgagataaaacatggggaaagggagcaagtggtccctcataatgattcattaacatgggctagaaaaactcagaaaggggttttgaagggtgaagaggagctgttccaggtagtccaataggtaccaaaagggaattttaagtggaactatttattcacagagtggtgaattgacatgagctgtgtcatgaactccagaactkccaaggttgagggtggaggaataggggaaaatgaccatagagaggttaggagtgaggaatgacaaggtcctatttgcattctgattctctttctagttgagcatatgagggaaggaagggaagtggggagatgaaagaaaagtggttagctaggagacaatggaatagtcttggcagatgttcaagacctaaaggaaagaagtggtggtagggatataccgtagaggtggaagagaataggggtggatttctgacctgcttggaaagcgaaattggctgggcttgtttgttgcttggtttgctcaccacaagaataacgttggcttggactagggcttggagttacagatttagcctgttgaagagaagggtaggggctgttgtgagatgactcccctacttcaagaactaggaaatcagaaataagaccatcttctgcaagtcatcactttagccaacacacaatagatcctcacagacatgcacaaagttacgttaaagagaartgacacaatgggatatttagaaggactgagaagtggaagtagaggtttgtctgcccagaagaaaagacaaaggaatttcagaggccaatgttggccatgtgtgtctgaacacagtgcaaaggggcctggagcttgatccctggacttccagggtatggtttcactggcagtgccatcacctgtttagggcacagcacctgaaagctaatgggctttgaggctcatgagcaaacatggcagctctgcacatgattgtacatttggctaagtccccttgtcccattagtcacctcttgcttctgattcagcagcccaagagctgtacctccaagaaaagactgtagcatgtccagtggatgcaagatttcaatctgagtctcagatttagctggtgtttgtaatcgtacctggcttgtagctgttcatgggagccaatcatatgcatctcttccaatggtgtatcacttggagacattacactgatagcttgaaactggccacggtgggagtatcagtgtgctggggctaccatatcaaagcaccacagaccaggaggcttaaacaacagaatttattgtctcacagttctggaggctaggagttcaaaatccaggtgttggcagggttggtttctcctgaggcctctctccttagattgtacatgttatcttctccctatgtcttcatgcgatcttccttatgagtgtctgtgtcctaatctccttttcttataaggacaccagtcatattggattagggcccaccttaatgaccttattttaacttaaccacctctttaaagatcctatctccatatacagtttcattccaaagtactgaggattaggcctttaacgtatgaattttggggggacacattcagcccatacaatggcagtatttatagcatggaaaccagcaaatgcacaactcagggcttcccacgcccacccgagagctggatgttaaacatttaccaacacaccattgactatagctctcactgccaccccactcatttttttttggtgtatgcatccatttctttgaacttggttattcctcaaagataaacagtttctgagtttctgaactaacaaggctaatactaggcctgtccctggggaaagggatgtctctgtagtgcatcttagccccaacctcaaggcttcctaagacaataacctcttgaaccttctaagggaagcacatcttagaataatagtagcaatttttattgayttcttcctrtggaacagaccctggtctaaacactttgcataaagtagcacatcagtcctcacagtaactctgcaaggtgggtattattattactatatccttttctggatgagaaacttgcctgacaccacacagctgctagatggcagtgaggattccaagcttgcatgttcttgatcatcaggctccctgctttttgaggcccggatgttcccttatttcataccacctcaagtaacaaagtgtgattaactctttccaaagccagatcttggtccttgacagccttggttcccctttctggaaaagaagcacatctttgcaagtacctttgttgctcaaagcttggacggcaggttcgatgatatttctagctacctcgagccccattttccgttccagaaagtggtatcaaaagggcacctttagaactcactctgattgcataagtaccttgaataacacatctgtaatttgtgacatatattctctaagcaaaatatagtgagccatgcttcagggaacacactgtgctgttgtactaattaatttgtcaagttatggctaattataaaatgctttgttgcttattttgatttgtaatgtagcctacattgttttaaccactaatgggaagtggcagagtgtgggggactggagtgttccctccaggctgcagaagccgtgggctggtgtctgggttacctgggtcacaagtgtgtgtttcagtcgatcctcatctgctctgtaaggctggaagtccccgtccactcctttttcaccaagtgggcggtggagagccttcctgcttatcagctggtggacactctcaccgtgctgcagtgagaaggtctcacaaggtggcactgaagccttttgtttctgagcccttcagggacagggaggcaggacagggccacaggagggtatcctggccctctggagaaatcagttctgtacctctggctggtccttcttggggctggaggtgacaggctcgaggtgaacaggggaacggcgatgtggtcacagtgcctgcggctgcgttccaaaacttctcagatggcagcattccttgggaaatctgccagggtgcagggttgggcatttggactgatagcctcaaagctcgattttgtcaggacatttagaaggacttcctttccagggacaaacccacagcaaccagccaagaaaacccatgtgtgacccaaggccagaaatcccaggacagcatctgatggcctcatggagagtctgcccagcccaaggcggactgtcttagagtggtaatgtcccttgtcgtagccacccagtaccagtctgcccagggcttagcaggctaggcctggggtcctacacacctttcccccaactgcattgcatgagttctgtgacttctgtttctctgggcttccttctccatataccaggctgatcacctgccttccctttttcctaactgattgtaatgcatttggcgatgtgccctcacagccctgccttttgaagacacgcccaggtccacttgaggtgggctgcagggggctctcaaaagctttcgcctgagcctcccattccaagtgtttgatggtgccagtgtgctgatatttccccatattttaccacccctattttattctcttaaagcacctgctattttcactgggcctgtgtatctcaccttatatctatttattattatttatagatttatgttccatattatgttatattataaacatatttatttatttactttaatgctcattatctgtctccctcctggactatgctgttttgttcaccaaagcacacctagtgcctagcccagggcctggcaccagtggtcaccaataaaatatttattcaatgtacaaaaagtcctgcattgagaggggactctgggaacccttcatagacctgctctgtgctgccagcctgctttgactctggacacagtggatggtgcttgtgtggccagtgcctcctctgttgggacctgtgagcacatgtctggagctggatcttgcacagcacactctctaccatccatgctttcatagtcaagagggcacttgatgaaattaaaaggctgcaaatttaaaatagacacccttttttggcaacatattattaatcaacctttggaactcaatccttcaggatattgagtcaaataattcagcacgactaaggaagagattagaaagctctacgaataagaataacatctgttagcatggagcttccctttccagagaaatccacccctgaactgttaggtaaagtctcagccccagctatgatgaagggataacaggcctattagaactgattaggtaaaatcaaggccgctagtgagagggtggttatagacactgaccagggagagagatcttgtcccaaagacagcccagtcccaaaaacctcctttccaaatgactgtgctccctggagcctagatcctagatttagtaagtccccagtgattccatgtacctgtatacttatccatccacccaccatccatccatccaaccatctatccatccatccatccatccatccatccatccatccatccatccatccatccaccaatccattgatctatccattcatccatccatccaccaacccattgatctgtccattcattgcatccattcatcagtaggtccatccatccatcatacatctgttcatccaggcacaatctgaggaaaagatagacaaggcccttattttcagaaactctcacacgccaatgaggcaggccaaagaggaaacagatcattgtaattgtaatcacatgataaaatgattacaggggacatcctagatgccaggggagcccagggaaggccccttaccaggaagcaaagcctcaactggttcccgggaagcagtgtggtattgcggaaagaatgtttgctttggaactagtcagaaatggatttgaattcttgctctatcacttacaatctgagtgactatgggcaactgcttggagccttcattttcctcccctctaaaatggagacagctaaacccaccaggcttctggaaagattcagtgaggtgatctctgtgcagggcctgacagaatgcctgccattagcagctggtgggtaaattttggtgtctttccctccatttgccttctttggttacttttgaaaatgaaatacagatcttgtttaaaaatatttatatatttgatattctgcacacacatactcacacacacacatggaatttaacactctcaattcagcattaaatttctccctttttctgggcaactcacaaggacatctgttacctcgatgccattagctacgttagcacatctataagtacctcattaaaaaaatcgaatattaacaacatagcgggagctgtaggctttccatttgattactctgaagggtaagtttacttaaaataagctaatttataattctgaagttgtaaatttgaataacattgtcccctgaagacttttttcaatgaatccaagtgtagacacagaatcctcagtttccataggggcagccccagggtcaatggggatgaggtgacacagggtgacaccctctgattggcatccttctttttccttaactcagggggaatgcagccagcatgtttaacactggagctggttggtgggaattgggcacttgttgctgtggtaggagtggttaccatttccatcttgttaggacccctagtgagccactggttctgtgggtgtgatgggagagagagctgacattcttgctggcctggagccctgtccagcctggaggcccagtggccaactgagagggctccgggtggcccatcttcctgggactatggggaggacacagaggttcctttctgtctggatgttccttggggctgtcttatagtccacacttctgcaggcaagactgctgcccccctgcaagggcttcaggtggtctccctgcagagtttgattgtatttttgaaagtgaagtccacttcttatctcatctacacctaattcccagccttctccaactcttgttttcttcccaccccttggatgacccagagactgaagcatcattcatcctcatgggcttccatgaccagctgttctagctcctctctccctctgaggagcgtaccaagccgggcagcaagtgctcatgggctcttaatagaaatgtttgatgatgataattagatcatgggcaatttgttaccataacatttacttttcacatttttcttggaaattacatctgtctccagctcttctgcttgactcaggacagtgatttcaatttttgcaaagaatgtggcccaaagaggcaattcgttactgaagaaagagcaaaggccacaaagctgggtgggccaggcttctattccagcttctctgtcttctagctgtttgaatcttggaaagcttaagtttctgggcttgaattttcatgtttgcaaaatttcttctccctccctctcacagatatttatttatttatttatttatatttattttttaaattggatcctgatttattctttaaaaacctgatagaaatgacatttttgagataatcagggaaatttgaatactgaatgggtattagctggtatcaaggaggtactctttttttttttttttttttaagtatttattgatcattcttgggtgtttctcggagagggggatttggcagggtcatagggcaatagtggagggaaggtcagcagataaacatgtgaacaagggtctctggttttcctaggcagaggaccctgcggccttccgcagtgtttgtgtccctgggtatttgagattagggagtggtgatgactcttaaggagcatgctgccttgaagcatctgtttaacaaagcacatcttgcaccgcccttaatccatttaaccctgaatggacacagcacatgtttcagagagcaaggggttgggggtaaggttatagattaacagcatcccaaggcagaagaatttttcttagtacagaacaaaatggagtctcccatgtctacttctttctacacagatacagcaacaatctgatttctctttcctttccccacacttcccccccttacactcgacaaaactgccatcgtcatcatggcccgttctcaatgagctgctgggtacacctcccagatggggtggcagctgggcagaggggccccccacctcccagacggggtggccgggcagaggcgccccccacctccaggacagggtggctgccgggcgggggctgcccccccacctccctccctctcacagatatttaatgagcacctattacatgccattcagagagagatggccacaagccagactaagccccctttgtcatggagcctacattgcagtgaagtgggacaggtaacaaccagataaccacatagatataaatatggtgaagatgagtaaggggaaaagatggggtgagggtcatattacagaaaggtggggaggggagagaaggcccctctgacatgggggcatttgagaggcctgaaggtggtgacagagtgaaccaatgggacgtaggggaagaacatttaggcagagggaacagccagtgcaaagactctgagcaggggtgtatttgccatatgcaagaaacacctcagcaacaggtcaggtagggctttgtgggactttgtaaagaaattacaaaagtacaaagaaatgtactttaagatggaagctgttagagagttttgagcagagctgctgtgaagaacagaccatggtgggagaagggaaaggaaggaggcctttgagaacactgtggaagcaacccaggcaagaggtggtaggggctttgatgagggggggcagaggtggaaaacctaaacagtggtcaggttctggatgcattttgcttttttgttatttttgttattttagattcaaagggtacatgtgcagctttgttatgtgggtatatttcatcatgttgaggtttgggcgtctaatgatcctgtcacctaagtagtgaacatagtaccccataggtagtttttcaacccttgaccctcctcctgcccccccttttgaagtccacagtgtttattgttcccatctttatttccatgtgtactcaacatttagttcccccttgcaagtgagaacatgccatatttggttttctgtttttgcatcagtttgcttagaataatggcctccagctgcatccatgttgctgcaaaggatatgattttgtgcttttgtatggctgcacggtattacctagtgtatatgtaccatattttctttatattttggattttttttccatttaggagtggaggtttaataggcagaagaaaagagaaagagaaacagctctctctgtggaaacgaaggtctccaagcggaaaggaccagctggtggcaaatgtgccagattttataggcgggtttgaggaggcagtgtctgatttacatagggctcacagattggtttgatcaggtatgatgtttacatagtgcacgcagaaggcaccatcttgtttgctccttactgtacacgtggctggcaaagagaaggaagatggagccaccatcttgaacatgtctagtccttagttcctgctggcattcacctgtgcaagctcccagcttgcttgtctatgtctgcagcctgactttacaggctgctctttgttagaaaatgatttggagctgcctttcattcaaaaggaaagccttactgaggactcccatacccttactatctgcctaaatgatttcttcttaactcctatatcattccccactctggagtggtaaccctaactgctgttagggagtgttggatgatgactctttctggctacttactgctgaaaaggggcatcatgtgcagaatagcagctagggctcctcctggggttgatctaagggtccctggaagaaggcatgcccatgcatggttctatctgcagcaccatttggagtttgattgctgtcaaccattctgatgggtagtaacactgttttgcctccaccagatgtagctgaaacgttaatatacaagtaacattccttttaggataaatggtattggatttgggtagctagagaaactttattgttaacctttggggaatctttcctgcaattattaatcccttcrtgacttccacagaccatctaagacatgcttaaaccttctgtcttgtcctaaatatccttgttttaaaccaaccgttctctttaggaaaagcatttaccatacaagatcctttcttatataaaatctctttcctttataaccttctttacatagccagggtgtgatatactaccaaaaccaaaaagaagttctagtagactcagtgatagtaaaactttcatgcttcctttttgttggtaactattatcccttctttaaagagaagaattaagcaaaattctacagcaatggaaattctctgtccaatatttcagttagaaggtgctaccatgtatagctctactgcaaatagtagagtaagtatagcaattcctgcaagggtaacatagtagattatttccctctaaaattttacttgccaagatatagaatttccctctgggggtctatgaagttccttggttttattttcccaaacaaagaaacctctgggttatggacaccctactcactttcattacctggcagaatttgcaggttaattgcccagaactagcatattgatccagatttctatgttacccatccctttttgtttttttcaagcttcagaagatcaccactagattcacaagaataagcaaggttagtctaaatataggcaaaaagcttaaaaataattaatgtgactaggatttaatgacaaatgtatgataagctttggagtataatttctctctccagtcctcatttttggtaaaaacaaattatgatgggacatgttgttcatagaataaactttagtcttatacttggcgtgattatttgcataaagtacaagaatgattattaggccttttggattggctttgatggaactctgttccacaaggaatctcagataagacctcttaaaggtgagctcagacatgggttcatattctcaaatacctgtgagttgggtgatcctctcctagattttggatgtattttgaaggcagattgacagaatcttcttagagcttggatgtgagtcttcagagaagagtcaaggacagtgccatcacttttggcctgagttataagaatggtgagaccatttgctacaatgacaaggaggacagaggagtgggttttggggggaagtggaaaccagtgtgtttttggaaatgttaaatttgagaaatccaattagaagcttgaaggaggcagctggatctactatgctggagatgagaggagaggctggagctgcaggtacacctggggactcaccagcacacagacactgtggatagccatagtatagcattagagggatgcttaagggaggagaagggatctggggactggcatcagaagggttgctgtaagggctaagtggggagcataaagcaatcagctttcttgcctcccrtccttcagaattcatgggacatttcttacctttagattttacaatttggaagtctactagaagagctgggactttttttttaagtataaatattttgctcatgatgacacaatttttatttagttacaaacctgtcatttgagatgaaaatggccctttcccagagtccctcctaccaggtggcttttcagagagaagggtggatactccagtgccctgggcactggctaagaggtatgctgaggggagccctggctgtcctgagcaagtcatctctggtaaagactgagcatcacatgctccccccttctctaggtttgagcccagctattccatgtgaatctgcacatgaatatttaaagattccaatatctaaagatagttctcatcatttctagagcattccagggcagataacagatacctgttttgttgtaggaagaccagggccagttcacttcggtggactgactcacctgaagtcagacagtaaatcggtccataccagtgaccctggcttctaatcccatggcctgggaccttaattccatagccttgatgagtatataaaattccataaccttcccagaatgaaaggggtagagttgcccccaaacagcatacaaagatggaagctttgattacttgcacagctgctgtagtgcacagtttggtggggcagcacacatatgcagtgggagcaggctagggtggctccttgctcataattatttgtcaaggaagtattgggtggagatgcaggaggcagctttagagccacacacacctggtgggtgaatggcatctcagcgtcttgtgagatgtgtaatttgagaagagtcccctcacatctttgagccgaattttctcatccatacatcacggggtattaactcttacctccaggagtggttagaaggattagtcagatgatgtacataaaggagccagcacacagcctggtacaaacccagtgttcatcaatgtttattctcttgtctatatacagccaatgagaaattcatgatggtaataggtacaggttaatgatgagcagtttctgtaatgactgttgtgataatgtgagtgttgattttatgccaataaatcaattaggaaacctgagctgaggaaacaagatgtctgatgtgtaggcaaaacaaaggcaaacaatgtatgtgactggaagccgtcagctgtggcttttcctgaaggaaacttggtctcaaatggaccttgggagaagcagctgcagactccctaagcaggatatgatgatctgagttcaggaatataacacctgaaaaactggaactaaagctgtctcagccactaaaatcagataagggtttcatagcagcactgttcacaacagccaaaaaatggaagcaattcaaatatttgtcaactgctcaatggataaatagaatgtggcatatccatacaatgaaatagtatttagccgtgagaaggaatgcagttctgacacatgttacagcttggataaaacttgaacacattattctaagtgaaagaaaccaggcaaaaaaggactactatcccatgactgcattaatatgaaatgtccagaacaggcaaatccatggagacagagagcaatgagtggttgcaggggctgcggagaaagaaaaatggagagtgactgctaatggatataagattgtcctttgggggtgataaaaatattccagaactagacacagttgatgtattaaatgctgtggcatcttatactttaaatgattaaaattgtggattttatgtcatgtatattttcccacaattagaaaataatcagatagagaagtctgggattttactccaggagaccctcaagacaggctgctccttctgagtggagctctttgtcctgcctcccatggccccactgtgagccagacttagcccagcatgctttagacaggttgtttctttgtctccacgcagctgtgagagtggtgctctcctactttacaggccaggaacagaggctgagagcatgtcatgcattttctccagtcccaggccagcatgtgctgaactgggattcacaccccacacgtctccacatgagggctggacctgccaccataagcaccagtctctggtcatccagcatagccactgttgtttattgagcatttactatgtgctggctccagggtaggtctgggttgcttctcaccagttaggttcagttctgggtcccctatgctgagtacagtgtctggcaaagagtagaagctgagtgtgtgtttgttaagtacatattaggtttttgtcactgacatagttgacttggttgtagatggcaaactgtatcgaaggaatggctttctctttgacagccagcaccagtggagatttcaacaaaagcgagcctgagtcctagcttctctgaagtaaagctgcttgaaaccctcatcctccgttcctctgaaacttgacagccacagctcatcaagcagttgaaaatcatttatatgttcagaaatggacaattcagtattgtaaattttgaaaattaacaaactgttaaaggatcactgtgcacttgaagttgtggcagaaagcaagcatttctgcgcttgtaagagcaatatgtatgcgtgtgtgtttcagatattactcatcaaatacaagcatatgtttataactctccatctatatgcaaatagtttgtggtgtggcgcttatatcccaaacaaatagtgtgaaacgtatataaattatgcaataatatagatgttgcacatatgttagttggagcgaattatcatcaaaactctgggattggatgggtttgtgttgtgcatgttagcaacacccccttgggccttgagggcagtgccagtgaaggtcttgctgtaggaacaagccagagggtggtgtggccttggaaagtggctgctcccctgccccagggcacagaaggactataccctgaggcacagagcttagaggcaggttcctcagaacagaggtgtgtttttcaattttgcaggctcaaaattcaattttactggagttctaggggagtgattgggccagaggcattattccaggtcccaaaactgggttgattatctattcacagggagaagccccactgtccaggctgaagtctcacactggctgagctgcatgatatccgcttgtatacacagtgcagggcacagatatcaggttctgctccaggttcaaagttcagccctgccacttactatatgtatgacacctgaaggaaacatccaccctctctgagtctgttttcttatttgtaaaccgaggagataatggctcctgttctggggttgtggttggggtagaaaggacagcatttggaaagcacgtggtacatagaatgtgctcccaattggtggaaccccttgattgtgactactatcgtaggaaagctacaagggggaagccaattctaataaggctgcttgtgatcactaggaagtgaggagtcaagtgagtcaagttactcttgttggaatcactcgtattcaaggcctggtctctgcacttgagctgcatagttttgatagcaggacaatgcttcagaaacgagcaaaccaccataaccactacatttacatgcattatattacctagtgctcccaaaaggaagacttggtactgttactattcgtggtctgcagctcagccaggggaagccatgtgtccgggtcacagagctggtgagagggggccaggatttgagtccagcctctgtggactgacttctccatcagggctgctttctcgcaaactattctggccacatggggacatgttgctgcattttgagcctctcttatcacatgattcctgtttaaagcagtttcaaaccatgtgtgtggttgggagactaacattgggactgacactgcaaactcctcaggctagctttcctggaattagcctggtataaagactcctggggcccagatgacatcctaggatgactggcctcatcttatctactctgtggatgttttccctgtttgggtgttttcttggcagataggggtggggatacccacccactgtttccctgggctaggggcaggcagacccttgcatgctggaccagaagtgagtgatggggcaggaaaccactaggggcagggaggagaggctctgcccagccggctaactgtgaggctgctgggaagcagagttgtggacagaagcaagtctgggttgcagccagccagagaggtggggctcagaacaagggaaactaacttttggggggagccctcacctggctcagatctgctcatcttatggagccccggcaccatccacgtcatggtgaggctcctcgcagtgactttgcatggatcactgtgtaccatttagagcgtctcacaagaaaatttagccaagcttattttaggccaattgaagttgtaggcatgctgcctagggaaaaaatagatcttttctcacttgatgtgtgacagatgagagcgacagagaggcccctgcactctatcctacacaccgtgattgctgcctggggaactgggggctggctaccttattatcttgcttcttatcatcacttctgaggtgtttaaatgggtcgtttgcaccagacggctgggtgatagcggaagaagaatgggaaagaggaaataagcaagttattttgcggatgctaaccaggtctggctgtctctgcatactcatttgtaaactggatgatctcatcccggactgcccattccaaccctggtcatggctcatggggcccttgactagggaaatctgacagctcttattccatcctcagcaactggagacataagtggctggccttggttcagaggcactgtagaggagagaatgaagaggaagaagaggaaggcattaatttaacataattaatgagtactcactcatggcctaggcatacagacatggctgtgatgatgattattatttttgtatacttatctgtttatttgctgcagcctaagtgagacatggtgaggcccttgtcatgtgtagtgccgggacaggaagggaacttacttgattcatctgaagggaatagatgcaattgaacttagagaggtaggagaccaatgagatataaggcggagtctgggaggaggcctgggttctttcgtgtgtggctgtgtaaaycatacatgattcagggagcacaagaagtcaggaagaagaatgtgtttggtcagggggaggtggtgagtctggccttgggcatgctgggtgtgtagtgttggtgcggtttatgtgtgcaggtattgtcagcaagcagtgggtaataaagaaatggtgttcaagagaggggtctggacagggacctggagaagcagtgggygtggagcaggttgctgagagaaggtttagagggaaaactggactgagggactgagccagtggagacgggatgggcaaagacagcaggagttcaagagcaccctttgaaagtgggatcagattagtacttagcttgtggggttgtgagagttcaacgaggtaagggcttacagtgaagcacaggacacagtgagcccgcaggccatattggttgctggtgtggattgcagtgatgactgttattctgccttgattagttttctcagtctttcttgggacatacatttcaccttcggactaggtcagatcttagtgcggaaaggggcagggtctctctactgcatccctccgcagggcctctatttctccaagctgggaacccctgaggacagagtggcaggtggcagcgtgaggagttacagggacctccaagcaccctgggctggggtttggaggctgggagagctgcagtcgctctgcccaggaggcagtgattacaatatcctgtggccccccaacatatgacccttgtttgggtgctggtctctcaagaatcttgcaggtcttaaaaaaggaatttttttaatcttttttttttttttttgagatggagtctcgctctgtcacccaggctggagtgcagtggtgcgatcttggctcactgcaacctccacctcctgggttcaagcaattcttcgacctcagcctccagagtagctgggcttacaggcgcctgccaccatgcctggctaatttttgtatttttagtagagatgaggtttcaccatgttggccaggctggtctcgaactcctgaccttgggtgatctaccctcctcggcctcccaaagtgcttggattacaggtgtgagccactgcacctggccaaaaaaggaatttttgacaccatccattccccagtagattagtggccttgagctagcctctcacagagacctcggggaaaaaaaagagcgtcagaactgccctgtgtttttttttcatcctttaactgactttggggtttggggctaatgacccttatgggcaggaggcagcatggctgaccaggggacctccctggcctcaccctgtggccctgcactgtcctacgcaggagccaccagacacaggtggccattgagggcttaaaatggggccggtgctactgagcacctaaattttaataatatggaattgaaattagtttaaatttaaaaactgacacttgattcaagtattagaaaaaattttaagtatgtttggaacaacttgattatgtgactcttctaaagatacattttataaaatataaaatcagatcaagtatttctgatgaaaatttagcgtttagattaagatatgctgtaaatgtacaatacacactggtttagaagactgtatgaatgtaaagtgtcttattaatagtttttatattgattacatgttsaaatgataatattttagacatattgggctaagtaaaatgtggtattaatcggtttctttttacccttttatagtggatgctagacaattttaaattgaatatgcagcttgcattctacttcttttagatgcggctgctctagacagcccgggacccaggctgcagctcaccctcagctgactaagagctagtaagccctttgcagacacacctgagggtgaagctctccaaatcttctggggagggtctagcgtagcctgtggtctgagaagccgatggctccagggttcacttacagaatatactacgcaggtgaatgggaaaattttgcaggtttaaaccagacatcaacctgaatataaactatggacctggggtgaaaatgatgtgtcagtgtaggctcatcagttgtaacaaacatggtactgaggcatgggatggtaataatgtggagatcatgcatgtgtgggggctgaggggatatagaaatctttgtcttttctgtttagttttgctgtggacctaatactgcttttaaaaatgaagtccttttaaaaaacaaaaagcctcaagcagaagaaaagagtaagaaaaacaattaatgaaacaaacaaacaaaaaccctaaacagacatctcagggtgtcatcaatatctttttctgggggaaagaaatctgttcaattaatccctactcatcaggggcggtgtctgctgatcagatcagatcacagcattgttgagcacattatagtattataataaaaggctcagctggagggaggagacacctgttcgccaaggagtctctcctgagattcttaccagraaacccagagaagcccagatagggagttaatgccttttaaaaatttgcttggcttccatttgggagattaaggccttaaatcacacctgcaattgcaagtggattcctcccaagctttgatgatggtctttgcattgtagagtggctctcagacacttttatcgtcctcccaggcaggcaggcaggcaggtcaggttgaattaaccacatatgagaatcagaaaagacaaaaacgccttgcaaagtggtctccaagagttctggggggctgctaatattctgttttctcatctctgtgtgttcatttatgaaaattcactagtcttagggtttttgtacttttctatatgtctattataacttcagtaaacatagtttaacaaaaggctccagagtcagctgtcactgtcatcaaacccacaaggaaccaggaagatgctgctcccagaagggcttcccttctccccagggaggccttatcctgtggggcctgcctgtcctgtgggctttggatgctggaggcctgtagtgctggctgacctcagatgatgctttaggattttgcaaatggtagaaatggagctaatgatgaattacaaggcactttccactctccccactccatctgttacttcctctgacctacagtcacctccacactcttgactccattttaataggcaggaaattgaggcttagagaagccaaggtcactgagcaaataagcagtaaaggttggaactcagttcagcctgattcccctgagcccacaggctgtgctggggctgtgcccatatgcacacaagggcccacaggctggagctgcatgggcgagtgtcgactcctgcacatccagcatggatggctcagtcggtcagcgccaggaaccatcctgtcagtcacacagaatctaggcagccggctctgcttctgctcctctcctgtgccaggctccatccttgctcctgcctggcactttgcaaatgtgtgaaggtcccactctgttatctaaaggaaactgatttttccctcacattggaacaagtttgctcataagtggatgtgcactgtctcaccttggccagggcactgccagccctctgaggggagtgtgcagaatgctaaacgtgcttgttgacattacacctgagacatgtttgtgttataaatgggtacaaattgaatttggcttaggtgatatatgacgtctgtcatggttttccccatggtaagtcagttagaggagagctaatttatttcagattgggcattccaagctttcattgtgcctagcatggccatatttccctctgcaatcactaggatgaagctggcaatgtaccagggctgccagtgagctggctgctgccatcagtgtgctcctcgaaccaccctggccctgggtatacatgctgaggatgcctcgtggccttggccaaatagatttttgccttcttttggcccatgaagacctggcttggagccagacctctgtttgaatcctgacctgccactattagctatcacactagctgtgtggctcaaagcaagtcacacaccttctctgaacctcagcttcttaatctgtgaaagacagagatgccaacttccacccagtggagttctgggaggattaaatggacaatctgcaaagggcctagcatgcatgtgaattgcttttcctcaactgtgaattgagaacacagattccacctgtgttcctggctggccagggtgtggttggaatggaggggggtcatgggcaggaaaggggaaatgccccatgccccgaagccctccagtccccaggagccctctccctgatgggggcactatggacatcctgatgagagcaggtggctgaggcattatgcggtttgtagagaggttcccaggggagcaccaccataccaagggggcacatgcctgtgcagagcacagctggggtggagggggcagctgtgtgaggacaagcattgtcagcgctggggatgcgggtgtgcaggggtccataggcccttctgtggtgcagatgccaaactggtctggttgtgtttctgagtgggctttgaggcagctgctaggcctctagttcaagctgcctatctcttttcctctgtacttttataggagagggaaggcttcaccttgatcaaaggcaccatcttgtcctataagaggcactgggtcctgggttgtaagcacagtccagaatccagtgttaggtgtcctgactgtgccttctgatttggagctgcaaactcctcagcccacattgtcagtatcttttggagaaggcccatcatggatggaatttgcatcctctcttgaagttacccaagtgcagaaaaatatttggttgcatcatgagaaaaaagaagacaatattgtatgggtggtgttaaaaccctgagtctgtggtaactgttgaaacacatggcagcctcctgccacacagcctttggtggggcagggagatggagctggaaggcggggctgatcctctcaaccacaggccagagctccccgagcagcaagtctttgtctgtggccccagcattctggctggctgtttagggctggtagtctccagaggcactcacaggaggtttggaagaaacagctctggaaggcgtgggcacctgcagtcacgtgcatgtaacaaagccagctgtttgctcttggcctcggagctgcaatcaagaacctaggacttgttggagtgagagacaggttgtcatgctgtgtgagaacactgcatgtgtaactcgagttcccccagacattttggcatgggctgccgtctgtcttgtagcatttgctacataagcctgtcttatctcccctgacagggttatgggaggccagagagccagtctgctttcctcacacctgctacaggcacttacagaattctgaccaagctgggcaattttggtgtgtttcagggagagctttctgatgccagggtttggttgtggctcatggcatgaaggagctcatcagaagtctgtgtgctcatgaaggagctcatcagaaggctgcggtgcatggcccakgsccggatcacccctccactggaacagaggcgagcagactgccctgttggatgtgaactgttgctccatatcgttctctttttcctagagctgtgggacaagtacagcaccttgcagctgggtgtgaagtgcctgggagagtgggtgtgaagtgcctgggagagtctgtgtgaggaggagggacgtggcacaggaaatctgcggtgaggcagctgtagcactgagtctgggcatggtctgttgggctcagagatggggcaagtgcctccacacacgtgagcactaagggataggccaacctcctctctttccctcctttgcaaggcccaggctggacctgcatcctctcccaaatcttccttctctttcctacttggaatccccacacctgcttttctacctgcaacatgctcagaactactaatcattcacaatcatcagggagagctactttgattcacacaaataactcaagggtggaaggacacttgtgttgtcagctggatacygtggccctctggattgaatgtctgccagccatacctgccccttgtcctggagacaccagggccaatacagccaaatgggctatgacattgaaccatgacccagttgtgcctgctcaagggttttggggaaggtggctggagaacccctgcttctgcaaataaggctggagcaacaggcagcctggtgcgtagttctgtctccgcatgctgatggctgcaattctgtagcaaaagtcagcacttactggggtggggtcagtgcttactaaaatataacatgagaccctgtagtccagccttctttgacaattcaaattctgagcacttgctgtgtgcctggtcacactgcccagagaagcagagaaagaagatggagaataaggacaggttatacatgtctcttgatacttacccatgtgccyggaattctattttcagttgttattcccataggtaaaatgagggaattgaaccttggagagatttgagttattgtctcaaacaaatgttttatcacacatagcaagtaagtggttggggtcaaattgsaaaccaggaatacttagcagcaggtccaatactttgtgtctgtaacctttgatctctgtagttacatgtgtgtaacttcttcctgggatttcagactatttctgcttcagggcctagcagatgattggcacacaacagcactcagtaaaagttcattgaacgaatgacttaggccatgctagactcaagaccaatgcctcctcttatcagagcaccctcattctgtggatgctgagtgtgagagataatacccctgactctaaagtccagggtccctcaaccatgtggttctggccacccagctgctcaccatttgcggggagatggaataatacacataaaagagggtgctgggtttagaaatgggaggcagagatctgagagagcaattgtggtataagactattttttagagccattgaaaataaaatatcacagaagcaggaaagatgtgaaatggagaaaagaaagactaagttccttcattcattgtatattccactaatatttatggaggactactttgtgctagacgctgttctcggctgctgggggataggagtgaagaagacagaaaaagtctacccaatttagagagaattcatagaaattaactcttactcataactctcacttacatggttacacatgaagaaggcttgcttcacttgattccttagcaaacatttgccgccctacactctagggattcagaaagagagattgctgctactcttataagagatggtgctcttaccatcctggctaacacggtgaaaccccgtctctactaaaaatacaaaaaattagccaggcgtggtggtgggcacctgtagtcccagatacttgggaggctgaggcaggagaatggcaagaacccaggaggcagagcttgcagtgaactgagatcgcgccactgcactccagcctgggcaacagagcgagactctgtttcaaaaaaaaaaaaaaaaaagatggtgctctttggggtcagtctgactatttaactcagcctcttgtttacttcctaccactcttctgagactttggtccctggataactgtcttcctcaccagcccaagtccagacataatgctcggtaacttccctgtctatgtggcaacccctcaacacatttccttgacctcctgatttccagtgacccactcctccactgtccctcagcttcctacttccacagccccatcatggtccttagcatcatctgaaatgactccagctcctgctttctggccacatctgtaataatatctgtaataatttcccctgcctcaccttctgtactgtcaggttcagattgcaaygatgaagtccgctcccactaacttaatcagctaaaatgacggattgttaagacactaggcaggtcacagagtcaatgggaagtccagagaacaagattaagaaaatgagcagcaaccaagggagtctgggccccagagcagttggatcccctcagccacagtagggctgagcagtagggctgttgctgaacgtggctgccacttccactcgccctgccacttcctccacagctggacattggcttgcactagcatggtgtcaatattctcttagagtgcttgcatttttgtatcagttttcatcatatttagaaagttgggtaagattatcctgtttccaccttttgccatagctgccagagcattgggagagaaaatatctaaccccattaagcatctttggtaggaggaatgagctttctaagaagactaaagctgtggttgagtttctaaccaactgaaagggagtttggtggctggaaagccaaaggaaagccaaatgttcacgacattattcctttttggctgactgacacccgtgtgcgtttcttcaacccatatttttgagcacctgctatggaactggcacagttctaggggctgaggcagtgaaccaaatataaaattctctgctcagatgagactttgaggagatggacaataaacaggatgaataggtatatggtatgttatgataagtgccacacaacattacaggaaaaggagctgtaacatgttgagagggactcaatgttaaatatggtggtaagaggaagcttactgggaagtgggcatttgagcgaaaactttataaaaggtgaagaaacaaagtatctgaataactcaagaaagggtgctcctggcagagaggacagtaaacataaagaccttaagtgagggcttgagtagatgtgggggcttacatggaaatggggctcgaatagaatgtcctccaatcagataagaggccagcgtggccagagtcacatgaaccagaaggagagtagtaggagatgaagtcagagggaatagtgcccagcctgaaaacttgctccttttaagtctatgacattctggctagaaagtgagccattgactgagtgtaattgtagtgctatggcagtgcgcttctggatggcatctacatacttgccgagtgatctttgtggtatgcctaaatctgcttttcccatccatgctaaaggcagtcctgatgtgggctgagagagagcctgctgtgtggccagaatgtgcaggcaaggagaagccttctggtgactttcttgtggctccagggcctgaacaggcatgaccatgtatatgcccttgtactggatgatggaatgctaatgcatatccttaactttttgactcacttagtgaatctgaaaacatccagtctatgttgggtggctcagcctatgcattaatatggtttccatttagtatggtttccattattaggcatttcttctttcctaagtctgttagaaagtcaggaacggcccaatwtgaaaaatgagaatagcttcttgccaagtagggcataacttggctcccaagccctataaatgtctggcatgtwtaacttgtgtgagttccatacagcatcctcactcagtggagtcatgttaaatcctgacttgtgggagctgagtgtcagagcctctgtcctgtagcctggaaaaagtagagagcttaccctttatctgggccccattaaaagttgtcagaatttcaacttctccagtgagtggatcagagcagcacacccaaatatggcatctgttgcttccaaatccagaaaggctcacctagtgttgtgcctctttgtgaataacatgggatgcaggggacagcatcttgttttttcttctgcagagtacattctgacaaaccatacagcactgagcttccacaaaacttaactaagttttgcaggttcatacaagttattttctaccatatatacacgtatcttatcaaggcacttcatacctgctaacttatgccctctatgtctgtcttatcagcatgatgtcatcaatgttttagactagcatgatgttcttctcttaamtggtcagacggtcaaattcttatggactgtgtagctcagagacagaaagttgctatggacctcaggaaggatagtgaaggtttattgctatagctatctggagaaagtaaactgcttctagtaatttttgttgttgtttgagataaagggaaaaacatactgacaggtcaataaccatgtacaagttgctagggtctgtattgatttgatccagtaagagaccatatcagaaacagcagatgcaattggagtcaccacttgattaagtttatgatgatccactgtcaatctatataactcattactttttgtatctgccaacttagaaagttaatatagggatgtgagtggaatcctctgctttgtacctttcaaatagttaatgaggaagcaaatttatctgatttctctagggatgtagtcatgtttttttgttgttattttggtaggaagagggaaatagtttacattttgcccttttggccttattagccctcacttgattttcagggagagtcaatcgggaagtttatcttactgctgaagatatctattccaaacagacactcgggaaattggaaaacagctattgaataggtctgaggtcccactggactgactagggttgaaactctatttttcatttgacctgcattagcccctactctgacccatgggtagatccagatgtccaggaattaggattagtcaagatccagcattcaatgataccccaaagatcgtggtattatttcctttccttcagtgcaaagggttatcctgataaatagtgtcttagatcattcaggctgctataacaaaataccataaatgatttcgcttataaacaatagtaatttatttctcacagttctggagactgaagtccaagatcaaggtcccagcagattcagcgtctgctgagggcctacttcttggttcatagaaggcattttgtcatggagttgtcacatggcagaaggggtaaaaaagctctcaggagcctcttttaaaagagccccagtcctattctagcacttcatgatccagttacctcccaaaggctccatctcttaataccatcgccctggaggttaggattgcaacacctgaattttgggggggacacaaacactcagcccacagcaaatagtttcaggtccctttagggaaagctaagaagtattaagtattcatgatacttaattgtgatgctttatgtgagttgaggtcttcctgccttgtaaaaggttcagggtcagggtcaattaacctctgccagctctctccatgggttagaacattctgacgacccctctggctctgccgattccctaggtgctaggtacactttactcctggtgtttgtgtgggtgctctgcccatctctgttgaaatcagggcactagtttcaactgcagttgaccaacactttacagcctgtggagaccaggcactaacatgtttttccaaaatgctagcactcccctcatctttgtatttatcaacacttgccgaagggagtggcttttgggaatgtggttataggtgagtagggtgaggtacatctactttatttatttatttattttttgaggcagagtccctctctgttgcccaggctggtgtgcagtggttcaagcaattctcttgcctcagcctcttaagtagctgggattacaggtgcccaccaccacgcctggctaatttttgtatttttagtagagactgggtttcaccatgttggccaggctggtcttgagctcctgacctcaagcaatctgctcgcttcggcctcccaaagtgctgtgattataggcgtaagccctcatgcccggccgacatacatcaactttaatatttttttggtctttggactgtttcctctacattatgtcagagaagtttggcatctcaacttcatttagagttcatcactgttgagtttatatttctgttaaatagctgagcaaacaattagaaccactctcagctgcttgtactaggacattgaatttagaattctggcaagtgcttccatatcagtgaatttagtctgatctgaaattacgttctttcctccttggaatagtcttctcagagtccagtcctttatgttcagttcatacatcgagcctcagatttagagatctgagacttttttttcctctttccttcatttatacagagcacttaaaagctgccatcctaatccatgccattgtcattaatctcttcatgcttttcataatattctttgggagtcgagcattactgtcccaaaattttgcttttaattcattttattcactaaacaaatatttaatgagcatttattatttgctaggtattgttccaggtgttaggtatagcagatgaaaaaaaatgacaaaaatctctgctttcatggagttcccaatctagtagaaagtttatttcagatgatcacatgtgctaatttagtgagttatttcgtcactgcaaaaatattggcttccagctcctcatttctgaatccaaattagattttcattatctttgccctcaatgagattagaatatcagccccagatttctctccttacttcttattgcaatcggctattaagtaatcctcacattttcattttgaccatctctattcttcatccagtgtgagtttttttcaaaatgcaaaatgtgaaagtcatctcctgcacctaccctgtcctttaaagatccctatcccaaactcctttaaaggtttctatagaatttagggcaaagactggaatcttgatagccttcatgattcatctgccgcctaattttgcrcatatttcttctgccttatttttttctacacaaacacatacacacacgccttcacaccttcaactcattacttttttttttttttttggagacatagtctctgttgcccaggctggagtacagtggcaagatctcagctctctgcaacctcttcctcccaggttcaagcaactctcctgcctcagcctctcgagtagctgggactacaggtgcacaccaccacacctggctaatttttttgtattttagtagagatggagtttcatcattgcccaggcctgtctccaactcctgagctcaggcaatccattctcctcggcctcccaaagtgctaggattatasgaatgaaccaccatacccggcctcattacttcctttycatattcagaaatcaatttaaactttactttctggaatcccagtcccactcctgccaacatggtctggtccctgggcaccctgcctgcccttcatagccctcgctttgatttgtaatcaaacatacagtattatggccatctggtgaagcagttttcccttcctatgaagtaggccccaagaaaatgggcatgtgtttgtgttcgctgctatagccccaatgctcagcacactgtctagtatgaagtagtattcaatggatatttgtctaatgaattaataacatcatgatagccattgtaatgtttgctcattctctaagtgccaaaataggagtatatactaaaactgttgtcaattgcataagaagcccttcaaggattccaagggcagtcaaggatggcttcctggaggagaaagagtttgagctgagaagagaactgagtttgtcttttcatgggtgtttgagagttgcctggctatttttgccctggatcctattctgtgtctgatatgcaaacctggatgaggtacctgatggtttaaagtcactgtctggagtcaaggaagtggagaggtctcattttgtaccagtcctttggagatcactgagacatgggttttcagcctggtaactttcttgcctatgtatctgctaatgactatgacccatctttttgggttagttctcctttttctccattccggtgtctgatgcagagaatttaggaagtttacagacctctgcttaggttgggttaggaaaattccacataacatgttcatgtccctgattctccaaagttcttgtaggagggtgagaaagcctttgcagggaaagaacataaacagtgttgggaaaactgaaatctaatagcagctttttctgctgttcctgctataattaccttccttcttggcaatgactttacctcttctatcactgctgtttcatttgtccaataaactcccgattatccatcttcaacagcgtggcctggctttatctcaggcaattggttccagcagatggattgattagaagccatttccttcccaaattctgttgcttgatgttcctgttaacttttatcatcagggctgtagaatcctctcctagctgcctgaattcatgcataaataaaactggttgcagctaaacccccagcctctgccatttaaatcccaatttatctcactgtgggttgcttgggtagaaatttcgtttgtggtattgagttgagaaatgtcaagaggggcttgctgttaaaaaaaaattcttctgcaacaaacacttacgcttcttgcaaggatgagatcacagcatttgtctgaccagggaaatgggtgtcctttcaaaaaaaattgtccactttttttttcggttataagttggacctcagaattggattattcataatccttggtttgtgacacaatctcatcattgctgtgtgtggccagagctcattagcattttgaatgctatataatattacaataggacgctgttgtgaatggtgtctcctttgtaatccattctcctgttgataggcattagacatgatatcaagattttgctattgtgaactgtgttattatgaacatttttgtgctgcttcctgctgtacatgtgcaagagtttctcttggagtggcgctggatygctggggacatgaatatttaaattaaaccaaaaaactcccaaattgattgtatcaatttattcttctaccagcaaaatatgggagatgttcttgatttacatactctgaaacacatggaggtttcttaatctgtgtccataaaatgtgtataaaatggcattttattgtgttctggatttgcatttctctgatcaccaaggagactaaagaacttagttttatttttcacaggtgtttccttttctgtgagaagaccatttgtgtctttgctcatttttctgttgggtagaagatccttttcttattgatttatagaagctctttatatattattcataaattcatggtcaattataagtgttacaactattatttttccatttgtcttttttacttccttgaagcttttcattgataaacacaagttattaatttggatattgtaaaatttatctactatttattctatacagtttttttttggtttgtttaagaaatcctggggcttgatactgggttggtggtctttgtccagaaatattaagggatgaagagggctataaccctccttctgagggtttccaggaggagtctgagggtctagcttttctggtgaacccagttcctgttcctgccttctttcctaaggccctgctcactctggcttccaccacagtgccaagcccctctggtctccaggggagggattgctctgttacatagcaggatcaggggtaatcaggccaacaggggagatggtggcaatttttcttttttaatctgtatttatatacagtcttatttctttaagcccatacactgtctcttaccccatcttcctctcaggtgacaatatcagtgagtgccatacagaattctgtattcaccagcatcatgaaacgtttgtggtcttttgagttgatcttggcagagtaaagggacatgtcctggagccattcttgaatctctctccccttctttgtgacaactccccctaaccaaaaataaataaataaataaataaataaataaataaaaaaacacaaaaaacaaaaaaaacaaaactgaggcacttcacttagaaactggggtcctgcttataatcatgcatataacctttactttgatggatctggccagaggggtgttggascccagccctcccacataccagacaagctcttaggggagcagaagaaaagcaggaagaatttaaatatttaatttttttaattgacttttctagttattaaaagttgcttgtttcagcagtgatattgtataaagaacatcttgtaagatactcctgacatctcgctttggcacatgtgcagtacagtttctatgataatgtgtttgctctaacttccctggcttctccctcagcccatccattctcctgcagagcagttgggttggaggctcattgaggcaagcagcaatattggaggtgggggggtgcggagcggtgctgcgaccactgcctcccatgacccttctgacctcagacttggaactcaagaacctgaggattccagcggtcagtgtcagtggggggtgggaggagagagcrgcagagaagctctgagagccccttcccacaacaaatctagttctagttgttatatttaggcaaaactttgtagtcttctttcccttttatgatggattttgataaaatacaaaacagcgtttaattttcttatcacctttgaatttggaaattttgagcacacaagctcttctgtacctatttaaattaaagtccaccaaggggactgcagctcctagaacatgagaatcaagcctctcaatattaaactgcggagtgtgacccctgcttcccccatcctcccgcccaaggacgacggggattgctccagagctgctgggtagtttaccatcccttctataggcatggagttggcactgacatcacagcttcataaccccaccaccgccagcttcccctgcctcctacatccagtctgttcttgttcatagtgagaatcctgtgttcccacttcagtgacacccgaattgttttttttttttttaattgtcttcaaggaggaagggccccattaaagggtgaacttgtaataaattggaatttcaaataaacctcatgtacttgtgttcataaagaaaaaaaaaatccttttctacccctagatcagaaagatattcacctatgtaaaagtcctaaagttagcttctgtcatttaagtgcttttttttttttagacggcgtctcgctctgtcgccaggctggagtgcagtggcgcaatctcagctcactgcaacctccgcctcccgggttcaagcgattctcccacctcagcctgctgagtagctgggactagaggtgcccgccaccacgctcagctaattttgtacttttagtagagacggggtttcaccatgttgaccagaatggtctcgatctcttgacctcatgatccgctcacctcggcctcccaaagtgctgggattataggcatgagccaccatgcccagccctgtcatttaagttcttaatacaactacagctaatttttgtgtttggaatgagttaggttttgaaattaaccttttttcccaagtggataatcatattttcttatcctatttattgaatagtcctcatctgtctgatgacctgacctgccactttggacatctagaacctttttacttatgaataatatctgttttaggactttgtattctattctgcactagtactaccattgcttaattgctatagattcataataatttttgatatttgataaaacaaacctcttcactcttccttctcagaagtgtactggctattcttccatgtaaattttagaattagcttattagggttcatgaaaattctgtcagaatcttgaatagaattgcattaaatatacagataagtatgggaagaatttatgtctacataagattatrtatccttatccacaagtatgttatatatcttcatttatttaagtgtttcagagaccagatagggcctgtgtttcaatagttctcttgcctgctgtcaggcaaatctttgtcacttacccttccatatcatactgtgagctatcccccaaaacattatacattcttgtatcttgtctgaattctatgtctgctcttactcaagataatggcgatggttgtctgacatcaaggagtctggatatgtgctttggagctatcactatgacccccaccaaaatttgaccacagtgtgggatcccttatctcatcctggtggttaatttatcagtgatttttatgagtgcttgctttcattttttggtagttcaggtatcctgtgctttgttattagatattctagtttcacacccttgttcccctgctacctaatctacatgattaaccagtagtctctccaacaacatttacccttgctcatgatctttctccttactctcttaggggtagccttttatgagagggcaaagagttttgcctttttttttttcaatttattttacaagtacttattgaatggagctggctattgggaagcattacaaatgtatgccctgggggagggggtatcacacagtataagatgggagccatcgtggttggctggctggaactgtgggtcaatcatagagtcttctgcaggagaactgttcctttcagtgatcctagtaccaaaactgaccagctgtcaggattcatggcatctgtccacttgtgtttgattgctagcagagctgaggcatgcccaccatccaggtccttgccatatactttgggagaaaagatatagaatttgagcctgaaaatatttcattgcttkcctgatgtgacgttggtaagttattcagctcctctaagcctcagtcttactccttataaaatggaatcaatgatagcttcctcagagtgtgatgttacagtagtttatgtcttctttgtccttcttgtctcaagattccagaaaggagaaagtaggaacagtgcaatgaggtcatttttcatctgtccatcagctgctgcaatactgggcaagcgctggagggaggggatgctagggttctccagagaaacagaatcaagtctgtgtgtgtttgtgtgtgtgtgtgtgtgagtgtgtgtgtgtagaaagagagagagacagagagagatagagagattttaaggaatcggctcacacaattacagagactgaaatctgcagagtgagccagcaggttggagacccaggagagggccaataatgcagatgaagtttgaaggccatctgctgcaaaattccctcttgttgggagaggccagccttctgttctattcatgccttcaactgattggatgaggcccactcacatcatggagggcaatctgctttactcaaagtcagaggatttaaatataacctcatcccaaaaccatccatctcacagaaacagccagaatgtttgaccaagtatctggacattgtggcccatctaagtttacataaaattaaccattacagagggactttgggaagctctttttggcagcatatctatctcttctttgataattaggacatttttcaaacatgtgtaaacctccaggagaattgcaatattcctccatgtccattctgcacatttctgcagaggcaggattacagaatgagtaagatcacagatgtggggtcaggtggcctgggttgaactctggctctgcctagtacggaacttaggcaagttacttaccctgtctgttcctcagtttccccattgggaaagagggtaaatagtatacctctcttacagggtagcagtgaggattatctgttgattggattcctgtgcacagtttccttcttcctgttgctctgctgcaagacattggggagtttctaatgttttgctgaaatgggcagtgctgtagtgaacagtatcctgttgctttccttgtgccctatgtatgtggcacagggcaggcaagttggcaggtttcttagctattgccaaagggatctccaagttcgttacactttatttttcacatcctggcaaatatttggttgacactgttacactttaaaatctctgcctgtaagatgggtataagtggtgtctccttataatgtgcatttctccatttatagatgtttgaatatcttcttaggtacccattggccattggcttctaaacccttatggaaagagagctgctctcacatttggtgtctgctgatggcagcctcctcgcgtacttgggctgggtgaatatgggaagtactcatgcacacctgggctccacgagtggctgccacatgtcctgctggctgctggtggccttggcagctctcagaagctgcctgagctctcaggagtctggattagttgggcttccctgattagtcactgaagtaatattctaaatggggcacaagtgccagggaattaaaaatacttcttgtttttgaataagaagctgacatgttcttaggacatcagggctatatctggatgaacagctgtcagctgcctcatgggctctcccatccagctgatgtgccaagggctccccgttctcctggctccctgacttcccaagagcaagtctcattagacaaagttcagtgagggcagctgcctcctggctcttcatcatcaactctatccccatggctcaacacgtgcttgacacattgtaggtatgcattttcatttgttaaatgaatgtgtcaagtgtctacagatgcccaggaggttctgggttagtctggttctgggcttcattgggttcaggagacagaagaaagggaagcccttttttgctcttgtgggtttgctgttgacttgtgcaatgaatcaaactagctggaggacagtcatcccttgctctgcaagcggagttagggccaaccctaagatcttgctgtaccttgagaacatttaagacattgaattttcatcagtctttatggctttcttctgtttatctttgtatccccagcacaatacatgaggtgtggacatagtatgtgcacaatgaatatttactgatggaataaacaaaccaatggaggaaggcacaatgattctcattaaccacggttttgaaatgccacttttgtatctgtatattaaaaggcttaattccacagtttttaaaaaatatgtgcgtagttcaacacagtccctttaaacaaaataacacagcaatcactatggctcctttcttttgtaggacatgtggctgagtctggggggttgtaagtggagagacatttgtttatactcctcccaggcccagtaaccactgtaataattttgtgaaaaggctaggaggttaaacaaggattttgctgatacttaggaaatggagaatgtaagtgcaaaaagacattaagttttacgtctgtgagtgctggtttgaaaacttcataaagaggtgcagcctgtattataggaaaacatacaactcaggggcagctctgtttttccaagcaattaaaaaaatgcaattcaggataaagggagaaaggactgaatgccagtgagctttagaatcagttgctattagtacattaagcaaatgaatgccagcattcttgttttacctgtcattgtctattttctatgaaatgtcggtattttaggttgaattgtatcacctcatggatgtgttgaagacttaacccctggtaactgtgaatgtgaccttgtttggcagtagggtctttgtagatgctgtgaggttaaaatgagctcatgagggtgatcctaatccagtatgacttgtgttctcataagaagaggaaaatttgaagacagacatgcacaaagaggaaatgcatgtaatgacacggacacagagagaggtggccatgtgaagagggaggcagagattggagttatactgccacaggacaaggaatgcctggggctactagaagctggaagaggcaaggaaggatccttccctagagactttgaagggagcacggccttgctggcaccttgacttcagacttctagcctccagaactgtgggagaacatgtttcttttttttcaggcatccagtttgtggtcctttgttagagcagccatagcaaactaatacactcgatgcagctgttcagttacaacaatcaagctaattgtcaggcatctcccacaaatgctagggaaactttctggatcattggatgctaaactttgtagcagaatcacagatgcctctgaagcygaatctgcatttgtaacagatgccctttctctgcaaggccaaattccttcaggaaatctttcccaaactctgacaaacaagaaagattgaagaacagcactctaaggagtcaccaagctcagggaaagtggctaaacagtgctccaggctcagaaggaggaatttggacatgaagttaggtgggtcctcaaggtccacctctgccctttcaatgtcttatcaatcttccttctgtatcttctgagagactgagtgagaattgatggggtgttttgtgtggtttgtgtcatttttttttgtttgcttattttgttgctgtttgcagttctctaaattttaacacatataaagattcatggaatcaccacctcaatcaggatacagaacagctccatcaaaaaatttccttatattatccctttacagtgacagcattttcctaccctgagcctctagcaatcactgatttgttctccatcatgatggttttatcattttgagactgtaatatgaatagaagcaagcagtatgtagcctttgagaccagctgcttttactgagaataatgccttttagattcatccacattgatatgtgtatcagtagttcattttttaaaaaattgcagagtagtatttcattggtgtatcatagttggtttctccattcacccgctgaagaacaagtggttgtttctagtttttggtaattatgaagagtgccactaaaagctttttctggtatgaattttttattcttgttgagtaacacccaggagtgggtttgcttagttgtatggtaagtgtgtatttaactttattaaaactatcaaacttttccagaatgacggtccattttgagttagattttgggaaaggtgtgaggcttaatttcaggttcaatttttttgatatatggatttctagttgttcctacactatttgttaagacgctatcctttctccattgaattgcttttgcactgttgttaaaaccaattggctatatttgtgtgggtctatttttggactttttattctattccactgatacatttgtctatcccttcaccaataccatgctgttttgattaccataacttatggtgagtctgaaaattgattagagtgatttcttcaactgatttttcaacagtgtttagctgttctaattcctttgcctttccatatgtatgttggaaatggcttgtccatattatgaaaaatcctcttkggattttgttacctatagaccaatttggagaggattggcatccttgctaaactgagttttccagtctgtgaacacaatttgtctttccatttacttatgtctttgatttcctgcatcagtgttttgtacagattctgcatgagttgttagttttataacttttttttccaagctattaggaatagtattgtctttagattttgttttccaattctacattgctagtatatggaaacacaactgagttttgtgtatgatcttgtatcatgccactttgctaaatttcatttttgtttcaagaaattgttttgtaagttaattgaggttttctatatagacattattgttggttgtgaatagggacagttttacttctttctttgcaatctgtacacgctttgatttcttcttcttgccttatggcactggctagggctcccagtaagatggggaataagaatggtgagtgtgaacatctttacctttttttgttcttagtgggggaaagctttaaatctttcactattaagtataatgttagacataggttttagaaatagataccttttatcaagttgaggaagttctcttttagttttggtttgcaaggagtttttattgtgaaagaaagctgcattttgtcatgtgctttttttctgcatccattgatgtaatcaagttggtttttttctttagactattaatatagtgtattatattgcttgatttttaaatattgagttagtcatgcatttcttagataaatccaacatggccatgacatattaatttttcaacatattgctagattcaatttgctaatagttaacattttcttaaaattttttgtatctatgttcatgagggatattcatctgcagttttctgtttttgtactgtccttggttttggtagcagggcaaatctggcctcataaaatgagtggggagtgtacctctctcttctatttctggaagagattatgcagaattggtgctgttacttttttaaacatttggtggaatttttcagtaaaatcatctagtactgaatatttcttttatggaaaacttttaactatgtgttacatttatttaatacttataggagtactsaggttattgagttaatcttgggtaaattttgttgtttgtgtttttctttctttctttcttttttttttttttttgaaatagagtcttgctctgttggccaggctggagtgcagtggcacaatcttggctcactgcaacctctgcctcccaagttcaactgattctcgtgcctcagcctcccaagtagctgggttatagacgtgcaccaccacatccagctagtttttgtatttttagtagagacagggtttcgccatgttggccagactggtctcgaactcccgatctcaggtgatccacccgccttggcctcccaaagcgctgggattacaggcgtgagccactgtgcctggccttatttgtgtttttcaatgagttggtgttctatgtcatctaagctgctaggtttaagtgtacagagttgtttgtagtattcccttcttatcattttaatagctgtggagtctgttgtgatgttttatcttacttttctaaaattggttatttgtgtcttttctttctcttttctttgttaggtttgctagagctttatcaaatttgctgatgttttcaaakaatcagttttggttctgttgattttatctgttgtttttaggtttttaatttctttgatttctgatctttattattttattccatctgcctgttatggagttaataaaatgcttttatttttatagtctcttaagataaaagctaaaagcttaagttaattttttttaaatctttctttttwttagtataagtattttattgctatgcatttccctctaagcactggtttacctgtgtctcacaaattgtgcagtgttgtgttttccatctttatgtaattcaaaatattttctaatttttctttagactttttttcacccatggattatttataagtgtgctttcaagtgttcggatattttcttattatctttcaaataccaaattctaatttaattccattattgtcagaaaacttttatatgattcacttattttacatttgttaggatttgctttatgacacaggatatggacttccttggggaacgtttcgtgggctcttgataaaaaagcatattctgctgttgttgtgtgaagtattctataaatgtcaataagatctagtaggttaatggatttgtttagttcatgtttatctttgataatttttttgtctattaaatctatctattgctgagaaagttttgttggagtctataaaattatgcatttatttgtcattttagttcctccagtgtttgcttcacataacctttatcattagataatatttctctatgcattataatcttctttgctctgatatttcatttgtctgatgttaatttagctactctggcttttatttgattagtgtttccacaatatgtttttccgttcttttatgattaatctacctatatcagtatatttgaagtgagtttcttgtaggcaacatgtaattggtttgcttgtttttttcaaaacatattccatcaatttttgatcgatatgtttagaccatttacatttaatgcatttagtaatttctttagatttacgtcttcctttttcttgttttctgtttcccctctgtttttgtcttttgctattttctgccttcttttgggttattaaaacattttttaccattccttttggttttatgtattgtgatttttactatgtatctttgattatttttataatattgctttggagattacaatatgcatacttacgtttttatagtgtactgagaatcaataatttgccactttaagtgcagtgtagaaatcttgccaccatttagttccctctacgttcatcaaaaccttatccaactatgttataattttttttttttttgagatggagtctcgctytgttgcccaggctgtagtacagtggcgcgatcttggctcactgcaacctccacctcccaggttcaagcagttctctgcctcagcctcccgagtagttgggattacaggtgcccactaccacacccagctaatttttgtatttttagtagagatggggtttcaccatcttggccaggcatctcttgaactcctgactttgtgatcaaccctcttcggcctcccaaagtgctgagattacaggtgtgagccaccattcccagcttatgttatggtttttacttttagctatcacatgttttagagaactcaaaaggagaagaatctattgtatatagactttattattttcaagatttttttctttgtctctagtttttagcagtttaattgtgatttgtctgaacttgggtttctttagttttattctgtttgggtttgcagaacttcttaaatctatagatttttgtctttcaacaaatttgataagttttaagccattatttctcagttttttccttttcttttctttctttctttcttttttttttttttgagatggagtttcgcttttgtcgcccatgctgaagtgcaatagcatgatctcagctcactgcaacctctacctcctgggttcaagcgattctcctgcctcagccttctgagtagctgggattacatgcacccaccatcatgcctggctaatttttatatttttagtagaggcagggtttcaccatgttggcaagactggttgctctgataacacaaatattagatcttttgtttttgtttcataggtccctgatgctctgttcatttttaaaaatatatttctcttgttctgactgaatcattactattgatgtgtcttcaagtttattgattctttcctctgtcatcatcgttcttcattgagcccatccagtgaaattttttttgttgttaaattttagttattgtatacttcagcataacattcctatttggttttttaaaagtttcttgtatttctttgctgggactttttatttttccatttcttttaggagtgttcacaattgcttgttggaacatttttataatagttactttaaagcctttgccagaaaattacatccacgtcatctttgggttgatgtttgctgattatcttttcccatgtgagttgagattttgcttgttcttattctgagcaattttggattttatcttgggaattttgaatattatgactcttggtttcacttacattctgtgaaaggtgttgatatttttgttttagcaggttaagttcaggccacaagctccagcatgttgcctgtgggctgttaccaatgtcagctcaggtttgaaagcatttgccgtgctcttctaatcattctggtgtgtgtgccacccagtggccagtctggaacctaatggtaatctgtcttttatcttttattcacagcttttatatactgattagaatcctatccacgtatgagcagctcaggagtgagcccaggacttcataaaccgcttgttagagttgctttcctgagattttccttctctgtgacgtcctcactcttttcctattctgagggactctttgatggttctccaatcagctgtggctttggagttcttgctctgctgcacacttttgtggctgcatctgcctctagggcaaggggtcaagagkgttagaggataaaagcttggtaaacttacagccagtttggtgttctttgaattcttgttttcttctcctatctgcctgctcatgtttactcatcagactccttgaatagctgccacatgcattctgtccaggttttatgactatgttcaggggagaatcatggtgggtgctcttactccattacacctagtcagtgttccttaatcagacatgcacacctagtcaactggggaacattttccccttgcatagtttttatggagtcatgtgagtgggggtccgaaactcttcctcacccctaaggctggagaccctgaaaactaaggcagagccaacagattgggagcagaggcatccggctgcctgctagttgggaacttcctctctttccaggattctcttaggacacttgctctacccagaaataaaatacaggattgctgataggtggccgtcccatcaaagttccacgactagtgatagattattggaaacgactttgttcctgaataatgcctttaagttgaattgttataagagaagcttctattttctatggctgtagcattattttctataggtgcagggttccacttctgaaaaataacttttaacataaaaatccgcaagyctaacatgaaaataaatggaaagaacataaaactcaactatgtgcctttaaaaacatttatagtaagcatgtgaaggcaaacagtgtctatgaaggttaattttacatttgcagttgtttcagccaggtggaaatgtttaaaaatataagccaaatggcattttgactaaagattctgtcttgcattctcaataaattttatatattaggtgcttttgattgcttcaataacctttaaactgaattcaaaagtagggaattctggtccatagtaggctgtctctgtaaaagcataggccatcttacctactcttttctgacagctggagatgagtttacagccatggtttctggactaccaggcgaccagctgggggaccccagcattctgtccactgccacaactgcgtaatcacgtgctgagtatctaacagctcaccaataagtggcagcatgtgtgtatccatattccaaccaaaatggacctctatttcttcatttcagggcctcccagcatcccttgggtttggccagttttatggttatcactgaagtgggcagctagggttctgtgtggtccccagcatctaattccaggtgtgtgatttaagggcagagatgttgggtgctaggattgagattattggctgttaatgggctggattttaaacaattttaatctcaagttggcctgatgccaggtgagctttgtcctctggaaagcaccctgccttacctctgtccactcacagatgctgacactgtgggatcctcacagcagacccggcaggtcaggctgccatgctgtgggtcactgcacagcatctgtaaacccagatggagggtctgtttcttgagctggaagagctgtttggaggcattgggtcaagcctctttctgggtctggtttgctcatttttctttcctgttgtttggtgtgtttgaaaaatcaaagccgtttgcagctcctggcccaggacatgtttgattagctggttcatcagggaagatggctcagcagggcaggagtccaacaaggttaaaagttgcaatgtccatctccgtggaaggggcacctgctccatatttaaactggttatttgatgggacagctgcctgacagggcttggacatgacttctgtgtcaggctgccatgcaaggaaacatcatctactgaacatcatcagagacggaaaggggtccctggctttgattttgggcgagtctcattactctcctaggcacaattctcctgtctataagatgggtatataatgtaattttactttacagttttgtcattaggataaaataggacaattcatgtaaaagcaattagccataggctcacatgaagtaaaatgctaagtaaatttaaatggtgctcttcatcattttcttctccttcttcttctcttattactagtcatgggccctggctggggtacctagtttctctaaaccttttccttgtgtatagagtaggagcagtagtagctcmtttgcagacttgtaggaggattaaatgggacagtaggaggattaaatggtcctaggaccagtgggtttccaacactaattgcttccctgaccccatttgattgatataaatgtccatgcttttaaaatatttgctaatatttacacatacaagtgacccttgcactgtggcttgcctatgtgaggcagtgtcctgggatggcccataccattgatcggagaattagaggcctgctccccactacatatctgccagctcccatcctactgccttgcttaccttggccaaagctgcccctgcacctgcacagattctgcccactgtcctctcccacatccctccccttgtcctctgtacctgctgttctgaggccagcaaataccctggcctcctcctcttctcttaccttacttaccttaactcaaaccggttgtcctctggggatagcctgtcaagttgaaagtcttattcccttcacattccgtgtccctcaggaggtgtcctttttatattatcttctttatctcctgcaaaccatttctttcccttcctgcaccaccctatctttttctagctcttttaaaaacttctaaaattgttattttttagagacagggtcccacttggtcacccaggctggagtgcagtggtgcaatcatagcttactgcagcctcaagctcctgggctcaagcagtcctactgcatcagcctcccaagttgctgagactacaggtgcacgccaccatgccctgctcattattattattattatttttagagacagggtctcactatgttacctaggctggtcttgaactcctgggctcaagcactcttcctgcctcagcttcccaaagcaccagaattacaaacgtgagccactgtgcctggcctctttctagttctttctagcttattctagctcttaccatttgttccccccccacctctcctcatcctcactgccagctctgtcccctctgttatcattccctgaacactctggctcactctttcctcccacctccaatctggctcatgcccagtgacctcctagtgagacctccaaccccacatgttttcacaaaacccttatcttcatgtcttcttagtgaggcttcaagatactgacccataataatctctcccttgcctactcaattttcctgttcccttttctttgtgatattcaccaggcaaaactcccacatgagctaagcctgaccatcctcttttgcatacctgtgcctgagtgctgagtgttgctgtagaaaatgacaaagccagggtgctggtcttccttggtattgctcctcacaaatctccatggcttgcactgtacttccctaaaccccttttccatgctttgtcttctcctttcaacccctcctcctcctccctccttatttagccatcagatgggagccccctcatctcccatctccaaagtcaagcccacctgcacttgcaccagctggctcattgccccatcttgtcacacccagggaagtaagtgttcttgcaacagccacttgccccctgccctgaatccatcccaatttcccctctaggattttgccttttcttttccacatttctcttctgcattactaatctcttcctatccactcctgcattgctgctctgcctagaaacttgttttagaacatttaatctaagaaagcaaccctcccacattttccacatcccctttcagtgattgctctgtttctcctgattttgttttctctccttttgtctgattttccacccgccacaatttgtctactgatttcaccctccttctcctgaaatgacctttgtcagggctaaccatcttcctattttccaattttctgctctttcccctcttccttgccaccttggtgacatttgacacagtgaagcactgcctcctgacacatttgcttctttggtctatgatatcagcatcagcccagagccctcctgacttggcagtttccttcgcaggctcctctttcttgcccaaactcccactgtccacctccccagaggggcagtcccgcacctcttctctgtctcttccctcctttcttggtggtctcatctccaccaatggcttcaagtacttgcacattaatctactccaaatgttagcctctagcccaggcttttcctgtgagccttcgcatccacctggatgtttcacaggcaacttggccttagcatatcccaaaaagaattctctactttgctcctcccctactttgcccacctctcagaatgactctacaggcagctggttgcttgagtccaaaatagaaatcatccgcatctccccctttcccttgtattctacattcaatcagtggatccaccagcatcgtaaggaactagacccagccagaaggaagccagggacctcacctcatccacagacaatcaggcaactctgggcatctctctactcttgcccccttccctcatgggtcagaggagtggaggctccaaggagcagggagggcgcaagaggaatcttggtacaagatcgtgcttcctaccccagaacaaaggttacccatgccttgggggacagtggaggtaagcattaaatggggtaaaatgaacatgaactttttaatgattaaaagtgaccttaaagttatgggtatcattctgggaccagggataatgactgaaggaaaaaaaaagyctttatatttttattctattkgtttccgattgtctaacaaactaattataataaatgtgagcacatcacttcctgtttcagacttctcaaaggtgttccattcaacttaaaataaaacccaagctccttttagaggcctccatgcattctactgcccacctctctccacttgcagggtgcccacctctctccacttgcaggggacctctcttccttccttcctcagcactctgagctcttcgagccccatggcctttgcacatgatcttctggtttcctggaaaggttttggctgcttccttgtggtttttcttaagggcacctcggttgaaaggctgtcgtctctcatgatttgttttctatgtttctgtcttagcacctatcacgtatttgttgaattccttgtttcactgcatattgtctcctttaagtgagtcctgtgtgaaggcagatcattcctgccttgatcacacttattccccctgagcctcatacaagctctgcatctgttaggccactgataaatacctgttgagtgtaagaataaaattcatttactggcttactggtgtcacgtgaagggctatttcttctctgctgagcagagatgagtgtattgtgaagctaacgatgcctaagtttcagggccatttgcttgcctgggttccttctaaggcaatgtgatcaacaggtcatgtttttgaataatttgcaaaggtgtcttgtttgttcgaactgttataacaaaaataccatagacttggtggctcatatactacaggaatttagttctcacagtttggagactggtcctagatccaagtgcagacagattcagaatctggtgagggcttgcttcctggttcacaggcggctgtctttttgctgtaatttcacagggctgaaggggcaagggagcaacctggggcttctttttataaggcactcattatgagggatacactctctttaactaatcacctcccaaaggttccatgtcctaataccatcgtcttgggagttaggatttcaacatgtaaattttgcagagatataaactgtcagatcctagcagttagatgaaaatcatgctttcttttcccttcctgtagaacagcggtctccagcctttttggcaccagggacagatttcgtggaagacaatgtttccacgsaccagtgggggttgaaggctagtttcaggatgaaactgttccatttcagatcaccaggcactagttagattctcatgagtgcacaacctagatctgtcgcatgcttaattcacaatagggtttgtagtcctgtgagaatcaaatgccgatgctgattgaacagggggcrgagctcaggtggtcctgctcactggcctgatgcttaccacctgctgtgtggcccggcttctaactggctatggactggtacctctattgggttcaacrggaaaatgcaggtaccagtccgtggccagtgggtggacccctgctgtggacccctctgtattaatcatgtttttgattccccagattttaggatgctttgacattttggagctttactgaccagggaaagccttcccctcagggcaagctaattcctacagacagcaaatgacccacctgtgacacactttttgcatgccaaacaacctgtccaaagccaatgactccaacaacagcctttgtggaactctcactggccaagccactgttcccctgccctgatcaccccagtgccaggtagcaggcaactctcgatagtccctaacacccagagcctgctagaattattcacaccagccaatcctaaacctgcgtaatccgcctctcctgtttcttccctcacaaaccgcacaaaaagctcttgtccacattttcctcctgctccctgtgacctgactcaccctggggyttccccatgtggccccaaaaggtgtgccctgcctcctctttctagggatctgtgactctgtgaccacaacagacttcttccttcatgggagtcatttctgtgtctgtgtatctcaccatccttgattaaaagaaatcctggggatatgttaaaaatcctcccaagttgtataaacagatagcatcccttggtcaaagtggctttggttgtgaagtccctacagattcctgcgcccatacccacgtgcatctagaggccacaccaccaacctgtggctcagccaccccggggacagaaacccacagccaaggcccgggaacttagtgcttgagctgttcatcccctatgggcaacggtgaccttgagaggatcacactttctctgcttaaagtcattccctagtccccctaggcccaggggtctaggaaggcccaggttggggagcagactttcaggcaagtgtgaaaatgttacttctcttcttgtaaatgattcatttgatcacagagcctctgccagtagttacagagcttctagactgaagtgactgaaaaaagcttccctacatatttacttaattcatccttatatttcattcatgcaacattcactggacttttgccagactctgtgtgaagggtaggggacacaaagtacaatgaagccacctctgcccctgaggatcagacagattaatcaatgattgggtctcagggtgacacctgcaacaatagaggaaaatgcagggtattgggagagtagtggggagtggggtggggtcacttaaatccagcaggaggtggaagtcagaagaggaggcaacacttgagctgagttgtgagggatgagtaggaataagatgaataattggagatggagggggcatgccagatattcatttctattcagcaggtcttttgtttttgagctggaatttaatgtgggtctctgtgttaggtacaggggatttggtggtgacaaacctgatgattacccactttcatggagttttcagctagaggtgaggtaggcattacacaaaaaatggctcagtcacactgaagagtcacaaattatgatgtctatgaagaaaaaggtgaggatgtgaagatgtgaaatggtgttgctgggggaccccattcagatgcaaggtataggaaggcccctgaggaagcactactcaaacttggggcaaaaggtgagaatgtgggaaaagggcactggcatgggaggagcatcctggattctggaaagaaggaagtggaggtgccaaggaccagagggacgaagggatatgttggagtagagcagggtaaggctgcaggggaagtaagggtaggagcaggtaaggcaggtaaggctgtaggggaggtgaggctggggagaggtaaggctggcagggaaaggggtaattaggttggggggaaggtatagctagggggaaggtaaggctgggggcgtgattaggttagggggaaggtaaggcttggggagagataaggctggggggcaggtaaagctggggggtaattaggttggggggaagatatagctagggggaaggtaaggcttggaggaggtaaggctgggagggtgattaggttggctatgggaagaagtgagagtgggaggtgggaggtgagactgggggaggggaggtaaggcctcttgtgagggaggcatctcagccaaggtgaggaccagccggtcgatcctggcagtccaggctgttcaaggtggggaccgtgactcaatccagggtaggctttgaagatacccctgaggctactgggctgggtggctggcaagctggggcaactctgagccctgggcatggagaggctgccctggggtctgctaggtgcccgtggtgtccccttcagccttcagtctggtcctagatggggaggagctggttagggtggggcaggaaagtcctgactcatctgcagcttagactgggatcctcacttaggagtcagtgcctgaggctgggagctgtagtggttgtgatggagctgctgcttctgagagtgctgaatggggccatctgtggaatgaacagagcagaacagactctggttctttataacactccacttgggtttcataagagaaggaagctctatctgtgctgtcctttgcagtatcttcagtatctagaaccattctttggaactagagctctgcaaacacttggtgagtaaatgaatgttgcacctctcttagacataggagcagatgcaggctgagctgaccaggcagccagggcacattttggaagcctggcatctcagtctctttcctcacctctgtgggcctggcacagacttgctcttgcctgctcagaccactcccttctccaatgtggctggcgggagaggcaggttgcagttggggtctggcgatgatgcaggctccttcctgctgctgtatttacctgattgttacgtgatgctcttcccagctggcctcctatcaggcctgtctctgcaactaacacaattyccccggcagaatgcacagacaaatgtctcagacaacaaactggattattattattttcttcctcttggactgactgctccagtgcccatcaagggctctcccagggcatctcatttggaaacattctgggcttgctatttgcaggtagttgcctttaagacaaaagcggtctgagacaacttcattacctktcaggtttttcttggttaaatttgggctgcttcaaatatgggagactgacttaccgtggaattcttagcgtacatttatgcatccacccaatccatccgtaagttacgaacacctgggaggcatgcagaacttccctcctcgttgtgcttagtgctacagaattttattaaacaggatttattgagcaccttgaatgcagtagacattgtgccaggcatttagcctccaacttcttgctttgtctccaccacatccctgtggggtgggtattaatatttttcttctttggaggagtgaattcatgttctgagagatgaaaccacatattccaaatttgtcaggatttgtaccaagagaccaggccttgcatctctaacttgactttggggaaacaacacagccaacagctgagttgttcttttgcctytccctgtgggccaggcagccagatccgggagatccaatggggccatggtctagacatgggacccccaccacccccaggtgttggttgaggtccagtagaaagatggcctgaccagaggggatctcagtggggacatacaggggagacagctgcccaaccaggaggtgactgtgagtgcaggtagcatttcagatgctccttaggcactgagmggccatcctgggaacccagatgtaggttcttgctgcatctggggttccaggatggctagtggctcctacaaggagagcctgccccatgagcttcatgtaccatgcggtaaaccctgcttctggcctctgaaggtgaccgtctagttagattcacaggggctgctcctaatttatcgatcaaattcaggtgtcacctgctagcttacagttgggggagaccgaggtgggcagccacttagtgttgatctttgcatcaggaaatagagttttatggcagaaaatgccctggactttcaatcagagtggcctgggctcaaacatgaatatggctacttgcttagtgacgttgggcaagtcaatgaaccctctccgagtctcagtttcctcacttggcaacttgagatagaaacatctattactattgtgaagattaaatggtgtatgccagtggttctaatttgggtgcaattttgttccccagacaacatttggcaatgtctggagacatttttggttgttacagctggggggttgggatgctactggcatctagtgggtagagcccagagatgctgctaaaaatcctacaatgcagaggtcaaccctccacaacaaggtattattcagcccaaaatgtagtgctaggttgagaaaccctggtgtaaatgagtaagcatcacctagcgcttggcacccaagagagtgttaatcagggctaattgaattaagagtcagagtgttaagagccagaggactctcaacactggggctcctaccaggtgctccagtgccccatggtttgctcctgggactcaaggtgggggctgtgaatgtacctatgtgcttttgtcaggggactaggagtcttgatcagttgcttgtgaaggacactcccttccccttcctgagcctctctgcctgcatccttctggtgtctgaaagagcttctgagggccgttttgctctgatrtttctttccaggtgctgggatatgctgggatttggccaggaccaaggctccttgcacttctattcactagcgtgagtttcctgcccacctctcccagctccaggtcctggacacaggcccattccacctgcctgcaggtgctggggagcagcacagccgtgggagaaggctctcccgcccagacctctcagcacccagggtgctttcttgacataagcagctcatgccttggccccaggtggccaggtggtagatggagactagaatctcccaccctgcctgctggcttggccttgaaggagacccttgggcttaatctggagagagtctagaggaaggagaactgttatgtctctttctcgttccatgttgagtggttccaggtctttactgaggcccccagattgggggctcaggggcacaggacacctattaggagccttgtgagaaagtaagggagatgagcaggcagggatgaarccagggagatgggttggagcctctstctgtggtgcagggagaggtgaggaggctgctgggaggtcatggaggagagatggagaggagggctggattcagattacattcctgaagtccagtcgccagggtggggaggagacaggctgacactcacgtgtccagaggagatggaggagcagggaaggagcaggtatgaggaggacttcagctggccatgatgagggtgagcgtcctgtgggcatgggagagaatgatattgtgaggtgaagcctgaaaagaaagggccttttctttagcaacccccaagctcatgaccccatggtgagtcttggtcctccctcccttgaccagggcttggggagggagagcccctgagcaatggagtgcagccttgaggagcatctggggcctgccttggagactctatgggagctttcttggcctggccagttcctgctcaccatccacagggcctgaggctcattcagctctgataaccctggatgtgacaccctggcccaggagaggatgggcaactgggacttgtgggtggtctcagaaggaagtcccttctgttcaagtctccaggccacatcccctgcctgaacttcagttctctcatctttaagatgtgataatcatttccaccctgttcatcttaaagggaagttgcaaaaattaactaggctaatttccgggattgtgcagcactgtgaactggggagttaccacagggccgggtggagcctgctcaaggctggggtcccgtgcagtgggcagtggacacgtagcataatctcaccagataaatctgcacatgtgcctcactcctttcttcccctctgggccttctgtgagtggctcccccagcttttctggttggactacatcttataccaggtccagggccaaccagcacgtgtgacagagactccatttccttactcatgaactcaacagaggctgtccggtcatcctcacttcagacaaggtggtgggtgggctcaggagcaggctgcccacctgcttccccggcagagacctgtgtccaggccatggctggctctccactcaggcagctttccacactccagtttccagaaatttgtgtgtttctgggccccaaattggctaattggatcaacaatagagggtcttgagaggaaatgccatgtaggtttctaaagtgtttttagggagccataaaagtgccaggttgtcttttttatgcaggtttttacagtcttgatttaagaggttcttgagttttcctgtttttgcctgtgggttgcccttgctgagaaacttgggctgagggagttyctttttcagtgacaatagccacttagggaaaaagttcttcccaaaacatagagatgatagcggatggggaaagaaagtcacttttgctgaggtcctgatatgagtcaggtgctgtgcacagctttttgcatacattatctgttatgctcctactggatacccatgtgatactgggattgctctcactgtatagaggaagacactgaggctcagagatgtcccaacttatcccacatcacagagctgccacgggctgggctcaccatgggtcccctccccacctcctcccctgcaatactcccgcaatactccccattcacccttggttctcacctgatggacaatggccacaggcgtcctcgggatggttgcacttcacccttgaccccttgagtcaattttccatatagcacctggtctaatcctcttaagtataagtcagatcactgttgcttaaaatgcttccagtggcctttgtttcataaaataaaatccaaagtttttttttaatataaaagtatatatttaaggtgtacaacatgatgttttgctatacatacaaatagtgaaatggctactgtatagccaagtaaattaacacattcatcatctcacatagtttacccaattttttttttttttttgtggcaagagcccttttcatcactttcaaggccctcactaaatgrccatttttccatctgtcctggtctccaacttcattccccagactcacctggagccttatttttggttatcaaacatgccaaacaagcgctcacctcagggcctttgcactggctgttccctgtcattggatcactctcactctttgcccagattcccacatggctggtttccttgccttcttggtgctgctgcacaatgctgcctcatcacagaggcctttcctgaccaccctgcctgaagtagcacactcctccttctccctggtccctctcccgcctgacttcatcgtatttgtcatgacttgacattgtttcatatgttaagtgggtggttggcatttgtaacaaaagaggctatgtgtgttttgctgcagctctattctccatgcctgcaacagcatcygacacatagtaggtgcctggagcatctagtgaatgaacgacccactgaactaacacaggaatcaaaggggcagtgggagtggggaaagacggagagcartggtgaaggaaagggaagctttagacaaagttttcagatgtgtgcatctgagggtaaggacatcagcctgccagagagccyggggcaagaaggcagagcttggatgaacattgatgtacatttgaaggaggccgacattaagtcctttgccaaggttcctagtggctgctgggctcccatcaaaagccaagtaggcattgtagcccttgtgaagttagcatccctggcagccagctgcttccagattcccttctacaaaggctgatgatctgcgaaggcttttccctggagtgactgcagttcgtgtcctttgcctgcatatttcaaggcataaaatagagcaaaaccaaacaggtcttgtcctggcagcttgtgtgtcagactgaaagcttgtgcctgaagaggtgtgggttagacctgctatggcaggaggggcatattcattgctgttggctgctggtggtgcatttcttccagggcctgggtcagagcctggagcctgttggtcagttcccaactctctgtgctcatgggcctctgtcgggctgtgagctaccaaggtgaatccccacatgcaaccttgtcctatggcttcattgggagctagtggcccctccacgctgaggctgtccaagctacggctcacctggraggaaggcaagagatagctgtcacttcctgggtgcccacagtgaccagcatcaatctagacatttatgtattcataatttcccaaatcctcactgtgaaatgggcttcattgttctcatgtattacagaggaggaaagcagggcacagagaagccatgtgactctcataagttcctgtttctattaagaagcagatgcagggtctgaggagttatcttgaggctccaagtttgggcctcaattcattacaatgcatgtaggagacacatccctgtttctgaccccacttggggacagccagcactctttgctgttttctttattactctcttaccaacccttcaccccagggcctcatatgggaacacgagtgtgttttccatagggaagaaggagcagggaggtttgtctgctggccaggaaacatccggagatgctgcagaaggaggacttggatctgtcccagccccagcttggggaaccagaaatttgcggttgagagctcagcatcaggaatcaaatggcattagctgtgcaaccttggacaagtcatttctgtagacagacagtttctcatctattatatggaaacataagtttccttgtatctaaaactcctactgcaggataaggcatcacagtcccactgtttcttcacttaacaaacactgagcactggccgtatgccaggcactgtcctaggagtaggggcccagaggtgagcaaaacagccctgacactatccaacaggggctgtgggtggcacaggagatgggcatgggggaatcccaccctggggagaagcccatccagctggggtctgacgggtaagagaaattcattgttatcaggtctaggtaagtcccaggtggggaaggaggaaggggagagcgttccaggaaccaatccaatatttggaaggtaatgaggatggaatggctttgctctctcccctgagactaatgaaccgtcattgaaggcttctaagcagtgactgcttttatcaaatttgtgttttggttgaaaagttcattctggctgctgtgtggagcctggatagaaggtaaccattgtgcatgagtgaagatcagctaggaggctactgaaattgttttggcaacagatgaaggtaacttggagtaggccactggatagacccattctttgcctgtcctcctggcctcttcctgagccctgtggaccagtgtctgcctccaccaaggacagcagtgctgcagccttctgttatggactgagttatgtcccatcccaaaaagataagctggaatcctaaccccagtaccacagcatgtgatcttatttggagacagggtctttgcagatgatcaaattaaaatgatgttataagggtggaccctaatccaatatgactatttccttatgaaaaggagacrtttgtattcaggacatacacagagggaagatgatgtgaagatacagagagaaatggctatctacaagccaggaaggggggcttggaagcgatccctccttcctggtcctcaggggaaccagccctgctgacaycttaatctcagatttccatcctccagaactgggagataatacatttgtgttgtttgatctagctacctggtctgtgatattttattatggcagccctagcaaatgaacacaccctcatctctttatatagaaaacttggggacctccaagacctcaccactcttgggtcccactggtggagatgcacagatacagggtaggtggtggtcagacctctccagatgatgctgatgggcactggaggccatgggaggggggctggaggacacaggtttcacgcagggctttcctctgtgcactcacaaccttggtcctcagctgtgtgcagccagacctccagaaagctatgtccttggcctttattatgctcacaggccccttttagagccccccaccccaccacatacacacaaagttcagctcttgtcaagggtcctacaagaagaaacaagtcatgcagagtcagagaatggggctgtcacttactggttttgtgaactgggcaagacacttatgctttctgagccccaatttctctgtatataaaatggaaccattgtctctggagggttactgtaagcgttccaggaggatgtgagtaaacagggttgccacatgcagctgagcaggttgcatcctgcacctggatggctgggaggtgagtctggacttcatcagcacactgcttgctgctcagcaggccttccycactggggcattttcttctaatttgaataagagctcatgcaggcagggaggaccctgtatggcaaatgtctcacagtgtttctagcatgtagtagacattcaagaagtgttagctttttttttttctgttaaagtaattgtccattacacaatttggaggaatctctttcagaatttagggaatgtctgcttcctccttcctggtaatgtgatcagtgtaacaatgtgtttccctttttgctcttactgctgggaaggtcaagtccattaatgcttaggtttgtacaaatgtattcacttttccctggctctaatttattatgccttatttatgttgtaccagttgattaaatatgttctttgtggtaagctacccagtccctttggagaaaatgcttctaagtaaatgcaatatgtttttcggcttgggcaacatatcatctggctgctttaggtcctttggcctggtagatagtcagaggtgaatggaatagccttggcatctgcatggtgttgaccctgaaccccaaggatgtggctttgggggatttaaaaaaatcacaggttaggtagggaagacgctgcatggactggaaaaatgtccactgcgggaccacttgttgatggctttgcatgaacttaagcaagaactataaggataacccaggtatgtgaggatccctggaaagttagtagtatgttttcagagagctggatacattctcaggctcttttggccctctggcccaattgacctcggcactctcatgtgggccctggagtggcgtctgtgatcacagctgccatcatgtccatcattcagggcactagatagaccagacctctgccaggctcctaagcatgttccatcagggcatgattagtgttgggcttggcattgtgcttaaacagcagcttaggatttcattttcactgggtcggsggggaggtcttcaactggctagtgactgccacgtaaggactggctgggtatttctggatgtgaaatagggacttgtgatctaatccasggcagtaaggaagaccagcccactgcgttgtgtctggagagggacagccttgagtgtgagtgcaagggagcactcccaggctctgcaggtgtgcatggagccttgctctaatctaagcctagggggttgattgctcactttatgttgctagaaatgtttcatagctatgaatatgcccttgtttttcatatttttttcttctccagagttcaagctcactgcccatgggctgaattcagatcagaggtgtatttgtgtggctggcatggtrttttctacaacatcagagtccctttaggtggggtctgcacccttgagtcaggcaagtctcatctctcctcatgggctcattcctacctgttcccctcacttctcaccactgtattacctgcctgggacagattctgtgctacctccagcatttacactttggccacaataggctttaggatggaaggaaagctttattgagcatctactacatgccagccacttttctaagcgtttttggaactctagtcttcttcagactttgcatcaaccctataaggtagacactaatcacatttatagcagagggggctgaactccaaatcaaatgcatcaggagagtatgtcccaggatttaagcagccctggctcctacacaggtttcatgggcttcacctctcccgtgaagctgggccttgtcagaggtagaagactgtgctggaacccacaggccagtgcttagtccttcctaactgccttccatttggagcaggagaagaaaaaccatctctggtagttgcagacaagttcccattatggttggagtaaacctgcacccatgtgatatattttcctgaggccttagaaacacagcactcctgtcttagcctgtcctgtggggcctttgaagactgtcagtcctgaaggcagaattttgcaaagagcatacacagagggaaacaggtaagcctgttcaggtctgcagccaagagcagcagctgcttctcctcaggttgctgcagggacactggggaactggacgagggctacgtctcctgcatatcatcctggaatgtgagggaccctcctggaggtgcacgcacaggtggatgccacgggggcaaggggccggggagctagatgggtaggtcaggttttctaagacaaggaagcagtggcttgccccataggtgagttcttgcagaagctagaatctgtagccttccttctactcacctgaaggaggtgccatcctctggagagagccagacatgggtctggtgagcaggagctcagcctgccttcactcagtctggaggcatccccactccctgggggcagtgccttaaaatcacttgacttgaggtcatgctagtaattgggatgtattgatggagcaccatccagagttgtgattaactcggatcaaagtgctcagcagaacacagccttgcagatagattaattgctacaggaaatgatcacagtttgatctctggtcattttgttgttatttgaaaacagaacaaaaaaaacaataatcaaattagagaaaataaatgcttcttattaattaaggggaaaaaagagaagagaatagtacaaagatgttcagatcgtaagaaagacaaggcacacatcacggaagtgttggcatctattagacaacacttgcccaccccgtgatgagctggtaaggtgaacagaggcagagggtgcctgagccataggtgagctctcctggggcttcctggtgttctcacagatggcacgctagttctaaatgacagattttggaagaataataaggaaaaaccacataaatatgttaatatttttcatgtagatgaaatatattttataggaaagaaaccactattgtcctttttgggtgcatgaattaagtttttgggaaaggtggcctctgagagagagagcttgaccttgagggtcgattttcttgatcatctgctgggcagtccttgcctcctggagctgagttgaaagagggcaacttggagaccccttgaccataggcctggaccaaaaagagtcagtctccaaaagtttgggttctggggtagcttactatagactggacactgctcattttccgcagggaggccattcagcttttcttgtttgcaaactccagttgatcccaaccacagatgagccatccactagatctcatcaagcatcttatagcttttttattttattttgtttcccgtatggtagaggatccaattaggacaatcgccctcttggccctaaatgtggatggcctggaggagccacttggtgaagtggaagtaagagtagcctcgtgacaggctggcccgactgatggcccttcagttccccacagtcagccaggaaaggctgcgcaagccctgtccaccctgcacctcagcaaggaggatttcaaaaagtcccgagaaatctcagtgtttttgtcaaaataagggaagatggcttttcgggttgtgcagattagaaactgaatgtggggaagtaattatgaatgtccctaatggagacagagaacgtttggatagactaacagagccacatgtagagattttggacaaattcatttgggcaaatgatgagaatgggaatgtctaaggtggcatatttagatttgtatgaggctctggatgaaacccttgtagagaacatggagaaacacagaattttaagcagggcaattaggttgatgtgtaactttaaacacatgtacctagaagttattgattcactgatcaaagtcaatcaaaggaaggctttaggccatgctcatggcccacacctataatcccaacactttgggagtccaaggtgggaggatggcttggggccaggagtttgagaacagcctgggcaacatagtgagaccctgtcactgcaaaaataaaaaattagccaggcatagtggtgcrtgcctgtggtcccagctacttgggaarcattaggtagmrttcaacatgtccatcatccatgaaaagtggtggagcactgactggttgcagaaagtcaagagggtcactatttcattagtgctgcacaacctgccaggtaatataggggagcatatttagcatagtgctctcatatttatttgcttgacagatgaggatcccaaatatctccaatgactggtgcagtgtgtcagagataacaagataaaatctgatgtggaaaaattgaaagtcttccacttagattcaaaaggtcaatggcagcatttggtctataattaaaaacaataatagtacctgacatttcttgtgttcttgctacttatcaggcataatgccaagtggttttcagacattatcccatttagtcctcacacagccccctgagagaggcaggtgataatctctgttttacaaaaaacaaaacaaaacaaaacaaaacaaaacaaacaaaaaacttgaggcttgggctttgtgtgactttccctcggtatttctttcctaaatattgactgatgaatttatttatgtgcacaattgatactggatctggtcatgagcttgctttggccaatggcatgctggcaaaagtgagcatgcaagttctgagcatagactttccgtagaaagcaggcgtccacctacccatctactctgataaagagaatatgccccaggtatacactgccctcacactgagcccaagaatgggacgtgtggagctgggccatccaggtgactccccagtctgcgaatatgagacatacactcttatattgggtgataatgagattttgtggttgtttgccacttagcagcatgactaatatatgttgccagtttgtagctgggctgggattcaaatccacataatctgacttcagaacccatgctctttggctctttaccatatttcattgaaagaaataagagatgaataatcaaggagacttaatatattccctgctgtagtcttttggttaaatacttaaaaagtctattctcaatttataattgtagcctaatcctcatcaaaatttccattcagtgtcttattagatttttacaaaatgattagaaaataaaactggaaaggaaaagctactttatatagaaatagttagaaaatagcaaataatgaagggggccagtattaacagattttagaacatagaagcccatgktaattaaatctgagaaacactggtacaaacagagacttccagcaaygaaagacaaatctgaaagagttccttatacataaaataagagaagataaaggaggaatcaaataccatggagaaaagaaggatttgtaatgaaggatgttggaagaatgtattagttatttggaaaaaaataactacaaatagcaaaaagtaggctacatgatttttcaggtaacactctaaattttaaagtggtaaaaatatttaaaaagtaaatagatccaatgtacaaaaagtaaaaacttctttataaagacaaaaaataaagaaaaaaaagtgaagggaaaattatttgttacaaatatacaaaatgggaatatttaccttgcctcattcaaattaataggcaaattcaaacctggttaacactggacaaaaggtatgaatgaacaagtgacatcggaatgaataaggttcagttcacctgaaaagtcacgtggtgccaccttgctctgtgcctggccctatgttaaataccaagacttcaaaacaaacatagcaaaatgaacatcttcaggaataaccagtgaatttcaaaataaaatgaaatccatgcaatcatcttatatctattatatctattatagatgattaaaagtagtaatgctatcaaggttgtgataaaactggtgactttatacattgctggttgctgtgtcaatgggaaaaaccatttgtaaaacatacctagaatcatcaatgtgttcatttgtttgacccaataatctcacttgttaaaatttatcctaaccttgtaatttaagtgagaaatacataaatatataaggattgtattgtagtgctatcttccatactgaacaattggaaacaacctaaatgttcagtgtagggaatagctaagtacattatggaatagccacgcaatagactattgtgtagccaataaacatgatgattgcaaaggcactgagaaagtatttctgatatgatcatgagtattgaaatagcagaattatacctatgtagtgattaaaagtacataaaaattaaatatataaatatatttaatatatttatataaatatatacatatatttaatatagttatataaatatatacatgactaaggccctggaatctgacgattcatgggatggctggcctgtgggaaattacgctcttcccaattgcctttgatttccattagggttgtttcatttttcagtaaacaagtaaaaataacattagattaaaaaatgtgccaaaggatggaatgagaacaatgagtcctagctgtaccgggggaaaaagagacttaggaatgtgagttgtattcaagctcactatgagccatcaaaattatgggtcagttaaaaaaaaaaaagaaaaatggtcaggaaaaccttgaacgctttttctgagacacaacatgagatccacaggagatgtctggcttctgtcatgcaacataatgtctttgacattttcccatgttgttgtgtctgttaggggttgattstcatttgttaccacgtagacatgtagaattcctttgtaagaatatacggtcatttatttattcttttgttaatggaaatttgggttatttctaatttttggctatgatgaataaagctcttattgttttattcttgttcttgtcttttggtgggcatatgcacccacttatctagggtatatacctagaaatgggattgcaggattataaagtagatgtatgtttagtcttagaagatgctggcaaacattatcccaaaatgattgcaggaattttttcccacctgaactgtatgaaagtttcagatactctacattctcaacaacacttagtgttggtagtctttttaatttcagctattccaaaggcaggagtgagtctcactgtggttttaatttccatttccctgatgactgaagatgttgagcatttttcacattcttaccagccatttggatatcctgttttgtaaaaggcttgttcagaactttctcccactttactttttcaattgggttgttggactttttctttttgatttacaggataatttttaaaactaaaaatgctgaatatgggtctttttgggacatatgtattatgaataccttgtcatttgtatcatctttttcactatctaaatttggtgtcttttggtgagcaacagttattactttttaataaagtatgattgattatttttaaatggttactgccttttgtcttattttaaaaatctatgcctacattaaggcaaggaagctatcttcctatattttgttttagaagcttatttatttttattttaccttttacatttagatctgaagctgaatgactcctggggaaaggttgtcactggggaaccatctaagtgcatctgttttcacttagatttgttatttttattcctaaatttgatttccttttcatactaytgtaaatggaattgtttcattaattttatttttattttcatgatagtatatagaaatagagttgatttttacatattgatcttgtatcctgcaaccttgcagaatttatttattagccttgatagttttttgtgtgaatatcttaggactttaaaaaaaataaatgagctgtgtcatctgcaaatatagatagttttacttcttcctccctatttccttctagatgttttaaaatttccttttcttgmctgatttgcatgactagaatctccagtacaatattgagtagaagttgcaaaagtggatatccttgtcttgttccttgtcttaggggaaaaacattgagtctttcatcattcagtatgatgttagctgcagatgtttcatagatgtcctttatcaggttgaaggagttttcttctattcctaattcgttgagtgttgttgttgtttttaatcatgaaaagctttgaattttgtcaaatgctttttctgcatctgtaaagataatcatatgttttttgtcctttattctgttaactatggcatattacattgattggttttcagatgttaaacaaatcctgcattcctaggataaatctcacttgacggtcatgtataattcttgttatatgctgctggatttattttgctagcattttgttgaaattttttgtgccgatattcataaaggttactggtctgtagtcctcttttcttgtggtgtctttgtctgattttagtatcagggtaacagtagcctcttagaatgagtttggaagtgttccctcctattctattttttggaagagtttgtgaaggcatggcattaaatcttctttaaatatttgaaagaattcgccagtgaagacatctgggctttgactttactttgtgggaagttttaaaattaccaattcaatttcttaacttgttataggtatattcaggaattctgtttctttttgagagagtttcagcagtttgtgtctttctagaaatatatctagttcgcttatttagtttgttgtcacacagctatttatttttatttttttaaggtcagtagtgaaatcccctcttttatttctgattctagtaatttgaatcttctataatttttaattgataaatctagttaaattttatcaattttgtcagtcttgaaaaaaatcaactctttgcttattgattttctctattatttttctatgctctatttcatttatttccattccaatctttattatttccttaattttccttattttggtgttagtttgctctttatctttttagtttcttaagggagaaggttaagttactgatttgaggccttctttctctttcaacgtaggtgtttacacccacaaattttcctctaggcactgcttttgtcacatcctataaattttgatattctgtatgtttttctcattaatctcaaagttttaaaaaattttctttgtaatttcttctttgactcattgattattgaggggtttgtggtctaatttccacatattcatgaattttcgaaatttccttctagtatagattttctactttaattctatttaggtcaaataacatactttgtgtgattttaatccttttacttttatcgaggcatgttttagggcatarcacatagtctgtcctatcctggggaaatgttccatgtgtgcatgagaagaattctcctcttgttgaatggagtgttccatagatatctgttaaatctagttggtttatagcatttttcaagctgtttcctgattgaacttctgtctagttgttctaccaattatggaaagtgagatattgtagtctccaactataatattatcattgaattatttatgtccaccttcaatactgtcaatttttgcctcctgtgtttttggggtgctattgttagatgaacataggtttataaaacataccttcctaatagatggacactttatcattataaaatgttccttttgtgttcaatagcacttttgtcttaaagtctattttgtctgctattagtacarccacttcagctgtcttgtggttactgtttgtatggtacatattttcccattgttttactttcaacctattatatctttgaaactaaagtgtgttttttgtagattacatctggttgcatcttttaaaaaattcactctgtcgttctgccttctgattggagtatttaattcatttacatttaatgtaattactgataaagtagattagcaccttccattttgttgtttgttttctacatgtcttatgtgtttgttcctttttccattactgctttattttgcattcaatatatattttctaatgtaacattttaattcccttgtttctttttctgtatatattttttagttatttttgtggtggttgccctgggaattacaattaacatgttaccttaaaacaaacyggaacagattaatggtagataattttaaatgttatgcaaaaactttgctttagtgtagctgtttcctcccccttctttatattattgttgctgtcgaaattgcatatttatacatttgaagcctgtcaatacagatttaaaagtgttattacaggcagttgtcttttttttttttttttttttgagacagagtcttgctgtgtcgtccaggctagagtgcagtggcgcgatcccggctcacagccagctccgcctcccgggttcatgccattctcctgcctcagcctcccgagtagctgggactacaggtgcccgccaccaggcccagcaaattttttgtatttttagtagagacggggtttcaccatgttagccaggatggtctcgatctcttgaccttgtgatccacccgcctcggcctcccaaagtgctgggattacaggagtgagccactgcacctggcaggcagttgtcttttgatcaaataggaggacagagttacaaaaatacatttataccttcatttttacttatattgttacctttatcagtgctctttattttgtatgttaattcagattattatctattgtcttttcatttgagactaaaggacttctagtatctcttgtaaagccaatataataacaaattttatccattctcatttatctgtgaatgtcttaatttctccttcatttttgctggctagtttttgccagatataaaattcttgactgacggtcttttacttgcagtactttgaacatgtcatcttactacctctggccaccatggtctctgctgagaagtcagatgacaatcttattcctcatcagtgatgagtcatttctttcttgctactttcaagaatctctggctttggttttatgatgtatttaggcatgagtctccctgagttctccttcttagcattgattgagcttcattcaagaatttcatttagttctttaaaaatataatttctgtctctttattgacattctccatttggtgagatactattgttatactttaatttttttagacacgattttctctagttccttgaaaatatttttaatagctgacttaaagtctttgggtactaatttcaacaactgtcccccatgggacaatttatattgaatgcaytttttcctatttttctgaatgtctcatatattttgttgaaaactgaacactttagataatatgatgtggcaactctggaaataagtcccctttatcctgggtttgttgcttttctctctttctttctttctttctttctcttttggtggtgttgctgttgctatatacttgtttagtaactttgatggactagttttgtgatgtctttattacctgtagtgtgtatctgtattagtttgttctcatgctgcaataaagacatacctggaactgagtaatttataaagaaaaaggtttaattgactcacagttccacatggctggggaggcctcacaatcatggcagaaagcaaaggggaagcaagatatatcttacgtggcagcaggtgagagagcttgtgcaggggaactgccatttataaaaccatcagatcttgtgagacttattcactaccatgagaacagtatggggaaaactgctcccagtastcaattatctccacctgtccctgcccttaaggcatggggattattacaattcaaggtgagatttgggtggggacacagccaaaccatgtcagtatccatttaagtctctgctcagttttcttagtagtcagctaatacttggtggtcatatatttctttctgcttttttttttttgaggtggagtctcactctgtcacccaggctggagtgcagtggcatgatcttggctcactgaaacctctgcctctcgggttcaagtgattctcctgcctcagcctcctgagtagctgggattacaggtacacaccaccatgtccagctaatttttatatttttagtagagctagggttttgccttgttggtcaggctggtctcaaactcctgacctcaggtgatccacccacctcagcctcccaaagtccttggattacaggtgtgagccaccgtatctggccagatatctctttagatgcctttaatcaatataatttttaccctttcctgggggttctgtatgtatgatggggcatgctttagatgctcatgtaggtacttacaactctctgtattctttactttctacttatatatggtctcaaggccagccagaggtaagatattggagctttctgagatctttccaggtgtgtcctaaatatccaggaatagatcagagatttcccaatgtccctatgggcatctttctctctattttccttttaaggttttggccaggctgttgtttttcctaactgttattacagactcaggtatttgtgatgctaaacaattgcttctaattgtttttaacaagtgctctaaggacagggcttttcctacctagtgagctttaagccaggtcaaataatgacaacaccgtgtgcataaggatcttccaggaaacacgtcaaattgtgacaatgccctggagaatggaactttttaagacgctccaaactcagttcccaccccatcttgtagctgcaaggaagatggtcttcttaaccacctgggttgagtgattgctggtttttaaggctactctggagctggggaggaggtggtgggagtagatctagttaaagtaccataaatcctgatgttcttaccaaggattagctgggattttttgaataaacactccttaggttgttatatggctttggttaatttctagggttgtgagaaagtttttttttttattatattttaagttctggggtacatgtgcagaacacgcaggtttgttacataggtatacatgtaccattgtggtttgctgcacccatcaacccatcatctacattaggtatttctcataatgctatccctcccctagcctcccaccccctgacaggccctggtgtgtgatgttcctctccctatgtccatgtgttctcagtgtttaactcccacttatgagtgagaacatgtggtgtttggttttctgttcttgtgttagattgctgagaatgatggtttccagtgtcatccatgtccctgcaaaggacatgaactcatctttttttctggctgcatagtattccacggtgtatatgtgccacattttccttatccaggctatcattgatgggcatttggattggttccaaatctttgctattgtgaacagtgccacaataaacatatgtgtgcatgtgtcttcatagtagaatgatttataattatttgggtatatacccagtaatgggattgctggatcaaatggtatttctagttctagatccttgaggaattgccacactgtcttccacaatggttgaactaatttacactcccaccaacagtgtaaaagcattcattttctccacatcctctccagcacctgttgtttcctgacttttcaatgattgccattctaactggcatgagatggtgtctctttgtgcttttgatttgcatttctctaatgatcagtgatgatgagctttttttcatatgtttgttggctgcataaatgtcttcttttgagaagtgtctattcatatcctttgcccactttttgatggggttgtttttttcttgtaaatttgtttcagctccttgtagattctggatattagccctttgcagatggatagattgcaaaatttttctcccattctgtaggttacatgttcactctgatgatagtttcttttgctgtgcagaagctctttagtttaatgagatcccatttgtcaattttggctttcattgccattgcttttggtattttagacatgaagtctttgcccatgcctatgtcctgaatggtactgcctaggtattcttctagggtttttatggttttaggtctaatatttaagtctttaatccatctggagttaatttttgtaaaaggtgtaaggaagggatccagtttcagcttttggcatatggctagcccgttttctcaacaccatttattaaatagtgaatcctttccccattgcttgtttttgtcaggtttgtcaaagattagrtggttgtagatgtgtaacattatttctgaggcctctattctgttccattggtccatatatctgttttggtaccagtaccatgctgttttggttactgtagctttgtggtatagtttgaagtcaggtagcatgatgcctctagctttgttctttttgcttaggattgtcttggctctgtggtctcttttttggttccatatgaaatttattttttcatgttttttcccaattctttgaagaaagtcaatggtagcttgagggggatagcattgagtccataaattactttgggcagtatggccattttcatgatattgattsttcttatccatgagcatggaatgtttttccatttgtttgtgtcctctcttatttccttgagcagtggtctatagtcctccttgaagagatccttcatatcccttttaagttgtattcctaggtattttattgtcttagtagcaattgtgaatgggagttcgctcatgatttggctctctgtttgtctgttattgctgtagggatgcttgtgattttttaattcttttatggaagggcttatttatggaagtccttactctgycatgtataaatcctctttcagttagatatgaggaccttttaagtaatttctgcatgtgctgtgtcaggtgctgctgctagaatgagaaataagatatagggcttgttttcatctcataatgtgaaaaggagagggacaagttgcatacaaaagcaacaaaatgttacacacatagaaggatgaccagggtgaagtaatggctcaaggaatgtagtggctatatctacctttgaggcaaggtgtgaccaggagaatcatggtgaaggagtagtcttatacatatggacatgaaataaccccacggatttgggaagctgctttggaatcaggttgggcgtggtaagagtggaggatggggagatcatcaggggcctggtgtcaggaggttagagtttttttgaaaagctatgagagccttagcagaggtttgagcacaagtctgacttgttcagatggaagtgagcaaaagtcaccctgtccactgtgtggcgagtgcattggagggtaagtgagaaatgggatgggagtcttaggaaagaggactggtttcttaacttggcagagaggtgatggtcaatacctgggagtaaggtagtggcagtggagaaaggaaggaagggttggagtgaagagataattcagtagtagaatccatgggacccgaaacccaatttcatatgaaagaaaggtcagaagaatctttttttttttggctgaaagatgtagcttgttcccatgaagaaagccatgagccttctaagtttcaactgcctccaggaacatgttctggaatccatgatatagttacagcaagggaagtaaataaagaaataacctccagttcaggcatcagcaacacatgtcattcttccagacttccctggctgggttgggcagctcctcttaggctcacacagaacctgcttcttatgcctagcagagcacttagcatattactttaaaattatccatttatgtgcctgtctttccctgtaaaccatgagtggtttaagcataggaaccaagtctcactcagcattgcttccctagcttgtcccagagtcgggattaacaattgtgtattgaattaaggatgggtgtagagggttaggaagaaaggatatctggaagggtagtactgagtggtttcataaatttttaaatttctccccaaacccagtacctcccaaacctgagcagagtgttcagttgtcatagccctgctcagtgctttagacwctcagtctccctggggcaagggtggcaccttgatcaagatggtttctcttgagccaccatcttgcattctaggatccccactgggagctgttagtgtgccttgaggccaggttgtgctggacacatctgtgatgatgttttcttccctccctctccatttaggaagctgacatggctccaggcaatgtaacttctctgggcatcattttcaagtggagcttttggacagttctawcgtttgtcaggtgcttgggaggtctatgcagctgagctggggcttttttctgatttttagggactggcagcttcaggttgtctccttaagtagagaagcaaggtggaaattgggaaagaaggctgtaggggaagatcacttccatccagtmaccagatgctaagcaactttgtaggggagagcaatgaacccggggatgctggaaaggaatgccgggaagggaaggagggaagggaagggtggcagacccctgtaggagcccaccagggacccttgcaccatgagcacagtgaaacccagaccagtgaggaggcctgaccaaaggagagcgagtggcccaagccatagacctcaggatccacagaccaccctctgtcctccctccctctgcctttcttccttcattcccttcctccttctttccttccttccttctgctctttttgcttccttattttcttcttttcttccttcctttctttattcttcccttccttccctcctttgttcttttctttcttcttttcttcctttgttctttctccttttccttccctccttccctctctctcttttcttccttccatcctttttgtccttaggaaggaaggcaggaaagagggagggagggaagcctgaaggaagggaaaaaggagaaggaaagaaggaagaagggaagagagggaggaaggaaagatagaaggaggatgggaaggaaggaagaaaggaagaagggagggaaagaagcagggaaggaaaaaaggaaggagagaaggaagctgagaaggaaggagggaaagagagaaaaacagatgaaaggcagaaaaggaaggaatgaaagaaggagggagagaaggtaaaaaggaaggaaggaaagaaggaaggaggaaagggmagaaggaagggaggaaggaagaaaggcagaagggagggaggacagacggtggttggtgggtcctgaggtctttggacacaagccasttgatttcgtttgcctcaggacccaagtggcgggaggcctcctcactggtctgggcttcactgtgcttatgataccagggtccctggtgggctctacaggggatctgctcatagctcccgggctgacagatgcgggagacttgttgggcatagctaatgtgcctggtggtgccagctgtgaagggaggcaggggcaggctcagaggagaacccagtgccgcatgataattgaggcttgtgtttggggagcaatttagtgttttcaaagcactttcatgtacattatytcattctatcctcagagcgatactgtgaatgtgttattatcactctgttctgttcagagtagaaatctgggcttaggatgtactgccattcaacaaggcagggcccacttctgagactcctgagactggccctggagcccttcactccaggcctagacaccacagagagctccttgccagcctccgtgcgactctaccaccgagcctctctctgtgagtcctcagggtgaaggccagggttaatagcagggtctgcagaagcccctcctccctcctgaagccaccagcaacaagcaggaaagttctcaagagatcaaaakaaatgttttccctgagtgaggtcagtgctcacaatggtgcatccatgggtggaatgcagtgctccaattccagcaaggctggtgtggccgtgatagaagtgattaaaccaggctcaatccattgattcattcatttggttgttcgccaacatgtagcggcaattgttaatgcaaggcaggtgagagattcttgcaggtggggtcaaggggagagacatacaggtcagtagggcgaggtccggcccttgagccttggctggtggaaatgtatagtgctctctctaccttagcatggctgtgctgtgtggatatatgctctcatgcccacagcaaatgcagaggggagctcagtgttgaaggctagagaaagcttataaagctttagcaaagagagggctctagacctggccagggaaggcctgctgtactatgatatgatcacaaccttttcctgactctgcatcctgcaggcagcacctgaacacttcgccacctgtctgtgtgggcagagtgatgttaaaactttgycagctttgctagtgaaaatggaagattgtgcaactatttcagaggacagtttgtctgtttcttagaaagctaagcataaaattaccttaggactttgctattctgctcctaaatattgacccagaagaggctgagcgtggtggctcacacctgtaatyccagcacttctggaggttgaggcaggcggatcacttgaggtcaggagtttgagaccagcctggccaaccctgtctctaccaaaaaatggtgaaaccctgtctctaccaaaaaatgcaaaaattagccaggagtggtggcacatgcctgtagtctcagctacttaggaggctgaggcacaagaatcacttgaacccagaaggcggaggttacaatgagccgagattgtgccactgcactccagcctgggtgacagagtgagatcctgtcttaaaaaaaaaaattacccaaaagaaatgaaaaaaatatatccacacaatgacttggacatgaatgtttagcgcagctttaatcgaaaaagcaaaaaactgaaaatgatgcaaatgttcattgacaggtgaatagataaacaaatagtgatgttctcagtaatagaaattagacagtaattaaagaaaacaatctggtgatacacacagtgacaaagatgaatctcaaaaacattatgctgagcaaaagaagccagaccggaaaaagagtaccttatgtatcattttatgtctatgaaaccctggaaaaagtgaatctgatcttgagctacagaaagcagaccagtggttgcctcgggtgggggcgggtgggagactggctggcagtgcacagggaactctcctggatgatggaaatgtgctccatcaggatcagcaggtgggtgcacaggtggatgtccttgccaactcattgccctgaacatctcaaggcagatgctgccaaggcactggtgcaacactctggagaccctgctgcacctcgtcttgttccctttatttgccaggtcacagagagggccaaagtttcccagaggagggttcagtttggccaggacagggcaggagtgtcattgagaagtgttgcatcagtcagggtcctccagagaagcagaatcagtacacatacacatagaagaagagattcattataaggaattggctcaggcacttttggaggctgacaaatcccaagatgtgcagtcaggaaacaggagacccaggagagccagcggtgtcagttccagtctgaaagaggattcagttcaagtttgaaggttggaaaataccaatgccccagctcaacacagtcaggcagacaaagttcccgcttcctcagcttctttttctttttctttctttctttctttctttttttttttttttgagacggagtttcactctcatagctcaggctggagtgcaatgatgtgatcttggctcaccacaacctctggctcctgggttcaagtgattctcctgcctcagcctcctgagtagctgggattacaggcatgtgccatcatgcctggctaactttgtatttttagtagagatggggtttctccatgttggtcaggctgctcttgaacttccgacctcaggtgatctgcctgcctcagcctcccgaagtgctgggattacaggtgtgagccaccacgcctggaccctcagcttctttttgttttattcagatcttcaactgatgggatgaagcccacctacattagtgggggtgatctaccttacttagttactgattcaaatgctaatctcatccagaaacaccctcacagacacacccagattaatattcagccaaatgtctggacaccctgtggcccagtcaaatgctaatctcacccagaaacaccctcacagacacactcagattaatattcagccaaatgtctggacaccctgtggcccagtcaaatagacatataaaattaacaatcacaggtgtcaccaaggggccttgaggtgacagatgggtattgtattgtttagtgtgttcatatgggttcagtgtagcagggcacctgtgggtgaggggcaggtagtttgtgacttacccctggcattcctatctttgaggagattatggtgccatgagagagactgtcatcagtaaaaaagttactcatggaagtaaaattcaaactgcagtaatatttacaaaggagcatgtggggtccaggagaggcccaggttgacctgacccagcaggggtcagaggggtttctagaggttattggccctgggcctgtgaggtttgcctttgttgtccacttgctgggttttgccatcatggccctgagtagctggcacatctcccgactcccttagggggagtttcacgtgttccattcttgctttagttaaaagtagctcaatttggggaaggtccttacttgcagcttgtctcaccttgataggtgacagccaggtttgcagaggctgcctttccatgtcacgttcaccctgaggagccagaccaggcatatagacatccccagcctagctttccattaacctctcctctcccaagcttaggggaagagttacctgggaatgggtggctgctgaccttcagcatgggtgcagggagagcatggcctgcagagcaggcttggagtcttgccgtaccaatcctgtctgggattcagggtgttctagatgggctgcaaccctaccaggtgggctcagggtgtcaagactctcttttctgcattttcaccggggagaatattcatcctttcctccttcctactgctctctgatttcattttggggagttccatcttgcccttatgtgtagtctggggggattatcccatttacagaagccaaaggggccagatgtgccttcttaactgcctaatacaaccggggggaacaccaagacctaacctggccacttaaatgctttctcgtggggctctaaaaatttgaggaccaaagacctggctggaaatcattcatggggtgtgtgaggctggaggatactctggccacaccatttctactctaaagttatttttgtagtttgttctccaaacccctggagctgcctcacatcccagcttcatcctatagctttggcagtgtgatatggtctggctctgtgtccttacccaaatctcatcttgaattgtaatccgaattgtaatccccacgtgttgggggagggacctcgtgggaggtgattagatcatgggggcggttcctccatgctgttctcgtgatartgagtgagttctcaagagatctgttggttttataaggggcttttccctgcttcgctcagcacttctctctcctgccaccatgtgaagaaggatgtgtttgcttccccttccaccatgattgtttcctgaggccttcccagccatgtggaactgtgagtcaattaaacctctttcctttataaattaccctgtcttcatagcaacctgaaaacgaactgatacacagtgattctgtgagttgccagattccttccaacagttccccaactttaattagaatcaatttctgttgcttgcactaaagagcccagtggttcttgctggatccatttcaaattgacgcttcccatgcctactctgttctgcactcctaaatgggagaaagggcattttccattaatctcaatgaggcttttttgattagagtttgcaaagtgctgggatgtgaaggggctttccttgtgctaccactgaatgtttgggtagcttagagtaatcagaccacatgcatgagcccaaaccaggccaagatggtcccttgtggtcaaaaccgcacttaatccccacctgccccatttgaaaagagaaatcctgagcatctattttaaactttttaaagatatgacgtttatgtaactcacctctttgaagttggaaatatcctcataaactttgaaaggaatgagcattggcagcttataagtttccagaagagagtgctggggaggttgggctagcagaagcttgctggaataggaagggttgagaaagggagttggcacagccaattagagattcaagtggtcaaggtgcccaggtgtaaggaacttacacctggagtgcaggacttgcacagcaggtgcaaaccgtttgacaccatggcttacagtctgactcaggaaatgatttgggttaaaattaaaataagaataaatatttggaaaacaagatatgagtataatgagtgctgaaagaaagaggctgcccagtgaggctgcccaggggcttggacattgcatgccctgagtaaccacatcaggactatggccatccactttgagggcctcgaatcaattttgccagggagcctggaggtgactcgagtgggtcaagctcatgagaaattactgtgaatgtcacatcctaatttccttatcaaattgagaaagagaaagggctgaggggagcacaatggccagctcccctctggtggaggctgagctggagaagcctcaggggtcagaaggggaagagtcccactctaggactgtgggcataggtcagctgcactgtccactgtgactgtggcagacaggggcaaagcgtgggcttgtagggagctcaggaaaggtgctgactgactgtctgatgactaaatgaatcatggagaaaggacagcctggagtctccacttgctctgtcgaaagagacctttctgacccattgaaccctgtcagttgctagttgtttcttatcccaggcacagctggaggcctggaagcactttcccttcaacatgccctacatctttgaataggatagtacccctaatgaggctgaattcatgttctcaggtcctgctgtttctgctttgactacagagaccctcctaggtaggggaccgggcagaggccagctggaccctctaccactgattccacccattttactcccagaggaggccattgcgtccagrttcttggcacttccataagttgtctcgcatgctggaggctggctatcctgatgcaggttctgaggggcctcttggtgtctccatatgttgtttaatcatggctacaggttcgccatcttgatgctgaccctaagrgctgggactctggagcaagggcagaaaagcttctttgtctcagtttytactgagtgagtaagttcttccctgcaccatccaagggacagggagatggagtctttccttcaggccctggaatctcattcccagaagctgggagtcacccagggggaatccggtggttctcataactccatgctgcacctgctctacccagcattgggaagagtcttagtcaatggcatgttttttgtatttttgtattttttgtatacttgtacctgtagactccaatcctttagacctatttcaaagtatgtactagaaaaggagaaaaaacacaagttcaacaagtgtctgcagtgggtttgacattttatatccatgatctcatttaaatttcacaacaccgtggggaactgaactatggctcggagggattaagtgacttcttctagatcacaagattagtaaatgtttgagttcacactacttcaacacttattagtgtaatttactgccttgatctgtattttgggggtttagcacagttctgccagttcggaaggacctgggaggctgtataaggacaagtattgcctgattttgctattttatgcttatgctagagtacactgcttatgaggaaccatatgatacagtaatgttgtcaaatttagtggcagcttccttacatatatcaagggccatctatctttggcccttttataatgattccttttataataaagaaagtataaaggctttttttggttgcctggagtgctgataaaaggaacattagtatttcctatatttgtgacttaggctttcatgtagacttaatttctgaagatttcctattgctgccagttactctcagtccattaaatagttaggacataggataaagagagacaatgtttagagtaacttggcatgcttgctggatacaataattggaagtcattgatttatagtagaagtgatggtaaacctctttctgttagatttcatatttaattgaacatcctctattgccatcctcctgtcctgagtgctatccaggtactatcttcattaatggcatttcatgatgttgttttctgggaccagaacttcctactggctccccttctttccaccattttatgtttgttaatttcaaggcagtttcagacactcctgtaaattgttaaacagtaatagactcccctcctctcatttgacttgattatgaagtgccaaattccaagttcagaaggatttgttatttggagattattttgccctcttttgtaaattaatttcctttcctgctaagacagccaaagaactgcaatgattttctaccacagagaggtaatgaggcttaggggaaaaagcttaataggaaaacattgtcccacactaagaattaggaactcagggcagagaagaagaagatgaatattaaaaccagacagtgtgatatttctgtgtgagggtttctgtgaaagtgtgcatgaattgttctggggaggaattatgcctgtaccttcatgcacatcagagactacctatacagagagactgtgaaatggttaagcacttaacgcctcataggctgaagcagcagagaggggtttgcaattgagtgtgatgttgggaggccaggaatattatagagtccacagattctgcaaagtggagaaggcttttttagttatacatagtctggaagtttcttctcacaaaatatcctagcaattacagttgacctttgaacaatgttgaagttaggggtgctgactccctacatagtcaaaaatttacatataacttttgttgttcagattatttcatcactcaggtattaagcctagtacccattagttatttttcctgatcctctccctgccctaccttccaccctctaataggccccagtgtgtgttgttcccttctatgtgttctcattatttagctcccacttataagtaagaacatgcagtatttggttttctgttcctgcatcagtttgctaagaataatggcctccagctccacccatgtccctgcaaaggacatgatctcattcttttttatagctgcatagtattccatggtgcatatgtaccaccatggaatactatgcagacatataacttttgacttccctaaaatttaactatgaataggttactgttgataagaaaccttactgataatataaaaaattaacacatactgtgtttgttatacatattatgtattatactcttacaatagagaaaagaaaatgctattgataaaattataagaaaaaaatatagttactattcattaagtggaaataatcatcataaatgtttttacccttgttgtcttcacattgagtagctgaggaagaggaagaagaagaggggctggtcttgctctctaggggtggaagaggcagaagaaaatctgagtgtaaatgaattcatgcagtttaaacccatgtgattaaaggatcaactgtgtacagttctcccaagataatagcctagatcattggtttggagggggggatcataccagagagaacccatgaaatagagatgttgttcaatttgcaaggccctgttttgtttctttttctttattttttctctcttttcctcttgtggcagaaggctttctttggggagtgagccaagccttgaagaaaaaaaaacacaaacacaaaaaatctccttaaaaaatgggtttgttgcagatcccacacttaaacctgaaggcattgcagtaatattgcaattgatatcaaagtgcctgtttcatcacagatgagttgaggagtttgggaaacactgaagaggattaataaaagaataatttctaaaacatggcattgctaattttttcatgtctagcttttcctctggatggatcttaaaagcaaaacaaacaaaaccaggctatttttggttgttctatgaattgttttgaagatttagcctgttctaggagtttgcttcctcatgctgttttcaggttgatgtcgtaacatgtgcccctctttgtttactgaaaattattaactctgttcaattgctctgttgtgtctttattcttgcatttccttcctgtttgtttcttagaggatgccattcccatgtaggcactgtgctataagagacagaaaggagaatcgacataagtcttgtttttgaaaggtttgtttgggaagatggaatgtttagtgcttcggatagtgttccttagaagcagggcctgacatggagatttgtgagcactttatttattgagaaagggagatgctcataaaggagttagggagatgggatggaggatggtatggacctactcaggcaaggcgtcggcctcacccccaggaacacaggtgatgctgaagagtgtcctatgggcttttgttctccagcagcattggccatggggtggcaacagggccctgtgggcacctctgggctttgattactccagggaaggttgtgaacgtgagcctttagccagcacctgcgggccctggggcagggccagcgaaagggatcctggggtgtgtctgggtgggcaccagcaatgtctgctgcagttgtgtacataaattgccttagataaaggtagaaaataagacatgttactagaagtttgagataatgtgcaatgaaacttcataaggcatagagggtggcttgacctgggagcatctgggaagactgcatgggagaaccagcatatgaaatgaacctggagagatttgagctttttgatcatgagtagggaagtgtgttttggttgtatgtgaaagaaaccccaattaaacgtctcccacctatactccaggcccagctaaagctagtayaagcagaaatacagaaatataacatgtgagcacacttaatggggaggtctgagggtgcatgcttagaactccctctgcacactggtgctgcttgtccttttatttgctctgattccatcccatcacattcaattattaattcaacaaacatgcatgtactatatgccagacaaaaatcccttgccctcctggagcccagagtctggttctcatggtaggcaggatggtaactgccagccccagcccaaggaagacagtgacctggtttggtcttgcttgagatgtttccatcctgtgggctggtcactgtgaacaagaggatagaaacatccaatgaccggggataggagtgggatctagtgagtggtatctaaccagagccagatggagtcctgcaggggccatttcccaatggaatggggatgccagacaggctcctaactccagacgtctcccacatatactccaggcccagggttcaagtcagatgatggtacagtattactcctggaaggagactcttgaatgatcagtgacagtgctgtcagagcacagggcatttggagaggagtggtgcatatccggctggaacctgatttgagaggactctgaagctgtaccaggactgtagcctttgttctgggagccacagaggatgaaggggcttggtgtgccaagcggggtgtaggaagatcactctggcaggaagtttgtacggggcataatgtttgctggatttgcgaactgattaaaattagaggacaaatcaaaggtgactgcaaggatgtgcttctacttttaaatattttgttatcttacaggccttttgagatgttctccccctctgctccttgacaagaccattgatcacagtctggtcaggcttggattctcagagcctcccttatctgtagctgtatcatttttaaaagtcttaggacatggagttacatcttgcttttctttggacatttcacagtctctttggctagagtctgggatacatttgtgattacactgagctgtaccctctctggctagcacgtgctattaaaatgacaggaccactttctctcaatgttcttgccactccatttccggaaccatgtctctttagctccagaatagcggcatttcctccactgcttctaagttggcaaattgtcactccaggtgcactgctctgggcttaatggctcttcaggcatatactttagttgaatgtaaacctcccattgccactgtgttttgtctgctccctatttccatgaaagtaaaaggaaggaatttaagttcatttaagatcattaatttataaaattcctagccttgatgctaggctttgttacctaccaggtatctctctctctctgttatctatctatttatctatctacccatccatttatcatccagtcacccatctatccatccatctactcacccatccatccaactatccatccatgcatccatccatccatccatccatccatccatccatccatccctatagttctctctctctctttttatatgtatctctcttttctctgtctctctccctatagacacacacacaagaaacacatagatatcaggggaacaactagacatttttgctaattttattttagtcattaatataagtgcatttaatcccggcaatatatctataaagtagacattatctctcagtgattattcactgagtttcagggaggttaaataatgtgttcaaaattatagttagtctttggagatgccaggatggaagcctagaaggtttgatgtaaagattgtgctcatcagagcacaaacaatgtggcagcaccatccataatagcaaaaacctggaaacactgtaaatgaaaatcaataggtgtttggataaataattgaatatttatccataaaaagaaatgcaataccacttcccaaaagaatggattaggtctacatacacaaagagtgagaaaatgttcatgatgtattgttttatgacaaaaagaagcaaattatacaatattatgtacaatatgatttatttctgttaaagttatattcttatatatgcatagaaagggtctggaaggatgcccaaaaatatgcagttaccagtggttacttctgggaaatgagattggggaataaaaaggaattttcaactaaaacttttttgaaaattttgcaattattattattttaataacagttattgttgttataaaaatgtaaaaaccaatacaacaccctggtacaaaaggctatctgctgcccttcccctccygcaccccacacctgtcagagtaccctcctgggagaagcacgtcttctgttcccatagaaagtgcttcctttgtcctctccacccaaatttaagcatcatgtccagacggtttctctcctctccagtttgtgtattcctgtgtgggcttaaagtgtatttttctgttcatgttcctgattataaagttaatacttaataataaaaacatcaattcagacaacaatgaaatatcgtattacctttcagaatggtcaagatttttggaagcagtttacatatatttattttttccttaaagcacatgtttttattaaaatttgaaaatactgtatatacttagaagcattcagaatgtcaaaaaaacaggatcttttttcttgcaattataagctggtattaagttcatagaagagttaatacaagttgcatcaaaaacaaaactactactccaaatatagtttgtgttatatgtgacctgctttaaatttctgtgtcaatttacagccccatactgtaagatacaaagtcagtgtctattgcaaatacctctaaaagwtaggttcataatgttttaatcttaatactaggcttactayacaaaaattatctacacatccttattatttcaatttttaaaaaaccaagtgagatgtgtgtagggcagttaattccttcagagaagagaacatcttctaagttgggaaattgtcactccaggtgacaatgcagcttcccaaaaggactacctaattcctcaactccatcctcaaccacttcatcctcatcttcctcttccttggactagatgttttatccttggcaagtatctctgttttttaaaaataaacttttcacttggaataattttagatgattaaacaatggacagagagttcttatctatccccttactcagtttcccttgatgttgattatctcatctaatcaaatcctacattgccatggtacatttgtcaaaacgaagacactgacaatggtacattactatttaaacccaagactttatttgaatttcactagtttttctactaatgtcccttttctgctctcagttctagtctaagataccacattgcttttaggacaacttctttttctcctatggtaggctttaacctggcaaagcaataccattttcaaaaatttcctcagcttggtaggcttattgtaaggttgcttatcacctgcagtgttattcaacattctcctaattcttttgcaacatatccaagatgctctcctttgatttctggggatagaccgaacaaaataagaacaaggtcgaaggaggctattgagtgtattgggacgtctgaccctctttctttccccttcagaaggaaataaggctttcatagcgtggctttatgcttttgccacttcttcagcatcctctcttctcagcagatttggtggtcttctttacgaagcattttttagaaaattctgtgaagttgactgaagcatcaggtgctgcttcttgtgtgcctttctctggcacagcatcctgcagagtcacgacactctccatggacgtgcacttgtgggtctgtggtgaccacagtgcccctgggacaatgactgggtcttctaggggaatctgtagccatagcttcattcccaaaactggctgccttgctcatacgtgctctacatacatatttttaaattatattttatctgagatacgaaagttatccatggccattataataagaaaaacagttcaaagatgtgtaaagcagtattctccccaccccacaccacctccagtcccaggctccgtgttcacagcttggagtgtatccttgcacagctctgtgtgggtaacaaggtaccaatgcatgtggtgggtacttacctcaaaccacaaattcagaagtggaaacaacacagccttttttgactgcagcggaacttaattttcattttgcacttccccttctgtgtgggggcagagaatgcagccacggccatgctgtgtttcccctgtccccttctcctggaggagcctctctgatttggcagtgagaataatggtgcgggtggacagtgctggtggggactgccctggttcattgtcatcactgtcgcgcctcttctgagccatacactgttccttctggacttgctgttgtctctcttgctgtgtttgccaagtcatccacatttccgcattgtgagccattggagcttatgactgtgtgcttctcatattcacctactattggcctgtccctgactctcaggtcaccaggcagctccacaggccacactggggagtgtgggtggggttctgggaggccccttatgtctaccttcctggatgcytgagaacactgggcttgttggcatcacagtgcaaaatgaaactgaagacaatttctcagagccgcccaagactgacctggggattcttccccccgcaatccccggggctggccttggccctgggagcagggacagcatccctttccaagcccccactggactctgttactcaagtctctcatgtcatctctttttgcctgagcatttttctctcttcatggcatcaaaagtattttcccgaataaattatttagagcagtgatttccaaagtgggttacacaattgattccttggtgtgtcaaagaaaattattagaacttctgtttctaatttttaagtcaaaaagcaaaggagtgaagcttcctaatatttaacacgagttgacacttgggtcgaatggagtggacactgagcagggttcagagcagtgaccttacctggctgcttgtcttctcagggcattgagcacaacctatttaatctgccatgagataccattagctgattactttttaaaacacaagacctttcaatggcagactctttatagtaccttgtaatgaaatggggagaaaattttgaaatcttttgtactacccagagcttcactggtgatcttttggcaaagtgcttaaaagtctgggacttgatgctaagacatttttctctcattaaaaaacaaactttgaggattgctgaccctatttgtaataatgagataatgtcaattgaatgctacctggcagatactcttctaaaaattaaacatattttatctgtcccttcaatgttttaacaattcataagaaagtaattgctttttgaagtaaattcttggttcaagagagcattttgaaaatgaatggtcggaaatatttccagtatttttaattgttgttgctgaaaaccatatgtgtcactcataaataataatttaaagcccttatatctgcttactagaaaacaaaccttggaaacagaattttctaatccgtatataaaaaacttccacagtgaagtatctcaggatgttttgaaagtgcttatgaaaactatgaaaattttatcatcctaaaaacctgggaaacagaattttctagcccatgtgtaggaacttttcagagtgaagggtttcaatgtgctttgaaatgactttctaaaaacatgaaattttagtgtgtttgaagtatctgggaagatggaaatgtattagtcaactttttgacaaattctgtttgctaagattgaggaagcaataccccaaagaacttcttcagtttggacatatggaaatctgacagataccactttcagctacagtacagtacccattaaaatcaagtattgaaataaatggaaactggaagcaggctttgaattactgtattacaaagggttaaaccaagatttaaaaaaaattaaagcattttcaattacattgctggacttaaattgtttataatggagcatatatgtttttaattataccaaaaagattttgtactattaatcacagtaaatcataacttattaaaatcatttatttcttcttttggatcttttmgtattatatattctaatatgttttataatctatagtaattcatgtgcataatttttaaatacctaagtatacacataacggagcacctgcttcaaaggttttgctgataggtgttcatggttaggatgcttggcagtcatagtttggatgaggacctcagcatttgaaactcaaagccatgagttaacctttatttctatagtctgctggggtacccattatttccatgtctttaggagggccactgtataaaagaaattagtaaaatgaaaacatgtcagtattataatattctgcaaaaacgcatataactatatcatcgtttttattttagaaaaaatggaattgtactatatccgttacgttgtaacttacttaaaaaaaaaactctacagtaaatcacattcatctttccaaattagtaaatgtaagtctaatttactcctttagtatttatctagtgacccataatatgcacatgctacattttactaagcattttcctattgagagatatacatgtttgccccaggttttctcttccattcttttctttctcactacctccctccgttcctttctttgatgattcctcctcccccaatacagccaatatgccaataaatatccttatacattttttactgctgtaagataaatttctcaaagtcgaactctagggtcaaaggctatatgtattttcagttttaatagctattgtcacattacttttcagatatgtttgcagcaattttcactcagcaatgactagaaatattatttctttccatccttgctgaactgaaattattatttttcttcatttttgtcaattcgaggggttaaaaataataccatgcttaaatttgctgcttgtgagcttgagcacatttttatttgtttattagctatttttgttcgcttttgctgcataacaaatcaccccaaaccttagtggcctaaagcaacaaccatttattttagctcacaattctgtgggccaccagtttgggctgggctcagccgggaagttctgttactggtcttggcttagctccttcacagatctgtggtcagctactggtcagttaggtggccctgtggttgccagttgggtggctgttggctagggcaatggaggccagtgggccatgtgtgtctcataatccaccaggctagacagagactgttcacaggctactgtggcaggattcctcagagcagcaagataggacaagccccagtgctgagaacttttaaagtctctgctcaggttatgtttgttcatttcccattggccaaaaaagtcacacagccaatccagactccgggcttggggaagtagatatctctcctgatgggagggagaatcgtgtggccattgtttgcgatctatcacattagccttttcaatttctttttctctgcattgcttttgcaatcctttgccccattctcctttattttcttattaatactaaaggagctctttatttactgatattaaccacttgcttggcatgtatagttgacccttgaacarcatgagtttgaactacataggttgacttttcatagaggtgggctctgcagggccagctgtgattttaagtgtgcctggattttggtataggtgggggtagattcaatccccaagtatagcaagggacagtacattgcaaatattttctctaatctttcatttatctttttgctttatggtatttttcactatattaaagatgatctggcttaagaaattcttcctagttccatggtgaggtaatgcttatgtttctggtatttttttccctcccagtatagatattttattatttccatttagagctttaatctgtttggcatatagttttaaaaaatatggcatatattttatatatctttgatttattccagcattctttattaaatttccttattaaataatcattttccctcacagaactcaaatgttatttctgtaaagttcccatatataattttttggtagggggctatttggcaatatcctttgacataacaatttttcctctaggaatttatctgccagaaatagtttatcaagtgagcaagagatatgcacaagaatgttcattgaagcattaaatattgaaaaattggaagcaactctatttttgaaacaaatgattagatatcaaaatggaataatagaatagttttcaactattgcaaagaatttattagcccaataactcaaaggcatatttttcagtggtgataagaatattgtagaaagtatgtatgatatgcttctactgtcatactattactaagctgtgtatctttatttcacacaaccaaagacatatgtagtatttaatagttttgaatatgaacagctgctcttttctcttctttctatgcctcacttcctctcctctcccagtattcaggcaacacataggaccacaggacaaaagttaatttcagctttggaatttcaaaatagacttttgtaatctataatagagacattgatttgaggagaaggcttgcatagtctccattccaaggcagagataaaggacccctggcatcaggtttatgtcttaaaccttgaacacgaacaccgaggctcactgtccgccaggtccatgcaaaagagataaagattacagtagctgcaggaaggagaggaagctgggtggagaatctgagtgttctcatttaagttttggatgggtatctgtgaagtgatctttagggtggggatccccctagtgtggggaaggaaggtctggatcacaggccccagacagttggagacataagagtcagagacccctctgaactctgtgaaggtggagacccccaccaacatcctctgaaccaggtataggcagcatcagaagattagaaattggcagggtgggggtaggaggcaggtctagacagagaaagcctgtgagtgcccctcccaggggagcacaggatagcatctggaagctttccacgtgtccccttgagggggactttgagaaactgaggacccaagtctcttggaccagaagaaggctcacagctgagaaaggggtgccccagtgtgtttggcttgggttgatcagtacatttgagaaacttggatatctaagagtccattagttgggatagatcctgaagacggagggcaggggaaaagtatatctaggttcaagctagcatggaaagatgacccctccagtgccccactgcacacttcagcaccgtgtaagctccctaggatgaagatgcaattccagggagaagtaggagacaggaggcagttaaagccacagggaaaactcttatttgtctgggagcattcttatttgcctgatctcactttccattgcttaaaattacgtttctgccactaagtggaatggggcttgggatagaaataaaattcaatcacaaaaaactaaagatgccctcttttgcacacctcctgaatttgtgacctgtgaaattcatgccttgtgcatatatatttagataggcacagaaaaacatctggaagaattcataacaagctgttcccagtggtaacaaagtttaatttcctacactgaacatggatcacttttgcaataaaaatgcaaatctagaaaaatatttcaaagtatgtcatgttcattgtaggcaatttggaaaatataaaaagtacatttaaaaattaaatcatctgaattcccaccatgtagatataaccatcgttaatagttttatttattttctttcatctgtctatgcatatatgttcacagcatatagatatgcatatattcaacatgtatatattctttttacagaactagagttatgtggtttttgtgtgtcatcctatatttttttcttttaatgctgttaatgagcattttcccatgctattaaacattcttcaaaaatgcactttaaaaggttcaggctctgtgaggtatagactataatttctaaatacagatgagaaaacgagggtcagaaaggttaaataacttacccaaggacacccagctggcatatagtgcagccaggatttgaacctatatcttcctgattatgaagaccaaccctcctaaggtgggaagaataaatgaatacacatcacacatcacagatkgatgaaaagcacctgatatatgtgggtccttaatacatacaattcttctccagtctccccatcctgtgatctggccttccccaagcagaatggttcttatattggtagtcagtcttggtttatagcaacccttctgaggaagctcttggagcttgagcggctgctttggcaccctgagcccctgcctcggtctcttctcctctccaaggttctggctgatgctttcttcagccagggtctggctctgcctctttgtgtttcccatgccactgaacccagttgtccccatgggtcaacagtgcttttgtccaggccatccagaagtttaacagaacctccacagaagacaagatttaaacattgcaggcagtcaaagttctccctgcaccctttaaatttaaagcaatccattggatgagttattatggaagcagtaactgggttttggttgggagaagcctagggtctataaaattcagataaatcattccatagatatatttccagagctgtaagtcacccagacatcgatagaaacggatgtttctccaatttctttttcagaagccacatcagtgtgtgcaccctggaatctgcatttattattcatcccaatagctttggagagggttgccagcagctctgggggtctgcatatgatatcactactctcagctcagcttcctaagagcagagctgaagctaagtgagatgggccctcctttgaagattcactacacatgggttagaaactcagctgcctctgtgggccagacagagaaggtaaataagagcagagtgttggaaaaaacaagagagtcttggggactgaaccaactggagaggcatgtcccatcaaaaggcattcacattcagttaagaaactactatgataattcctctgacagtttgctactacatctaagagttgtggcaggcagaacaatgccccctgcccacagctgtctctctctytctcttytttttttttttttttttttgagagggagtctcactgtgtcgcccaggctgcagtgcagtggtgcaatctctgctcactgcaacctccgcctcccaggttcaagcgattctcctgcttcagcctcccaagtagccaggattacaggtgtgcaccaccatgcccagctaattttttgtatttttagtagagatgggatttcaccatgttggccaggctggtctcgaactcctgacctcaggtgattctcccactttggcctcccaaagtgctgggattataggcatgaaccaccacactcagcctgtctctgtcttaactcttggaaccaatgaatatgttatgttacaggacgaaagaaaattaaggttgcagatggaattactgttgctaatcagctgaccttaaacagggaacttatttgggttatccaggtgggcgcaatggaatcacaagtgactgtgaaagtgggagagggagacaaagagtcagaggaagacatgactccccaagaaaggcccagaaagacgtgttgctgctgattgtgaagatggaggaaggggccaaggaatgagartggcttctagaagttggaaagggcaaagaagcacactctatcctagggcctctagacaggaacgcagccctgtcaacaccttgattttagcttagtgagacatctactctaccaaactttgtaggtttttgctaaatcactaaactttgtgtgcttagtcactaaacttgtggtaatttatggcagcatcaataaagagctaatacaggttgtatcctgtctataagctaataagaaagcaatctctgttggatcatggggcccagtaagacctacttgggtagggagaggtggggaagcatagacttgaccttgacctccttgttgaactcaggttggaggaatcaggggtcccccggaggcagtccaggtaggctggcagagaggctgtcctacagaccaggcaccaggcggcctgggactgagcaatgacccacctgctgagggttggcctccagggacaaccatttgacaaggcttggttttccaggaggctacaagtgtcagcatccgtttacaaactaatcaaactttggcaggtttgaacaactatgctcaaatttacttgattaatttattttgaagaaattaactttaaaaagggattttacttaatatactttcatgtgacttttttcggttgaatatgagagattgttgttgctggtattatcaagttgtaattttttaaagctttccaaatcacaggttaaatgactacctgcgattacccagctagaggctggccaaattagcttctggcctgtttctaatctattgttactggtgatgacccatagaggactgggtttttaattggcccccagaatactgttgattagaactggagagccttttgtatattttcagcatgtttactcactatccctgaggtcaaatcctggctcgtttgtatcgtggcattttatgatgtctctgaggctcacttttctcatttgtagaataggaaccatgagagaaactaccccatagcgttgttgtgagagttacgggagacaagccatgtaaaactctgagcacactgcccagcatatagtaagtgctcaaataaaaatattgatttatctcattgttattctaattttgaaatatataagatgaaaaattggagaacgttgtattgaaagtcagggcaagagtagagggtggactctgaccccatccgagcacttagatgctggtaatccactagggaggaatggctgtggctgaacttttccctcaatattgggtcttacttatagaaaatatgtccaagtatttttctccttaattcaggtggattttcctggagaacttgccctagagagttggattctcccatccagattccccctggcaagatctttgggatcataattggaaaggaggcattcatacctctggaagaaactctgttggttgatggctttgtagaatatattaagctcaaaggcttgtcaaattgagaccagatagctaataaatctgggatggagagtctagatgttgatagatcacattggccttatctgaatgatgaataagtatgggaagaagaaacttcttgatgtgaatatctttctgatatttagtgtcaactttgtgttgaacattaagctagccctggttttctcaacctcggcagtgttggaattctgggctgggcacttctttgtggtgggggcagaactgtgcattgtacgatgtttagcagccttcctgacctctacccatttgatrcccttgaccccctcacctcaagttttgacaaccccaaatgtccccagacattgccaaatgttccagtgggaggagggcagtggaggtaaaattgcccctggctaaaagctatggggttaggcattggggttacaaaaatgaatcaaactcagctcctatcatctagaatcttacagtttaagaggggagaccctcaagagcaatgggctatgataatatagtcaggtcaaccacaaggtgaactctgagcagaacataagactgagatgagacagggtagggcaggtgataccttcaacacagctactcggctggatacagagagaaatggtccttttctgatgaacacaggtgggtattttgaataacagttttagttttctgatgcccaccggggccagtcagaaggtgctacctttttcccctgctgaaaatgggcccaggctgctctacattttgacctcctgcatctgtgtttcacgttagactgggaagttttcacatcttgttgcacaggccatctttatctttagcatctttgctcttctttagaagtactaatgcttgtccaggccacaccccagactaattaagccagaattgttgggatgaggcctggacactgggattttctgaagctgctcaggtgaatcagatgtgcagggttgaaaaccactggtctcatgtaaaggaaaacagcctgggtgaggatttgagtggaacaaaccaggatattggctggtggtgcctccagaagctgctctccaggtcggtctgggcttggttcacatcagtaaaattgggtaatggccacatctaggaaacaaaagcattattttaatttataaaatcaaattctattgagttgaaaaacaaatgtgaattaaaattaacttaataactgctcttttaacttagtgcaagaagagattgtattaatggcattctaaaactcaccgtctcttagccaaatactttttaattgaacatcaaaataactcaataaaaatattaaatgtccactttttctgtcaaaatagaggcaagtaaacaagggcaaagggatccttatgccaaaaaacataggctaaaggaagctcttaacattgccctctgctctgagcttcccagtaggcaaggcaacaaacagaactggatagaatgcatgaccctcaatgcttactataaggaagaatgccagtccattgggagtgaggcttctattttttctctttttcttttttttttttttagtttggtgcttttttagaaggcatttatcacatgagtttctagataagggacatagaacaacataatggatagtgtctttgcttgcagttttacaaacaatgcaaatgcgattcatgtggctgcctcttatatcagctctggctggaagccaaaggcataaacagtgtgatattctagtttggtgtgaatttttccatggagagctgaaatgatatcatccaggcttagagcttcccagggatttgacttggcagagcttaaaagccttagaagaattaaaatttggtgtttcttaggctgtctttctagctaacttccatctaatttttaagatgtagttcagcatcatctgttccaagaaaccttccctgactccctgaagttgagttaggtatcctaatatgtggtcccataatatcctgtgcaccccacccctccatagaacccctacaccattatacctgtgtatgtgtctgtgttgcagatgatggaccctgaaaggtaggcatgatatcagttatgtttgtattcccagctcatacactggctctggcacatagtaggtcctcataaatatttattaggcatgccaaaactagagtagttcttggtataaggcaaggtagtgtgcagagagtttagagtcttggttttggcaccagattgccaggttgaaatttaggcctttaccactatctagctctgttaccttggacaagtgaaagaattgctctgtgcctctgtttactcatccgaaatacagagctaacaacagcacctacctcacagagttgctgaggggattaaaggaattgacatatgaagcatacttagtacagtgcctggcatatagaaattgctatgcaattggctatgatgattggtgtttttgatgtccccatggctcttttgccagggtgaatgtacagaggggctgagctgtggtcctggctgggcctggcacacagatacttgttattcactcgaaagcagctcccatgtcccagctctgaggcatgtggagggtcaggctgatactctgcgtgtatactggccctccaggctgcctctgttcggaggttgggcaaccttatccatccttctcagagctccctgtccagccacactggggtgattttgggaggatatttgtaatctttaggtcagaactccatctctgaggctttctaccttcttcaggtgacctctcaccctgcctcagtttcccttgggaggcaattgaggggtctttggccatgagcagacttgggatcctcttctggctcagcctcttattttctgtgtgatcttgggtgaataaggaaacatctccagcatctgctgtctcatctttaataattgagacaatagtacccctgatgaagtggctactgtaacgattcagggaagtaatctgtatagagctgttagccgggacccgtcatggtcagcatgtaatcaatattagatgcttttgctcttgactttgtgaaacttacttctatgaagtctatacctggtctttttttccatgacatgaactttctttagaatttatctttatgaaaataaccagaaaagctctggaggccttaaagtaccgaggtggctttatcccaaccaaagtctacaggacttacttgtgggtggggatcagtgcttactaacctgctcctgaagaggcaggaggtccctactcacctcctccctcctggagctgcctggcactcaggccacgcctggcagtggccccagccagcgtgactggcatcctgtctgcttgtggcttctccttgcccttttcatactaacttcattttctgctctaaaagacataggtattttacaaaaaaaggattaggaaagaagacaaattaggcacttttcatcatatttgtactgaaagtgatgtgtaaagtggttttgttgagaacaacatatgatttttgtcccagagcactaaatgtgaatctagactcttagaatatagcccagactctggctccaatccacagctagcctggaggtgtgtcattttgatgagctatttatctttgctctgtgtgtgtgtgtgtgtgtgtgtgtgtgtgtgtgtgtgtccaatctctgcagcttagggttcttccattccatattttggggcatactttgggcacactggactcagagtaacttttctttatacttacgttatttttgagggcaaggagatgttttgctctttcttgacttcacaggatttcaatgacctacttcttcctttaggtctacccaaacctctcactctttcagcccagtacctccatgaagccattcctactattccagcttgctctcacttctcccgtcagaggtccctccagacagcttgcccatccacagactgcatgcactatctgttcctccctacataaccccacagtggagcccaatctgattgaggaaagagacagcatcagtggcttcccttcttgcctgcaaattcaccctcactgaggacagggtacctaggaaaccctcagcctatatttatgttgaaggagctcagatctcctgttctgtacatttttaaatcattcatccttctagaaagatgtgttgatcaaagtgagccagtatgtttgaactatttctttgagcagactattataaatctccagccctcatgcacatcctgttgatataatgtcaatcccgaggttactgatggttccgcacctcttctttctttggattgcttgatgtatgttcatataaatgggctgtggaatgaagttgtaggataagcatttgacattcttcccttctagaagtgataaatcgagcctgcgcccaaaatggacttgtgggcttgatcaagaattctctatgaagttgtgtctgtttcactgcttgattccaaagaacacacagccccaaacagcctccagggcctgaagattggagcagagaattccttgttttatcccaaagtctggccagaaggtccacctttccaaagtgtatgaaaataagttatgtcttagtccattttgtgctgctatcacagaatacctgatattaggtagtatattgaaaaactacctgttggatactatgtttattacctgggtgatgaaataatctgtatacccgtccctcataacatgcaatttacttatataacaagcctgtgtatatacccctgaatctaaaataagtttttttttttttttttttttttttttaaagaacagagatttatttcttatacttctggaggctgggaagtccaaagttgaggagtstgcatcattggcaagggcctttgtgctgtgccatcccatgtcagaaagcaggagggcaagagagggtaagagagagtgagcaggagagcaagagggagtcaaactcacccttttataaggaagccactcttgcaatgctgacattaatctatacatgaggatggtgccccatgacacaaacaccttctattagaccccactctcaactctgttgcattgggaattaagtttctaacacatgtttttttggggatacattcgaaccatagcaagttctatataagaagttttggagtttgggttctcagctagttttccaggcttggtgcagaaaatcgatattccttttattttgttttgctgccgattttccctsttctgtcagcccctgcacaagccatgctcatccctgctgtgccctggtccagccaccttgcatcagtcagtgttcttagtcatcaacaacagaagcctgctctagttagcttaaggaaaaggagaatttattgacttctgatggactttggatttattgacttctaattgattagacaagtctgattggttgcccatgtttatccctgctctcccctaaactattctaaaatgatggcaaagggttaaagtgttgcaaatctacaagatcaaagaattcataagaggagacaacagtggataggtgcttggggccagtttttggaaaatagaaagtggatggagggctgggcacagtggctcatattagcactttgagaggttgaggcaggagcatccctgagtccagaagttggagaccagccagggtaacataatgagactccatctttacaaaaaattaaaaagaaaattaaccaggctttgtagcatgtgcctgtagtaatagctactcaggagactgaggtgggaggatcacttgagcccaggatgtcaagactgcattgagccaggattgtgccactgcactcagcctgggtgatagagggagaccctgtctcaatttttaaaaaagtggatggaagaagggtaactgatgtagcagatgcaaggatgttacagtgttagtgcttggtaataaagatactattgtggggtgagcctggttctgccggcaggcctctgagagcctcagcacccagaaactccagaaagcccaggttaggcaggtggtacaaaccaggaaaaattaagcagagattgacatgttcgatagtagaacctttggctgcttcttctgacctgctcccaggatgccagcggctggagtgctctcttctggcaggatataataggagtcttttctggagaaactgaaggactctggagaaaatacctccaaatgctgacattggggaatcttccattgcaaaggacaggaagtccccctatccacaagtcacacccatacccttcaatgagcttcttaatgcttcatattaaacatgaaaggacaattaaggatcattatgcatttgaggaatgtcttttatatgaaacagagagtacaacacaaagggataccaaagggatccaggacaaactaaataatgtaaggaaaaagagaaaacttcaaaaatgctattattagtcttaaagagattaaaaaatattgcacccttaagacatgaacaggttgctatgaaaaagaacagggagcacaaagcagcaattgaagagaaacatgatgactgaaattttaaaagttcaattgaagtaaagcaaaaaggcaaagaggtatataatgagagagaaaagttgataaaaatgcatggctcaatttagaaagtttaatattctagtagaaattctagagcaagaacagaaaaaataaagaaaaggcaaatatcagagaaataagtaacaaaatatttcagagttaaaggacatgtgtctccagattaaaaagtcctcccaaccatgtagctcttactcaaagtagatgaaaagaacaaccacaccaaggcactgggtagaggggtagggcagggggagagggaaggaaggaggaggaaaaggagaaggaggaaaggggaggagggagagtaggtgacatgaaaagaacaggaatcaaagtggcattaggatgcttaagagtaacaccaggcctggtggctcatgcctgtagtctcagcactttgggaggctaaggcctgcagatcacatgagtttgagaccagcctgggcaacatggcaaaacccagtctctacaaaaaatgcaaaaattaggccagcatagtgttatacacctgtaatctcagctgcttgggagactgaggtgagagattgcttgatcccggaggtcaaggctgaagtgagtcatgatcgcaccactgcactccagtctggatgacagagtgagactctgtctaaaaaaataaaatagaaaaagtaacatccatactagaagatactggagaggtgctatttctgaggaagaattaatattcacatattctatactaagtgaagctatcaatcaatatgatagcaaagttaaaaaaattcatacatggaaatactcaaaaacttacacactgtgaatctttgcttaagaagtttctgtggtaggatgggcttcagaaaaaaaaaataaagtcaaaataccaaaacaagataaaagtaagcataatagcagttacagagaatccaaccagcagagcagaaaggaagtctcatgacagcccctgctcatccaactggagaccaactggtccacacaagagaagggagagagctggaatgggctctctccagggcttaaggaaatggaaagcttattttgttgcattgagcatttggaaaagtacattatattataaatataatataatatataactacaaataaataactataaatataaataaaacaattttgtagttataaataaccacaagttatttgtagttataaataaccgcaagttatttgtagttataaataaccgcaagttatttgtagttawaaataacsgcaagttatttgtagttaaaaataaccgcaagttatttgtagttaaaaataaccgcaagttatttgtagttataaataaccgcaagttatttgtagttataaataaccgcaagttatttgtagttataaataactacaagtcagagcaattgttaatgcaaaaaagcaaaagttgtataagcaaggaaataatataatcatagtctactatttggcttagtagtgaatagtatcataaccataatggagtcaatacatttgatttaatttacaaattgtgatacaggtagattggaaatactgggaagggaaatgaaaggatgagaggattaagagacctaagtcctctctgcagtatcaggaacataatagatagtgctaaagttgatcaaccaagtatagcagtgtgaacatgattaaatatgattaagaaatatggaagtaaatcccaaagaaacagatgaaagagttataagtgtttgcctctggggagcaggactgggagtggcattaggaccagggactgccatttgtcaatagaaggcttttaattctgccttttaaaaattaagatttagtatagaataataggcttagaaactattgtctgtaattgtaacattgtgctttgaaattactcagtttattctcccttttaaaacatttgattgtacccttatacggcacaaggctcttgccagtttttgatatttaaattttaaaaataaatattatcttccctattgtttgtataaagttttagaatggagttaataagaaataaaagtaatttattcgaatgacactggtcaactcacagaggtgggctgaatgctggagaactaggcccagaaagccatgggaggctggatggaacagatgttgctgaggttaccctgggtcagtctggataagacaccttcggtggaccccaacactgctgttctcgtggggagtgagttaaacctttgagtcactatctcaagattcaaggggatctgctgtgctaagcctaggtcctgtgctggccttgcacacaatgggcatctccacacaccaaagactctctgatatggggtagacaaaatcctacaactgtttctcacacaccccaatgtgggacaccctttccttttctcccaaaccactggattcctcaaactattgggaacctgcccccatagcattttcgaacatattgagacccaagcatcagtcttgtctatctatctcccagactttgcagatgaaaaaacagtgaaatccaaggagtttaaaagcaaaagaggaaaagcaagaactaggtttggagtcctcttcacatatatttccctggttgatcaaacagggtactagtctgctaaagtttacctttgctcacgatctaaggtgaagagggtaatgttggaagacaagaagaggttccaaaatattctgaatggtttgtgtagagcagtgaactgattccagtaacatgacatttacaaggataaagatgaaggcttccagtgaggcctgggaaccccctgaaccagtacagggaatgtaggtgtatgtttgtgtgtataactcattattttaaaaatacatccctggggcttgaaagtggggcagctggatgtgagctgtgctgtccccaggaatgtgagggctccgcaatagtgaatcagtcgtggtgcaagggggaaagggagcttcctgtcgtgccacttttggcccagctcccagccttcacaggwcaccagttctgcagctggagtgacttggtgtctgcaggccaagcctgccagtgccgattcccacactggaggacggggactgtgcaggctgccttgctgctgcataatctgccttatccttgcagacctttcccttttgcctgagtgaagcccttgccctatccctgtccgctcctgtgattactcatctctcccaaactttatgtatttatgtaagtgttttagagatgcaatcttgctatattgcccaggctggtctcaagctcccagccctaaacgatcctccgcctctttctccagagcagctggatcacaggtgtgagccaccacacctggtctctcccaaactgttaagattgtcctctccaacttcctgctgcctgagggagtttagtgggatgaatcatcatcttcctcattgagcctatccagcatctgtctttatgcagctgcatctggaagtcacatcaggttcctttttctccttgtaccttactcagttttcaacctatgactccatcccatcaatgttttctttctaaacgctttaagctccatccttttcttcctgggccaatgccccataccctgctgtcgtcctcattgcctcttttctggactattgtaactacttttcagcaaatttttaaaatgctctcgcttgtgaaattcacctccacatggccaggctggcctatctggaatccagatctgaccatactcttccatcctaacttccttccatggatgcccaagtctgcatctccatttacctgattctgttcctgttgtaacctcagtgtcctgtgaaatattgatgtgtttctcgaacaaagaaagtgaatattctggggagattcgtttgaaaaataaacaccgggtatagccaattttgacaagtttctgggaaaagaggacttgtttgtttagtatgctttgtcattctcaagctggagatataagtgcagtatatctccaactttcccacagatttttttttttttttacaagaaactttacatcttctaagaccctcacatcctgtggaacacaatctggaaactcgcagcttatggggtaaaagccaggctctgctgcctggcagaagaccctgttgactgggacctggtagtgtttcaggtaataactcatgcctcatgccactgatcctcccacctcgggtattaagccatggggtgaccaacagtggagatgcatcatgtgcacatttaactcacagtccattggttctcaggccagatgatgccacatctgcctcaacaggcagtcggcatagtgaagcctgacatagtttgtgtgccaggacctgctggggagagtgcatgcatggtctagagggcttctcacgtggtcagcttgcccacacacttcctgtcctaacttgcaaggcaggaagagtttccaaagtggtctgagcatttgaattagagcagtggcctgagagaccagggctaggtaagtgggtgatgatttagttaatacactcagggaagaaaatgaagctaattgagggctgtagagaaatagtgattgataaaggttaggggaacagatacagggttctttacacaaatgatgttttctgtaccatttcatatccatgaattaagaaatctttatggctaattttgtctaattgatttttgcctcatctggtaactttagattcaaatcctcactcacacgatgtgaggatgtggctccaccacagtccctacaaatcgaatgccctttcacacctccaggcttctgcacactgtctccttagaagccctgtatcacagttttctctctaagccatgtcattctgtgggtggggccttttcaggtgctttgtgctggcaatggggtgggcgttgggcaggtgggccacacccctgaggactaagagcaggcatctttggtttctgattctgtttctaccttctataagggccaaatgcaatttcctggcttactgtgaggtccccaagagctttggggaaaaactaagctcttggccattcccaggtctgggacccaactgcttgggggctttgtgcttggagaggggctgtcttaaagtgaagcaaaatttacattgtggatgctaaaaatagtttccttctccccacacttttattgctgaatttgcaatatcctctcttccttactccctaagacctcagagccccccgtggtctctcagtcactttctgtggagccagagtcccaaattgagtgcccaggtggccgaggtaagaggtaaacaatcgtttatgccccagctgtcgcaccatccacctcttctcccccagtgtactggccacctcccctagttttcccgtgtcacaaatccagagacttgtttcctgacagtttctgggccaggagttcctccctagcaccatgaggtagaagaagcttatatctccagaactaaaaagcagatatttttctttctattccattctccaaaaagtcaggctcgtaaaaaagaatacaaattatactcagcagctcttatcagctyggtaaagaattgctactttcaactttattgccttaagaagaattcacatgtttccatcttttaaaaatgatttgggttgagggaaggaatttgattcatgtgcagaagtggcttgcatgagcatgatttgaaggggtcacagcattaaccttgagcgctaatgctttaattgagcagctgggaaggtgtagctattctcccagcggatgtacccgctctgggtcaggagctctgagactgacagctgcactgggagggagggactctcctgtccaaaatggctccacaccctccttcagcagtatctggtgctgtggtccctggagttggtctttggatgcaggcagcagcttctcaagctccagtatgagggaggagaaaacatttctaatcagttttggactttgcttgtatttgaaaatcacctgaagctggagctgaacagcagagtgtatgagaaatggctcaacacagccacctgccaccccagggccgtgtcccctgccctcagggaccgagtcatgagattgttcacagtgcacactgcagaggctggtggctgcccccgccaaaccagggtgggcataaataatctcagaagtgatttgttccactgtacatccaggtcctctaaagaagttgtgtgacagcatccatgtggccaagggcctgaatgtcttgctcctctgtgagacaagatcggatagaaaagctgggctccgttgcctcccatcaggacttagcctgaatgcctgtaagaacaagaacatggggggccttatttggtttctgtgccctccaggtggcagggaaattatggaccattgattaaaatccaagtatccattggccaatactcattggcgcctcctggcttcacttctccaagttgatcttattaaacagatcgtgcctgtgagcaggctccatttcatttttctgctgatattaacgtttccttataaattgtccacatgtagcatattctcactttttattatagtaaattgcactccctgcacagccctggaagctgcctctatttcatctgaaggatccrcaaatgatctgtaatgaatcttcattcccccggggctgtgagcgggcgcttctgccatccacatgaacagggaaggcagttcagactggctgtcgagctcagacttggtcaacaagaaggactgaggccagggaggtctaatgatttactagaaattgttcacatctatcagaattttacatgaatttagtcaattattctttctttctttcttgtttttccatagcaacataatagtttttcagagatctgagccaatgtcaaaaaagtctaatgctgaacactctctcttccagtgaactctctttcagtaatatctttttaaatgtcattgaccaaactagtccagaacttactatgttgttaggcatgatatatgggaactagcatcaggaggttcaacgctcagtacaaatgaagaaacaattgtatcctggaggaaaagctctagaatttgatcatgtttccatcacctcctaaaggtcagggcatcttgcattcctccactttaagttcactttgtttctttctcagatcctctcagatgtgtagaaagggggtgttaattgcaaatacaggcagcactaactttgcatggcacaatgttaaccaaaaatcaagtgtataatgaagttcgtgcaaagtgaggacactagttccatatgcatgggttttgtttaccagagtaccatgcaccatgcaaagcaaaggccacctgtacattcatattctttttaactgtagtaaggtttctgtttatgctcctggccttccttctactcagctctggaaatgtgaatcacccattcattcattctgtaggcacattttgaagttcactgtctgccaggtgctgtgtcccacaagtggcttcgtggtaattagaccaggctttggcctccaggagctcacttcctagtgagggactagaggctactccccatatgcaaaaaaatcctttgacaaccagaggtgcatgtgatccaggaattttgaaagggggtgacaggaaactctggaaaccaggatcagattttgcagaaggccctgtagctctccaggcccccactatccagtcaccactatcactgtcgcctgaatcaccttctggcttagctgttgtttttgcaccaaacacctatgaaacatgcagagattgagtttcgtcttttcttggtgcccaagtcagtggaacacggtagaaaccatatgggttttgcattggaaaggcctggttacactgactttctgggagactttgggaaaatcacttcatccttctgagtcttggtttttccatttgtaggctgcagctcagtagcctcyttcagtaggccattgtgaggactcagrgagggatcgtgtgtagagggcttagctcagggtctgggctggatgaggtgttctgtaaatgccagcgattgcccccagcctgcaaccagccttcccctccagcctttcccagccagtgccttccctgaactcctaagaggcaggttcagctttyttccaggaaaacagccctctcagcctcccccagagctgtggtttagtgcttcacagggtaaattctgatacagctttctcagatggctttcctagagctgggagtgattgccttgtctccaccatccttcagtgacctgagcccatgcactcccccatgttcaactgcttttccctctgcccagatggggtgtttcctgttcctgccaagggtgggggccttggacttcaaggatcctcgagcaaagagatgggtgagatgggaacagatgaccatcaaggaggggctggctcctgggaaaggcttgggacaaaatactggaaaagagaccttctgggatccaagattccccagtgggatctaagaataaggatggagccagaattaggagtcttgggagatgaagagaacttcagggcagttttctggtgaaacaaagaccaaagaggctccagagacaaggctggggcaaggagaagcagctgagtcagcatcttgggacgtttttccaagcaggcaggcccccaggagacacagggtggctgagaaagttctgtgataaccgctctttaggggtttcctcatgcttcccggcataacttctgaaaactcgggcctcatggtgtctgctttgctgatttccttttaaacaggctcttcaaataatccatcctcctgcagctagctacaccccttccttgcaaatggaggggcgttgcgctcctgcatgctttggaggggtgacattgcacagagagcattgttcctaaatgacatgttgttgcaaaggcagcggtgggcctttaacgtgagctcaatatctgtccttgggaaagtgccaggccctgggcttcacggggggaatgttcccaaatgttagagttggggttttaaaaagatgctaattgctgacaagctttcattatctcaggctcccagtgttggggggatgcctagataagtggtcaacaattaacacatacataaataattggtggcatttgcactttgtaaaataaatcctcagggatgtgtttggaaggcttccatgtggaggttttttccactccatttactattcctttaggccaagataaagagaaacagtctcacacttaagaaatgcaagtggaataatggtttcaggcttatgagaacaagttaacctggagaaggacagcaccgtgacttataatggtgttttctcagatatgagaaaaaagaccattttgttcccattgttacggggccaggttcagacccaaaaactttttcagacagttatctggggctttcagagagcagcatgaccaaaggaaagaacacaggctttggagacagttgggccgtagttcaaatctaacctctgctgaatactggctaagggaccttctgcaagatacgagtctagattgaggtatcagttccccatctgtgaagcagggataagaacactgcatggcttgttaagttgttgggagtaaatgaggtgtgtgggttgtaaagcagaggagatgttgtattgaagtatcttggggggtggttaataaaagcaagctctcgtcgcccttggaaatggctccaacttagtcttgagtgaaaagccaaggacacagaggaaggggacccagactggagatgcctcctccaatgcgctcagcctcactgtcttctctacttccttccaggctcttggatattagaaccaatcctcaccaccatatggtccaggggcagctgtcagctctccccagcaccagtctaggagagctgcctccacccttgacattcttgtcagtgctcagggactcctttctgtgcagagtctgtttggaagctgggagccagtacgtggcccacatctatttccctatgaaaatcgtgagatcagggtggccagggcaggacccaaatgtcctctggccctcagtgggcctgcagaatggcctgttggtgtcctgtgtcacttacaactcagctcttgggtgtcactgggaaaaggcacctgaggttcagattggggctgttgctctcgagcagggagacacattcccttccacagtcggctccccagacgtgggaagaacagctgccttcggccttctttagctggagtttgcctataacagcacacttttctttccagagggtggaatgtgggtgtcaagatgtggatatacacataagtcaacacacgtgtggacactcagctgtgccttttacccctggctgactgcacccagcctcgcagctgtctcatgtgccagtaccaccatcagcatctgctgtctcctccattcaaaaggggctagaagagaagtcagctggatgctttgcaacttcttacatccttaattcttcttctgaagttctgtgtttgccaatgtatcatggccacaggagccaggcagatgggcccagtggtttggctaggtctcgtgggattcacagcaatttagaggggtgcaggcatctggccaccgcagcaattcctttgggcttattgggccctagttcccagctcccacggggtttgtgtcccycagccacagtgtctagcttcaggagagaagtctaactgcagacagcagggaaccagccaccccacctgctgggagcccaccctgagcagaaggccggccccccttccctccccgcccacaggatacaggggctgccctttgcttgtctgaccgggtcatcacttctgtgctgatgcccacagcattatgcagctcgatccacactgtggccaagatgggagggaaacaccacgtcctgctgccttgaaggggagcacatggaggtggtggtgcccaccactttgcaaagctgtattgattgttggtctttttgccctggtgtatccatgatggcagagatgaggctcctggtccactcccctacccaggagaattaggatggcctgttggggttgggtgggctctgtctgttgaatgaaggaaggaaggaatgagggattatgcacgtgtacttcaagagaccatcgaatcaagagcaggctggagactccagtagaaggaacgggaggaactttgcgctgactgatcatctttagtgagagccttcctgggctggaagtgtcacctgtaatttcatttgactctcacaataaccctaagtgggaggtgtttgtctcaagttgacttcgcagaagtagacttggagatgaatttttgtgtgtgacaatgatttattaaaaattatggggacttaaaaaaagaaagacagcagggaagtggggacttggaacaggaacataaaggaagccaaacaaggtgattttggctccatcctgaaaagctgagatcacactctggagaagtccccagtagggagcaaggcagctgggatttgttttcgtggcactctgggcccctggttaggggtgtgcattccaaggcaccgtgagtgccaagcagggttcaggcagcctgaattgggggtgttggctggtgttgggagtgagcaaacatgctgagtcagtgtaataaaaaatgctaacaggattcacagggactgtgggcagagccccctgtagcactgttggtattcaaaagccttatgggtgtggaaactgcagctcagagaagtgaaaaggctcacccaggagcactcagccaggaagtggcagaactgggattccaatgtactctgcctgcctgctggaactctctatagtgttctcactctgcagacgaaagggaggacttgcctccacctgctgcagttgtagctggagaggaaaaggaaaagggcagcacttagaaggggaattaatggtgctgggagggacattgcccactggggtgtgagcatttagggctcttcccacagagctggcagccctccagtaattgctggagtggcgcgggttgatgggggacagggggaggcaggcagtgttcctgctaaatctgctgtagcttctccttctctccatctatctcagcctctgtgcgagtggcaccctctggaaaaggctgcagaaaagcactatttatctccatgtggggaaaagaggcttaacaaattagctgatgcttaattggtgaggaaaagtaggacagaaaagttgaccagttgtcctgtggggttttctgatcaattgtctccaccaatatcttccctgcatgggtctgatactaggtggaagtacttcttagggtggccaaggctcccacctgctccctggggtctcccagcaactgagtcaggttgtctgcactgctggcttcttccaggacaagcagagaacctctcacctgcacaggtatacccagaccttcagattcacagaactacatattctgaagcagggctctcagcccctgaagccaagaggcagggtcagagctctgaaacagcacaggacctcagacacagcacaattaccagtgaattaggatccctagcagtggggcctggggaccctcttttttaaagctccctaggaggttcttaaacacagccggactggagaatcattgctgaagaatgtcagtgcatgataaagctttacctctcacaaatggtcaaccttcttagaaaacacggcactgtaaagagagcactgctcaccttctgctcaggcacttcctgggatgggacgtygctactcctgaggcaccccatttcatcttgaatgacttggaaagtcagaaagttgtctcctatattgaattgatatctgcctccctgattatgggagccattggctstaggtcaacactcagaggatgcatagagcaattccaatctctcttgcacatgacaatttaaagacacctatattgtcccacctgtaagcatccctgatcactttaactgtccctctccatgactgggctatagtgtgcattgtccttcatcaagtggggtgacctggttaggtcaacccttcaaggggtggaacaaactcctcccacaccctcctttccatgagttgagctagagcccagcgatgtgcttttacataccttgggagacgggaaggggcaagtgttatctgttccttttacgaaggaacagagaccagagtggttaagtgacagctaggtggaggcagtcccctttggtttttcctcaagagtgttgctttcaaacttcatttccccatttgcctttttgctcctggaaactgagtgtaggactttgagtttggtcttgctaaaccacaagtctttagattcagttcagtgttccagccactgagatgttatgacatcctccagatttgcatctgtgcacatttgataagagtattgccagtgtcttccacatgagtgtcaaggaaatgttgaattgttgggaatcgaggtgagctagagcccagcgatgcgctcagagcattctcagcccaccctgtctccacttctccctccacctcttcatcagtgcttccaggcttttgaagacctccctgaaagtctgcatgttgacaggagagaggctctggatggggtggctgagactccacgctgaagtgtcctcctttctctatcctgactgaagattcctttgagctctggctctttagcccttgcagcttctctggagagagcccggttaactgagtttgtagaaaggggaggaaagtgtcttcaggatacagccttgtagcatacccaggtacatggcttagcatcccttgcagcctcttttctttccagtgcaagagagatgcaccctgtgcatgacagtttgcaggctgcagcaccatgcagacctagggtcatttgtggggtcgttggcacaggccccgacacctccatgcctcatttgttgggagtgagtcagatctctgtgtactgatgaggaaagatatttgtgttacactgataaatcaaaaactagagtcttaactggatatgtatttcatggtctgattttaatgaaaacacttgtctgatatctatttgtagctatttacttgcggagrtaactgtaaaatcttctagaaggtgacacctcaaacaacatttagagggtaaatttggagggataaagggggaattttcactatgtcagcatattttttttaatgggatgggattatgggatgttgagcatttttatgtttctgcattttttttttgataaaaggaataataaaattacattacaaacaaaaaaacaggactccaatctgatagctcttgtccaggttcatagtcagcctggctcagtgcccaggctcagcaagcacttggcacctgctcacgggatgtattcatacaggacatgcttggaaaccatcagtctcttccaattcttccaatctgttggcttttcaattgaaggagagggaaagcactcataaacacatacaggaaacaaaataattaaytgagttctgtctgccttggccttccacttcatttgcataatcaacaatgtttgctgaatacctgctgtgtgctggttacagctattgggacacagctgtgacctaggagatatggcctttgacataatggcagaggagatagacaataagaaatattctagcagaggagacagacaataagaaataagtaaactgatagccattcaagcacaaagatggcaagtgccataaagaaacagaacaaaacactaatagagagttacgggatggggctacggcccaggagctacaaagagctttgttctatggatcctaaagaactgaaggaaactcggagccccagagctgctgtgagctgctgtcttcctgaatgtcactcagtacagctggactagacaagcccccataaatccctcgttccagtttcctgattctgtagcctggagtaatgataacactcatcccctaagcrcccctgcagaaaggtgtttgcaggcattcctagggaaggggggctgtgcctgtgcctgtgcctgtgaccctgtgctgcctgcaggaacccaagcgtctaatcttgctctgggctggtgcaggagtgcgtggagggagagcaggaaatcagatgtctgtgttcagatgaagcttcttgcagctaaggcagccagagcaggccccaggggratggcatgttttgtgaggaaaatattctccaagaacaatgtttataaaactctgtctcggcaatcatcctgtgtctgccagcttctgtcttgcttctgttcatgttcgttctttttctctctgcaggcygtggagaccaacctggcttccaaggacagccactgggtctttgtgaatgaggtaagggctctagaaatgtgatgagcacggcctggactgagcccctagccccttgtaaagctcagtgtgattcttttcagttcaattctgacttagggggctgttgtgaatcctggggctccacctagcccaggcaaaaactcaaagagttgaacttgacctagcagggtgctcacctggcaggtgggaacgagagaaagaatcctgacctgggtccatgaggaagtcaaaagtcagagggcagtggtggcagggatgaggtgtgctaggtgaggtgaggcagccagtgggagccaggggctggagcaattagggcaggtcatgaattgggatgcagagggggtggggcaaaggaatgagtaggagaggaaggctgaatttcatgcaagatggtaagggtgtgcatgagtgtgagcaagagtgtgtatgcagggtgtgcacatgcgtgcgagagtgtgaatccaggtgtgtgtgtgtatgtctgtgtttatgatgtgagtgtgtatgtgtgtttgtgtatgagttgtgtggtgtgtaggtgtgagtgtgtgaacatgcatgttcgtggatgtgtgtgtgcaggtgtgtgtatatgtgtgtggatgtgtttgagtgtgtgacaggtatgtgcatgcatgtgcaagtgtatgtgtgtgtatatgtgtgtctgtgtgtgtgtgcatgtataaatgtatgtgtgaatatgtgtgtgattgtgcatgtacaagtgtgtatgtgtctttgtgtgtgaattgaatgtgttgagtgtatgtacaggggtgtgcatgtgcaaattttatgtgtgcatgtgagtgtgtatgtatgtatgagtgtgtgtgcatgagtgtgtatacgtgagtttgtgtatgtatatgtttgggtgtgtatgtatgaaagtgcatatatctgtatatgagtttgtgtgaatgctgtgtgggttgtatgtgcatgtgtgtttgtgtgtgcatgcgtgtgtgtaagtatgtttgtgtgtgcaaccagtacgtgtagggataagtgtacccatgtaaagggagtaaatagaaagtctctcccatgactgaccatcccaccagtttggccccagggaggaatggcaacaccagggatcgtggtggcctggcctgcttttcattacttgtaccctgtctggccctggcctcctccacgctgcaggcattgcataagagtggcctgaaatcacacactctagctttcccaaagaatcccctctgcccacatatcctttgaggagcactaccggggtggcctgtgtgacctcagtgcrctatattcactaaaagctgactcagaatgtgttcctggtgcaagctttcatcatggctatggccttcagctgctcctaaattactgatcaatttctaatggcttcattctggaagatgcaggtttattatgtaggtaattcattcttttatgatgtctgtttcctcattagttctttgctaatatggctgaaatagtcttgggtggcttattttaataattgtgcaggtagtatcagattgtaactacttgcaaagtccacttttcgtagattttcctccatgaattcacatcttattagctccatgtccacagagggcagctggggacgtgcagtaaccgtccatttaccgtggggtgcaggtggttgtgctggtaattagaagggacatgactgccgcctcctgttttcagagcctgtgagagrctgccttgatccttgagaagtttggattctctggggtttgctgacttctctgtggctcttcatagtccagttttctttgttccaaagaaacgatgcattccatgtggccctgaagtcaaatgtctgatgctggttttacttttttgatgaatcctccaaactggatagccagtgtttctctgttgccagtcttcaaaagaattactccgtttttacattcctaacctgttttcttttctttctccaaatccccacccaccctcaggggccccctgtctgtccctcttgactcactcttcagggctggcgttaacttcagactaaccagtgtgcggtgcccctagggcattccatactggtaggcacattggcattactggggcagctggaacccagggtttagtgtcatcaggaggagtcagatatggggtatacctgttggagccacactggagcggcttctactgagaggattgtggtgtctcaccatggccagcagtgtaccctgtgccagcccggcagtgcacatggatggtgtgaatatctctgagctgagtgtgtcctcctccaaatgtgaggggcctccagggagcctcatcttcctcctttcttggcttccttttctatgaggcaagggacaacatctaatatttctttttttatctttattttttattttttgagactggagtcttgttctgtcacccaggctgaagtgcagtggtgtgatctcagctcactgcaacctctgcctcccgggctcaagcaattctcctgcctcagcctcctgagtagctgggactacaggcgtgtgccagctcacccagctaatctttgtatttttagtagggcggggttttatcatgttggccaggctggcctcgaactcccgacctcaagtgatctgccctcctcagcctcccaaagtgctggggatacaggcgtgagccaccatgcccagccagctaatatttcttaatcacctactatgtgccaggcacttgtcagtgcatttgttaccttcttagtcctcatcaacagccctgtgtggcggttgtcattatcctcattttgcagatgggaaaacagagtctccagaggttaaatcacttgttcaaggtcatgcagctattaatggtgtatctgggatcctatttgaggactgtctggctccamatttttccatcaaacagtagtttcatgcacatggccttggcaaagatctataactcacagtcagtatctgattcagtgaagtcagtcagtgggggtcaggtatgcacactgatggggaatactcttgggctggcctttggtgccagctcagggacttttttgaagtcttctatcagaaggtagggcctgttggaaagctttcacccaggcaccccagggtagcctctggttaaggaccgtggtgttttccaaattacaagtaggcttatccttaggatccagctatactcaggactactgtttccggttttagcatggccccaattgaacacaaaagtcctgttattcttattataatgtgatatcattttaggctttgctcagtttttaagctatccaagtatagagccacagacaaatggtttctcagccaccttcctgtttgtcttatataatcactagagataaaataagggggaaaataaagaaaaagagaaagtcaggggcaggcatttactggctcactttccaacatgctccagaattcagctgcttcactgggtccttgtcttcccacctcttgaaactgctccccacttctctggaggaagttcagttcctcaaacaagctcaggtctgtgcctccccgaccaccgcaggtgtctttggggcctccagcatggccctccagctgtgcccccagctccctctcattccttacaggctctgcctttcagtttcctcctctgtatttgatttgttttatgcattttcctggattcagaataaacacttgagggcacacgtttttatttgctttctttacatctaccctcttttctttctggtgagtattggtgctacgtattacagacctggtttatttggagacgaaataattgcacgcagaggaagctttgtgagtgtgagtcctaccaacagttcctataggcctctgggcactactgtggggacactggagagcggatgtgtttttatatctgctagaagtatttaaagaatatttttattgactgattaggttgcagattaccttagagagggtaggggattcaaaagaacttgtggaaaacaaaatgaaccattagtcaaggtggccactgaactgtgagtcccttgagggcatggccagattcagctcatcactgaatcctcaatgccctgagcaaggaatagattcttcaaaggtttgtttgaaggcaggtcaatgtacatagtgtagagcaaattgcattgacaagcatttccctgtctgcctcagagaaaagacaaaggcaacaattaagtcctgagtttcagcgatggaaaggacctctctgggtcattcattagatgttgccaagttcaagcccagtcagccttgactctggatgagctgggtggcttttggagcctctttagcagctgaggtaaaatgtttcctctccacacatcctccagcagatgccaggagagtcagtgatccctgtgggtctggcctcttgggaactttgtgcagggaattctcctatagaaaaatcagtatgactctccagcctcttgaagaaccaaggttgatggggacttgaagcactgtgtttgttgctgggcagcttccattgttacatgaattcttccagacattgaaccaaagcacacacatactttgttggaaatggtttaagatgcttaacagatgatgtgggtatgcacacataacctttgcacctgggttttctcagagagtgagtctctaagaggtgatctgtgggtcagcagcggccaggaggaggtgacttctaaaaagggaggaggtatagtcagcaggcccttgccacttcttcccgattgtcagtgtaagtcggtgactccacatctcacgtccattccaaaccttgcccttgagctccagatccagagatccagcttgactcaagatcctcttgacttggccacttggaagctccatcaccacctcgaactcagcgtacttctttccaaactcaccatcctccccaaamctggttctctcttggtgctcctgatctcagagaccactgtccccatccttctggttggctcctcagacacagaaaaaacaaaggcatgataaaagaaaaagactgtgatatgaatgctgaatcacatagctttaagaaatctgcccacttcatccagcctgctgcagccctctgcaggatgaccctgaccccacatttrtacccttatttacttcttactattgcgttcatatctcatgggtcatccctgcaaatggatgagtgacttctttcttgcatttatttttccctcctagctttggggttttggcagggtttttctttccacctgccatgtccttctgaatctgtgattgtctaggacttccctttcttgcagacatctgcttaacattgcctctgccaaaaggacttctgtatttccccagtagggtgattttttcacagcctcaccccagttctgctgtgttggggaattgatgcacatgcctgattccctgaacaagctgatctcttttctctgaggttccctaaagttcctagcatgagggtctgacacacagaagagctcactgggttaaacaatctgactgtatcctaagagaccccccatctgccacccaaaggacaaagtcatcccagtgtgtggtcttcttcagcaccttctgcctagatgctctcctgtttttgagtctcaggccccagcccccatcttatcacttacactagtttgtcaccaacgagtactcagtgaggatccttagggatcagtccttgcccttagagtggcctctgtcaacagtccagggacatcactccagactttcaaatcttccctatcctaaagcacacaccaaggtaaaacaaatgaaaataagattatgcaccacatatataatgtgggagaggaagatgcgaatgctctaattgaagaaaacaaagaaaaagaccatgatatgaatgctgaatcacaaagcttcaagaaatctctatttgggacccagagaaagagagggaaggaaaagatttttttcttccttttattttgaagattccaattctgttggactgttcagtccctataccatttaccatcttcaaakttaatttagtaacactcgaaaacaattacgtttgtcataatctttttacttgtttctctcccagcctcattgaggaatctttgaggacagggagcatatcttactgcctctgtagtcccagctcagaactcttgaatgaagaccaggagttgccatttatcagaccttagatggagccagacattgtttttgagtatcaccttcattatgtttttttaattattattactgaaaaagtaacagctttgttgaggtttaattgacatgcaatacatacaatacttaagtgtacaagttgttaaatttggcatatgtatatacccaggaaaccataaccacaatagaggtagtgaacgtatctgtcaccccaaaagtgccctcatggtcctcaggaatgccaccctcctggcccactctcacccactctctaggcaactactgatctgtttctggctctactgattatttgtatctttgcgttttatgtaagtggaattatggagtgtgtactcttctgcttttggtatggcttattttactcaatgaaattattttgagattcatcttatgttgcaatgtgtagcaatagttctttccttttaattgatgaggaatatttatttgttcatggatataccacaatatgattatctgttccgctgttgatggacatttgggttgttttaggttttttgctattacaaataaagctactatgaacatttatgtataagtctttgtatggacatatactttcctttttctggggctcatacctacaagtggaattgccaacccctatggtagatttatgttaacttttcaagaaactgccaagttgctgagagttccagttgcttcatatcctcttcggtacttggtatggtcggggtttttgattatagtcactctgatgggtgtgtaatggtcctcactgtgatgttgatttttcatttccctcataactgacaatacttcctagcatttttcttgtgcttatttgccatttagatctaggtatcttcttggcaaagtatctgtttaaacaacttacccrtttatattggattttttgttttcttattattgagttctgaaaattctttttacattgggataaaagattttttaaaaatcagatatatactttgtaaatattttctcccagcctgtggcttatcttttcagttgagcactgtcttttgaagaacagacattttaaatttttatgaagtttaacttatcaatttattcttttaagaattatgtttttcgtgtagtatctgaaaactgcctggactcttgattctattccattgatctatttttttctrtctttatgccaatccgacattcttttgattactatagctttagctttacgatacgatttgaaattacattttgttaggctcctgccttgttcttcattttcaagattgttttggttatcttaggtccttgaaatttttgtatacatttaaaatcagcttgtcagcttctaaaaaaagctgactgggattttatttgggattgcagtgaatctgtactccatttttgggagaattgatgtcataaaaatagtgagtcatctcacccacaaacaagacatatcttcctaattatttagattttctttaatttctctcaatgttttatcttttacagtgtacagatttttcacatatttttgtgagatttatcccttagaattttatattgtcagtgctactgaaaattatagtttaaaacaaattttaatttccarttgttcattggtagaacatacaaatgcaattgatttttgcatattgatcttgtatcctagaactttgctaaacccacttaccaaaactagtggagtttttcatagattccattagattttcttagagaaaatattcttgactatcatgtcctctgggaatatgacagttttacctcttcctttccatctggataccttgtatttcttttttctgcctgattgcactgattagtacctccagttcaatattgaatataagtggtgacaggagacatcattttcgtattcctgatattagagggaacacacacagtttttcatcattaagtatcaggttagctgtaagttgtttatagatgttctttatcagattgggaaagttctcttccattcctagactggtgagtttttatcaggaaatgataatggattttatctaatgctttttctgcatctgttcagatgatcatatggtttttctttttgcagtttattaatatgctgaattacattgactgattttctaacattacagcaatccaacatctctgggataaaacctacttttcatattatattatcctttgtatatattgttctatttgattatatttgattcattaaatttttgattagaatttttctcctatgttcaccaggtatattggtatttaattttttttcttttgatgtctgtctttagttttggcattggcataatgctggcctcaaaagtaagttgggaagtattctctcttttacagtttctgaaagagttcataaataattattattttttccactaaatgtttgttagaatttaccaatgaagccatctgggcatggagttttctttagggaagtgttttaactacaaattaaatttatgtattagagatagagctatctatttgttctcaagtaagtttggtaatttgtgtctttccagaaatttttccgtttcatctaagttgtcaaatttataggtatgggccaggcatggtggctcacccctgtaatcccagcactttgggaggccgaggcaggcacatcacttgaggttgggtcttccagaccagcctggccaacatggcgaaaccccatctctactagaaatgcaaaaattagccaggtgtggtgatacacccctgtaatcccagctactttggagactgagacattagaatcacttgaaccctggaggtggaggttgcagtgagccgagattgtgccattgcactccaacctgggcaacagagtgagactgtctcaaaaaaacaaaacaaaacaaacaaaaaaacttataggtatgaagttcataatatcccactagcatcctttcaatatttgttgaatctgtagacatgtgatttttctcatatataatattcattacttgtctcttttctytttttattgatcagtctgattggaggtttattgacgttattcatttcaaagaaccagttttcaatttcattgattttctctattgtttttcaatttccatttatattaatttattgttttgtcttccttattttcttttttctgtttactttggctttaatttgctcttttttcccctagtktctagggagtaagctgagatcattgatttaagacctgtctttttctttgctatgtttccccttaagtgatttagtgacatcccacaaatcttgatatgttgtgctttcattatttagttcaaaatacttctmtattacttttggattccttctttgacccatgggttttagaagtatgtttttagtttccaaatatttggggattttaaagaaatctttctgctattgatttctaatttaactccactgtggttagaggatagagtttctattatttggatccttttaaaattattgagactgatttgatagccagtatattgtctttcctgctagatatttcaagtatacttgaaaaggatccattatctgctgttgtgtggaatgtttcataaatgtgaattaggtcattttagttgagtgttgattgcgccttctgtatcctttatgattatttggtctactttttctatcaattatttagagaggagtattaaaatactcatccttaattgtgagtttgtttgttctcctttcagttttaccagttattgcttaatatatttggaagctttatttcaaggggcataaatgcttaggatttttatgttctcttgatttattaaccctctatcattaggacttaaattaggatttgtccctggtatttttttctgctctgaaatatagtttatctgggattactgcagccattctatatttattttgacttgtgttagtataataccttttttcactgtcttacttttaacatacttgtttctttatgtttaaagtatatttcctggaggcagcacttatttaggtcttgctattttatccattataacagtcttcaccttttaattgaggaattttagataatttatactgaatgtaatcatcaatattgttaggttcaaggctgtcttcttgccattttgtatttgtttcatttcctttgattccttttttctcttttaaaacctcttatgggtgaattgcgaattttttatgattctattttaacttttattggcttatgagctataactcttttaaaaaagtttagtagttgcttaggatttatagtatacatctttaattcaccaccatctacttttaagtgatattatactacaccacatatatttcagtataagtatcttacaatagtatccctccgtgttaccctcccgactcaatgtaattgttataataaatgttactttcatatgtgttatatacacaaaaatacatagttattatgtttattaaaacagtcagttatcttttaaagagatttaagtaataagaaaataatcttaaatacttttctctgccgttatcatttcaggtgctatttatatttttggtgcgaagatccgtagtttgatctggtatcatttctcttctgcttgaaagacttcctttgacatttcttatagtacagttctgctggtggtgaatgcttgccgcttttgtatgtctgaaaatgacttcatttcactttcatttttggaagatatttttactaggtacagaattctaggttaacagtatttcctttcagtactttaaaaatgttgccttactatcttcctcctcatattattactgataagcatctgatattgtccttacttttgtttttctgtatataacatgctctttatctctggtttcttttaatgtttcttctttttctctggttttgatcaatttgattatcatgtaccttggcatggttttcttcttgtttttatttttgtgtgtgtgcctgcactttgttgagcttcttggacttgtgtacttataattttcatcaaaactttaatccattattactgcaaaatgtgaaaaaaatcttttatattttctaatatttttctgcctccatatcctcttacttgagattttgagttacgcagatactaggtttttgtgaagttatcccacacgtcactgatgttctttttctcttattttttctattttattttgtgtaatttttattgttatgtgttcagattcagtgatattttgtttgtcgatgtctaatctgccaactattctgtccagtgtttttttttttaatttcatacattgtagttttgatttctagaagtttttgagttttttcgttaaatcttcaatgtctctacttatattttgaatgtaaaaaaagtagttataataactgtttagggtaattatctgctaattctaattctgttttagttctgggtcagcactctgctcagcattgtcatgggggaccctctggaagtgaccacatttttctctctctgtgcagttttcttctctctagtagtctttcctgcaaactctaactgccttgctcttccattctcttgggtccatatccttaacacatggagtccactgggttctgcatgcttcctctccccacctgcactgtgtcatggaaattctctaaaggcagagatttagttcagtcataaaactcaccttgtttcctgtcttgaaggatcgctattcttcattgcctattttccagtgtcttgcaaactattttttcataggtttttcctagtctttttggttatttcaggtcagagggtaaatccaatccctgttactccatcttggttaattataggcatcatctttattatcttatttaattctcagaaaactcctggtattgtggagcacattttcaatggggcaagacagatgaccagataattattacatttataatttgatgaatttgttagatactatgtagagtaatacaatcatgtaaggcaaaaagagggagaaggagtggattctactttacatagggtgcccatgagaaatctgttgggagaaggaatggattccactttacatagggtgcccatgagaaatctatttgatgaggtaacatttgaacagggacttgaagaagtgaggaagtgaggatgctgtgcatatttctggaggaagagcattccagttgaaggagagaacaggtgtgaagtctctgagtgggagtctgtggctaggctttaggaatggcacagaggccagtgtggctggagcagagtgagtgatggagagagtggtgggagaggggttagaggcatggcaggaggccaggtcatgtagaacttttctggcctttgtaagacacgattcttattctgagtgaagttggaagcaagaggagggttttgagcaaaagatgggcaatatatatatatatttttttgaaactataccctggtagctgccttaagagtaagtgaggtggtgaggagggtagggatgaaataaactatttatcaggctattgtgattatctaggaaaggaagggtggtggtttggactatggggtagtatggaggaggtaagaagtagttggattctgaatatatttggggtggggagccgataagatttgctgttggattagatgtggattatgagaaaagagaaacatcaagtatgattctagagttttcatttgtttgtttgtttttagcttcaggaactgaaaagagaagacatttcttgagatgaggagattgaatatttcaggggtaagatcaggaatttggtttgaatctgttaattttgagatacctattagaccattacacagagatggtatgtagacactagacatgtggctctatgagtctggagttcagagggagggtaaagctgktgatatgaatctgggaaccatctgcatataggggatattgaacctcatgtgactggatgagaccacagaggggttgcattactaaaaatgcgaagaggcccaaaccctggcacctctggggcatgtgaagccagagaaaggaggagaaactcaccatggatgctgaccaggagcagcctgaggtggaggaggaggacaggtgttgtgggggggtcccagaagccaagtgaagaaaccatttcaaagggaaggagaggtcaatgatgtctggtgatgctgccaggagggtgcgtgacctagaaggggaatgccgggaaaggtgggaggacagaaccctcaagaactccaacttctattataccatcctacagataagaaaacagtttgatgtcacataattagtaagtggcagaatcaggacttgagatctgagtgacttcgaatttaagaactccatacccgatgccacacggctccccscttatcttccctctcactcccagcactggttgaatgctgaataagttatggaatcccagcaatatctgaatttttcataacttagaaacagtaatatagtttgtattatggaaagtcctactatgaaacttttgttaatttattgcagttgtccctccttatctgcggttttactttttatggtttcagtcacccactgtcaactgaggttcaaaagtattaagtggaaaattccataaataaataatttatacgtttttcaatcgcatgctsttctgcatagtgtgatgaaagctctcgctgtactgctttgtcccacccaggatatgaatcatccctttatccagggtctccacactgtatgcaccacccacccattagtcacctactactaggttatcagatagaaaaaactatagtatatatagggtttggtactatctgcagtttcaggcatccactggggatcttgaaatgcattccccgaggataagagggagctgcttgattagatttgtaccctttatgttattttgcacattagtgccttatttttaaaatctattatggcaaacgtgaaagaaccttgcaaaagcccacacaaacaagcttatgtatgtcccatgaggaataccagaaggaaacaaaccctatttactggaaatgcacttctatatgttaatcacaatagatctattcttctttctcagccgtaaaggaacctatgagatttaacatttatggttgcagatatatgaggtcatcgttgttctgcagtatcattctttagccctttgaaaagccctgtggagacggtgtttgcagctgcacagatgatgggttttgggagcaggaccgaggaagaagtgacataccattgtgctttagatcacagtctttgggaacacaccatggatatgattctggctgcaatactgaccacttctgtgactgttttatttccttccttgagccatattttcatcatttactcagtagactttgtgatagttacctcctaggacagtcatgaagattaaatgagctaacatataggaagtggcctaacacagtgtcaggcagacagcaagcacgcttaaaagatagctcttcttctttgggaggccaaggcgggcagatcacgaggtcaggagattgagaccatcctggctaacacggtgaaaccccgtctctactaaaaatacaaaaacaattagccgggcatggtggcgggcacctgtagtcccagctactcgggaggctgaggtgggagaatggcgtgaacccatgaggcagagcttggcagtaagccaagatcatgccactgcactccagcctgggcgacagagcgagactctgtctcaaaawaaataaataaataaataaataaataaataaaataaaataaaataaatgaataaataaataaaagatagctcttctttgtaacaagtgactcacatcctgtgggaaagtttgcctttgtactttagtaaataaaaacacactgacttgaggaattaattcctcttgttacttgttatgaatccgcgtcgcagcatttatagttctgttctgggcctgctgcgaccctagttcttcctgaagtctcatgcatcctttaagacagttcaaattactgcctcctccactttttgcaatacttattaatgtcttccatggtctttccttctttccacactgcatataacttactctgtgattcttcagtgatccttatctttttccttcatggcctctctccctcccatgatatgtaactcttgacaagctattgttcattcgtcatacatgtactgaacacctgtgaagcaccagggatgctcataagaatttgaaagatgagtccctcaccctcagagagcttagagtgtcatggatgagaaacatgtgtccatggatcactaaattacagctcagccaaggctgtgggagccactccagatcctctacagttcaagttccaactccctgtagacagacaacctgccattgctatggaatcagactccatgtttttagatatgaatcaattgttcccaacaagtgtattgccgttttgcagagttttgacagaaaaatgcttgggaaagggagtgctgacacttagggagttttaaaaatagctttaattaccatatgcagcaaatgtatttgaaaactaaaggttggtgtctacctttccgcattcctatccatctgtcttccagcaartggattctggtggattcagatgaacttgctgcttgtgccagaaaggccctattatctgtgccttctaccctgttattacacctccttcgccagtctggataatcattatgcaccacacagaggagaagcaagcgcgcctgcacgcacatgtacacacacacattcacacgtggctgctgccttcacacagcatgggaaattacaggcccctggtggagctccccaggaagggtcctttcaaagctggaacagagaagcagaggcaggagatagttcaaaccaccagaacctctttctgtgagtgtcttaagggatgtttgagggtttacagagactgtagtctcagctttcattctctttcctactgcctcaaaccaggggatgctacatacattgaggcagctgtctcttagaggtggctggagaatcccaaatgaatattatgcagttttggaaaggaaagtgaggaggcagtttaactgccagtgattggaactaggatgcagtttccagcagccctagaggccagcttgtcagctactgagrcaatgaggggctgaaccttctgggtactttcacgcctgatactcctcttactcaagaattgctgaaaagcccactgtgtgaggcccatggggatctgaacaagtgcctccccatgtttaggtttctgcttgctgtgggcatggcaagaatagcaagccgaggggttgccctcagaagcaagggaagacacattgctgagtgcctactgtgtgccaggccctgctttggatgctttatagatattatcttaaaacaaattaaatttacccaattaaagggatggcaagaaacttgatctcagttataataggattgcttcctttctgccctcctgaaggatatgcaaaggttcctggattttacactaacaagatcaatcatagaaagatgtctgtagactcagcagtcccactactgggtatayatccaatggaaatgaaatcagtgtatcaaagggatatctgcactctcatgtggattgcagcgctattcacaatagcaagatatggaatcaacctaagtgtccatcagtagttgaatggatacagaaaatgtggtctatctacacaaaggaattctattcagccttaaaaaggaaggaaatcttgttattgacaacatggatgagcctggaggacactatgttaagtcaaataagctaggcgtagaaagacaaatatggcatgacctcacttatacacttctgtgttacagaattatgcttctgtcaaccatgaaccctatgtacaacagcagtcccataagattttagtggagctgagaaattcctgtcacctaatggctttgtagccatcctaatgtcatagtgcagtacattactccaatgttcatggtgatgctggtataaacaaacctactgtgctgccagtcatgtaaagaaagtagagtacatacaattaggtgcagtccataatacttgagaataataataggcgactatactattggtttatatatttactatggtatttttttattgttattttagagtgtacctcttctagttacaaagaagaaagttaactgtaaaacagcctgaggcagatctttcaggagatattccagaataaagcattgtcatcataaaagatgacagctccatgcatgctattgcccctgaagaccttctagtgagacaagatgtggaggtggaagagagtgatattgttgatcctgaccctgtgtaggcctaagtgtcttagtttttaacaaaaaagttttaaagaaattttaaaaatagaaaaaagcttatagaataagtatataaagaaaacaatattttgtatagctatacattgtgtttgtgttgtaaactaagtgttactataggagtcaaaaagttaaaatagttaagtttataaagtaaaaaagttataataagttaaagttaatttatttttgaagaaaaattttaaaaataaattttagtgttgcctatgtttagtgttcatagcctctatagtagtgtacagtaatgtcctgagccttcacagttactcaacactcacccactaactcacccagagcaacttcctgttctgcaagctccattcatcgtaagtgtcctatacagttgtacaattttttatctttcatagcatatttttactataccttttctatgtctagctatattcagatacacaaataccattgggttacagttgcctgcaatagtcagtacggtaacatgctgtataggtttgtagcctaagaacagtaggctatgccatatagcctaggtgtgcagttggctgttccatctaggtctgtgtaagtaccctctatgatgttctcacaatgacacaatcatctaacaacacatttctcagaacatatcyctgtcattaagcaatgtgtgactgcrtgtggaatccaaaaaagttgaacttatagaagcagagagaagaagggtgagatgccgtgggccagagtgacagtggggggttggggagatggtggtccaaggaatcaaaatttcagttagaaagaattaccagttcaggggatctattgtacagtatggttacgatagctgacaagaatgtattgaatatttgaagaatgctaagaaagattttaaatgttctcatcacaaaaaaattgataatggatcaattaattagcttgatttaaccaatccacaatgtatacatatatcaaaatgtcatgttgtacatcataaatatataacattttatttgtcaccatcatcatcatcataaaaagaaagacttctgtaggcactcaataacattaactccaagccactttgggcmtcaggcatgatgatatgttttccgagcatgagagaccccatgcctatggccaagccttcctgaggggccagtgtattggggatgggttaatccaaggcttctcctctggttccctccccatcttccctggaggtttcctggctcaggccattttacctatccccattctccaagccacagagaacttcccagccaaccattatgacagtttgcctattttttgaaagaaaatatcttgggagaaagaagagcataaactttctagggcataagtgctgcttaccactgtgtaggtgtgtctgggtgtgtgtataatgaagtgggaggggcagggatagaagcaaagcagagaaaaattgctctaattccttctgctccttctataataataaaataaaatacaaattaatataccaataaattatcctttcaaacagccttatatacgtcatttattttgcctcattgagattttactgttatgttcagttttgtgtctcactgttttcaattaataatrtatcattaacaatttatcatgtcagtaaatagcatttgaaataatatttaatgaccttctagtattctgtcattggaggaatcataatttatgcaaatcttctcctttgttggaaacttagcttggttaatgctattgtaaattatgctgcaatcaacatccttatacctagatctcttgatgtctccttctgatgataatattactatttcaaagtatggaaactcaaagagtctgaactgcttttatcatagtgcctgtctcatcttactcttgcatcttgtgacatgaatataataaattgttatttgtttttaccaatattttagataaaaaggtgcactgcattgtttaatttgtatttctttgcttattagcyaagtcaaacacttttaatatttcttgattgatcatcacgtctacttctattttgtgacatggttgcctatgtcctttgcacagatgtgttagttttatatagctttatccacacaacaaccttataagagagagattattaaaaatccagtagaggtgatgaagttgaagttcagaaaaggtctgaggtatcacaacaatataaagacaagctggaattttaagctcaagttggtctgattccaaaccctgtgttaccttcatgcagtactgcctttgaaccagcccagctctaacttaatggaagatacatgttgatttttgtccttwaagggtcaaaatttccgcatcaagccaagtaaaagttctgattaytrtattgggtagatcattttaatagctgaatcaaaacttggctttgcaacttaaagtgacagaacttcctgttaactagaaatagacagaaaagccacgaaacttcatccgacagatgaaattcttatccaatagaagtgaatgaatgaacagattcaaagagccagtggaagacaatgtaaagtagcttttatgatttactgcaaagaatcctgcttgtttaaagtcctggctgtcttatgttgarctttcaatggccccaccaagaagacttgcagtgaggggcaggcactctcctcacccttgtgggagtgacaacatgtccatgttcgtttttcccccagagagatgtttctcactaaatcctctttcccataattttgactcttgtggcccttttatatcctccttgtggctgagcatttttggagtcaagaaactgattctcattttcctcggatcatctgcatctgggtcaggtacttcactatggaatttcatatcattaagactatgtgcctcaaagaaaattttcaatttagcttaatggttcagtttaatatgaaaagccatttcttccacccaaatattggctgcaggaagatgggttctgttaaccattaggtttttgtccctcagctcacaccacacagtactgggagagatgtgtaccccagatgagaagcagtcatagccaggaaccacaagaactgggaaatgtggtgatggcttgtggatgaaatgtggacagacagttaataatggggcagtggcttagagtccaaggtgataacatatgagcatgggtgggaggatattctgtggcatctgctcccacaaggacttggcttgtcttctgattgagctgaggagacactagagcattttgtattgagaaatgatgtgatgtgaattatgtttttgaaggaccaccctgacatccgtgttgaagatatatcatgggggttgggatgagaaggggtaggaaaaaggaaaaaaggtggagcctttattagagatgatgggatgtggaccaggatggttcaaatggaggtggtgagatggattcaggctcaggagtttcaaaggtggggctaacaggagctgctgagagttgattaaactgatgtcagggaggaccaacggttagtgcaaaaacaagcaccttcaagtagcaagtgttgaaaggagatgaaggttataggttctgtgcagggtgagttatattttacaatatatatatatatatatatatwttttttttttttttgagagtcccagtttgttgaaggctgtggtgcagtgacacaatcttggttcactgcaacctccagctctcaggttcaagcgattctcctgcctcagcctcccaaatagctgggattacaggtgcacaccaccatgccgggctaatttttgtatttttagtagagacggggtttcaccatgctggcaaggctggtcttgaactcttgacctcaagtgatctgcctattttggcctcccaaagttctgggattacaggcttgagctaccgcacccggccaagttctgttttgtttggagtgctctagatctgagcaaaagtagtctgattccaatgcctacactgctgttattttataaacttttaaaagtacaattgacacttaaaaaacctgcacaatctgataagtacgacttggagttttgaaatatacatttgtaaaatcatcaccacaatcatgataatgcatctttgcataacccacaaaaatttcctcctgccccatataatttctacctctacctaatctcaagacaacctctgatctcctttctgtcactgtagattacatttcctagaattttatatcaatggaatcatacctgtattatactctttttttgtggagcttatttcactcagcatattgattttgagacacacgcatgttgttgtgtatattggcggttaatttttgcatatgatatgaggtaagggttaagattaatcyttattttatttttttayatagttatttaatttttccagcaccagccattgaaaatatcctttctactttggatcttttgtcaaaaatcaattgcccttcagtatgtgtatctattcttggactttcttttctgtttcattgaccattgactggtggaaggattgtctattgtcccagcagtgccacactatctcaataactgtagcattacagttaactttgaaatcaagaggagaaagttctgtaccttgtcctgtttttgaaatgtcgttttcacctttctaggttcttcacattttcacaggtgtgggactagggtgagacaagtgaggcactcaggacacaaaatttaagaggaattcactctgaagtttgtgatagtgccttaccctagttgaggccctgcatttccatacgcattttagaattaacttgtcagtttctagaaaaatcctgctaggatttaatttcaattgtgttgaattggcatcttaacaatattgtcttctaattcatgaacaaagcatatcttttcatttatttaggtctttcttaattatttttagcaatgttttacactgttaagtgtacaggtcttgttgttaaattagtctccaaatatctaataagtttcctataattgtaaatggtgtttcttttttcatttagatttgcaattgtttgttactagcatgtagcaatacaactggtttctggatattgaccttgtgttcctaatcttgctaaattcacttcttagttctggtaggtttttgttttagatttcctgggatttttcgatatagactatcatgccatccctgaatatagtgaactattcttattcctttccaatctggatctctctcacttatttttctagccctggtgccctgactagaacctccagcacaatgttgagtagaagtaatagtagcggatatctatgcctttttcctgctcttaggggaaaaaattcagccttttatcattaatgatgatgttagatgtaggttgattgttgatatcctttatcatgttgaagaagttttcttttattcctagtttgctgagagtttttaacataattggatcttgaattttgccaaatattttttgtgcatctattgagataatcacgttttgtcttttttattctgttagggtggagaactaaattgattcactttcaagtgtaaaaccaacctgcagtcctgggatgaatatttttgtcttttttcaagaaaatgttggattcaaaattaaaatattttagctaaagtattggctaagatattttaaagaaattttaaatctgtaaattttgtatctatgcccagagatacaaaaattggcttcagtttcttatcctgtaaaccctttgtctggttttgttatcagggtagtgatggcctcctgacatgagttgcaatatgtttcctcctcttcaattttctgaaagtgtttgtgtaaaattggtattctttcttccataaatgcatgtagaattcaccaatgacgttatctgggtctgaaaaggttcctctgaatacccttcatggaaagattttaagaacacattctatttttttagcagatctaggactatttagattatctttttttyctgaagatttttttttttaccttttatttttctaaaaacgtctttgctttagttttgcatgtataaaaatstaggaaaaacatagttttctttttttttcttttcatacttaaaagatgtatcacggacttcaggcttgccttgatgaggactcagctcttaatcttagttttatttctccctgcatatcggatcttcttcttctagctgcttttaggattttttctttgcctctctttggttatgtgcttaattatgtgtgytcttcatcaaacttggaaactttttggcaattattttctcaagtacttttttctgtatccccttctctctcttctccctcatggacttgaatgacttgtatattaggctgcttgaaattattctattctcactaatgctctgttgatctttttcctgtttttttttttgttttttttttatctccatgattcattttgagtagtttctgttgccatactttcaagttcatcgacttttcttctacagtgtctaatgtgctgttaattttatccagtgtatttttcatctcaggcattacatattctatttgttaaatccaatttgtgccttttatttttctccctatcatgcatgttttgctctatcttctttacatatggtatatgtttataatatttataatatctattttaatgtcctgttttcctaattaccatctaccatctgcattatttctgggtgtgtttctattgattgattgaggattgattgaggatattgacatatcctcattatggattgtattttcttacttctttatgtgcctgataatttttgattagatgccagacattatgcttttacatggttgggtgcttgattcattgttagtcctttaaagactttctccctccttgggacacagctgaattactttgaatattttgatgtttcaagacttgctttggagctttgttatgcagatctctttagtctgttgctaatttggcctatttctaaggattgctgcacctgctcctttcagatggtcctttccctggattcagggggtttagttatgtatgtctagttatgcctgttatccaatgtctgaaaacttgttgcatatattttgtttgtttttagttgtttaacatgacaggtaaattcagcccttattaatccaccacagccagcatttgcactcttaattatcatgctatatttccttctgaatgtatgttttttatctttacacttgggtctacaaaattgggtcttgttcagatgtaaggattggatatgttaaatacagggctataaactccagaatcatgacacttaagggctctgggccatgcaattttatttctaaatcatctttggaaagttttttgtggtaattttttaggattttaaattatatatgcaattaaaattataattctctgtcagctcctcagggataaaaaaaatgaggtgttaatgtgaaacataaggtctcattttcctagtggtagggatagttgtgcacaaacagaagtggatttaaatattctcctgagataaacaaataggtattgcaaacaaaataattaaagtggtttgcaacaggcaagcaaatgaggactgtgaaggatcagctgttattatatttatttttctgtttgaatatctgcctggggagtaaactgtgaattaaagggctcagccagcttttaataatttaacaacagaatgaaaagaattggctttgtgttatggagatagctactcaggtcatagtttaaaatattaaaaattttgaggttcactttttgtgtatgtgtgtgtaattctaaataactcattttctcccctctccctttttctttctctcttccttcttctctcccttgctcctttgctctttcctccttcccttcccttcttccttcatgagtacttaccaggcctggtgctcagagctaggaagatagcacaacaggagacatttacctcaccgtggaagagctggttctggttctaactccagcatagayagagcaatggattatcacttacaatttccttttggttttggaggcacagtgagaatttacagtagtcctgaactaaatgaaaattgtgggtatatacagtgaatgaccaaaagatccttatgaattttagatctgagttaatggagtttctttatgcatttcttaaaacccattttctttttttaaattgacacaataattgtacatatttatgggtggtacaatgtggtattttcatgcacatatacgttgtataatgatcaaatcagggtaatgagcatatccatcatgtcatacatttgtaatttccttgtggtgagaacattcagaaacctctcttctagctattatgaaatatacagtatattattgttaactatagtttgcccgatggtcaatagattaccagaatttatttctcctaacatcagtaatcatcagagaattgcaaatcaaaaccacaatggctcactagatagaaggaataagttctagtgtcctgcagcgctgtaggatgactatagctaacaataatatactatatcatttcagatagctaataggaagatattgaacattcccaagacaaataaatgataaactttgaggtgatggctatgctaatcaccctgatctgatcactatgcattgtatgaattgaagcatcattatatacccccgaatatgtgcattatgtgtcaatttaaaaaagagaacacaatgagatgacacctcactcattatcaaaatgactattataaaaaatataaaagataaaaagtattgatgaggatgcggagaaaagggaatcttaacacactgttggtgagaatgtaaattagtacaatcattatggaaaacagtatagaggtttctcaaaaaattaaaatataactaccctatgaaccagcaatcccacttctgggtatctatccaaaagaaaggaaatcaacatctccaaagtacctgaactctcatgtttattgcagcactattgacaatagccaagctatggaaacaacctaagtgtccatcaacagatgaatggataaagaaaatgtagtataaaaccaaaagagaatactattcagccataagaaagagtgaaattctgtcatttgagacaatatttatgaacctgggagacattatgttaagtaaaattagccaggcacagaaagaccattactgcataatctcactcaagtggaatctaaaaaatattgatctcgtagaagtagagagtagaacagtggttaccagaatcttgggaggagaggggtaaggggagattggagagaagttggtgaatgttacaaaattgaaactccttttctgggcctatttccacattgctctgttgggtgcaggggattgcagaaaggggcatgtctctgcctgtgactgctgaaacccgttacctggataacttcccactcagcctctgccttgattgttgaactgcaaacactctagatttgccgtccctccaaatgccaggcaaagctgttttaacttgtcccaacagttattccagtgcttttaaaatccaagtagacctgcagaagtttacatttcagatgcaacttagagcatatttcaggaatatcacatctgaaaaagtcagagtaaggttagcaattgataaaccacttttgggaattgctttgacctaccctgaatgttctgagtccattggaattaaaggaaattgaatgagcagggatgggtgaaatggagttttgagaatttagaatttgctaggtagaattttctatggcagaagcaggaagctcagagaagatgaaggaaaaagagggaaaagaaaaagagagagggaggaagagtgagagacaaaggaaatagtaaaaacaaaaggaaagcagaaagtaaaagtaggtgacaagaaaaaagggatgaggagagaactgaggagaagatggataaatctcacagacagcccacctaaacacgtccatcacctataaataaccaaccagccagaggagctcgagtcactgtcctcagtgtaggtccctagtctcattggcagggagatgtccaccttgtgcttatggttaaatatgattgaacaaaatagagtaaaatgtgaagaaatacaagttgattgataaaatggggtaagcttctcaaaatgtaaagttcttaggactttggacttctctggctggtataccaggttctccttgtaaaccagtagatctgggaagggtttgccagaactgagcagagagcctgttcctccacgtgctagtctttagggagaggagactgctgcagattgctgtctgtgctgactgggcccacgcttgggaatgggctgtgatggaggaggtggatgagaggcagctctgctagctgaatgctgggcagccagagtatgagggcaggcagagtgctggctctacagtgagcagaagctattgcgtcatttatacaaacaaaggaagctgaactacttttcaaacaatggctcatttatttcataacagaattgttgagtcctgttttgatgtcctggcaaggggtcaagggtacctaagatttcctggaggtgaggaacagtaaagagctaattgaaaattgggatggtctgctatgggcttccttaagggtgtagaagaggctgtaggaggaatgggatgatgggaagggcagaaaaagggctgctctggcttgcatggaggccaggtagaggcaggtctttgatgggcatcaaaggttgtagaaagacgtttagtttttaagttagatggataaggaggactcactgcaaaacttcgggctagacacattgtatcctattgaattaaagccactgaactttgtcaaaaccctaggaagtactattattccatttataaatgatgctcaaagaaattaagtgccttgtccaagttacaccatcaggaagagaagaaggcggggttggaagtcaaatccatctgatttcagaccctacgctcatcacttctctgcataatatcttagaccagggcttctcaaacattaatgtgcccataagtcacctggggatcttgttaaaatgcagattctgatgagataggtttagggtggggcctgagactttgcatttctgacaagctctgagatgatgctgatactgttggcccatggatctcactttaggaaacaaaagaaccctctttggcaagttgctgtggcctgtgcaaaccagggagactcatgcataccccataagtttttagggggcagctaatgagatgatgtgcctctggtcaggatgactactcagaagatgccccttcttccactgtcctctgtcctggagatgtaatcagtgccaagctttgtctcccaccctctcttcctactcaggatgtcctgatctccatggagccttggtctgccttgccctaggtggtctatagggacctgaatgcaacacacattctgaaaaccctgttgacttcagtgggagttattctgtcatcacgtctttattgaattcttttattttctcaacttttcttaagctggccttgcctgaagtttctctactgtcatcaacttagattactgacaccatggtttggaagaggaaaataaactttattatttctccagaaatggagtaatgctggtatcacacagatgtttgatagatctaggtcttcctaaggaataaaaggaaatgactaataatgtgattgcatagccctgtataagtttagagatttatataaatgtttaataatatttttctctgatatcggaactttccaaaattttactgaagttttgcagatcagacaaaaacttatctgtgcatgagttttgcacctggtttgccaaaatatatattttgaaaaaaagagatccttactattttatttgtggctttgaaaatttcccttcattataaaaatttatcctctttgtccctcaacctggcttgaagtgagacctttgcagttactctttctctgttttcaatgaaatatttctaagaagcttaaaagatacagagagtaatataacaaacacccacatgtccatcattgaaattttgccatatttgagatctcgtatttggagaaattggctgttttggatacagtgaaaatctgccctgtaccccatttcaagtcccatgagagtgtgaatcagtaaggttgttttgactacagtaacagaaaaatatgagtcaaatttccttgaatggtctaaaaatttattacttcactttacaaatggttcagagacaattcataagatttcaaggtagggcaattcagaggctaagtggcatcttcgggttccctgatctttgcagtgtgatggactggccctcaagtggactctgctcaggactcaaacatccagaggcagaaaggtgctgtctcttctaggtcttcttcttaggattcagaaaaccatctaaaaaatccagcatggagaacccccttatgtctcaacaaccagaagtggggccatggctgtctcttaaaactgggacaacccaggtggtctgggaccaggcaggacacagctctgggtctgggaccaggcaggacacagctctggttctgggtatcctggaggggagagccccctggggttgccctagcatggaggaagtgggcaagagtctcaggcaggcaccagatctgctggttagcttcctcttttcccccagggacagctactgtcctgaagctgggtgtgtcctcatctaagtttttattatattatactatacatgtatctttactataaatgtatttatttatcactctgtaacttattcctcttttcctttcttttctgctttccttaactctgtcatccacatctgtgcaggtgacgaagtaacactgcagatgtattcagtcatctttctagctgcatggtagtccatcatattaattcaattacttcttctattatttctttttctgttattacatcagaggcctgaatggatgtgaggaagaaatagctgaatctgacagttagtgaaactcttgtgtctccaaattatcccattggtattatcatcatttttattgttctcataattagcaaaaaggagcactttagaaaccattactagcctccatatcagtaattcatcacatttttgttttgattaaaggcttctttgaaaatccaatatagtctatgggctttctccacaggaaaatgcacatacacactttacactttttggaatggcaagtcctcctgaagccagccatataccctggctgaatatacatgttcctctgaacaggggaaatcacatcttatccccttccttagtgcacactataaaaaggacagttttgcttcgaatcagtgaattaagcatgtaccttttgggaggatgtgaggattggcttttcttcagaattctaacttttctttggtcttaacactttgcaagtgaagtagagatttgcagaggtttcttaatttatttgattcaaaatgcagattttctaagattcagtgcattctcagtagagaattagagacagcgattctttttattatgtagtgcatgaagcaatttctcatattttagtgtattcacagaaatcttttattaagtatggtataaggcaataaaagagtctttttttttactttctgatgactggtaaaaaggatatgatgttaacttgaaactccatccctcatttcttctctacttgtttttgttgttacaatattctggtttttaaattgcaaatacttctcccattgaaaatggaggtagatccatcagtattttgccatcagtcaattccaatttcatcaacagttaatgccccaaattctaaattttacctagttctaaagatgaccatttgcagccaccttagcttaagttaccatcatctctcacagggctgatctctttaatgagcagtactgatgaaataggatttatgggtggaacctattagattgtaggagaggaagtaacagaaatttagggatatatttctgaagcaacaaacaaaataaggtggaagctgcagaatgtttacattctttcagtcacgataatgagatgattcaagaatacaattcagatttggccaaatggaggagagtgcacatgcttctcttgggcccctcagaaatagccctctttctaatattaatgacaagaaacttaagaagagacagccaaatgaaacaaatataaattatagcataataactgaggtttagtcagtcacaaagtcaaaacatatagggagctatttgggaggcaggtgtgtgtcccagaaaaagaccagggtcatgagctaaagaatttaaattccatacaaaaggtttagtagtatgtcttcatggaagaataattagcctgaatgacactcacaaaaggaaaaatgaccaaaaaagccagatataatacatttaaaaatacttaaaaatagagtccatcaagagtaacatctatgaaggccaaatgtaaagtggtaataggaactcccagcaatatgtgagcttcagatttaatttttgccttgcatgtatttgcccaactgtgaaaaccctgagattttttcttatgattgtgcaaggaataggacgtatgagataaagtctaagaactaaacaaatgtggagcctgatgagagatttctacataaagctggaaacttctatcttcagtgtaaggattatgagaaatgaacacactatgcagaaggagatggcaaggaaaatgttcagtcttgactggagttgcatggagcggggagttttcttcagaactgataactcccatgcaggtttgtgatcccagtttccactatttacggtgtctttaaaaagctgaaaggaaaacttaaatttgtagtggttatagatttgtagtggttatagataactagtgctcctagttaggtatttgaagtcagcataaatagtttttgaagtaatgtgaatcaaaggcttcataaggcagttttaaggaaaatgagattacgtacatgacggaaaaaaacaaggaagaaagagaagatgggagagagggagggaagaggagagagagagagagagacagagagagagagagagagasacagagagagagagagagacagagagagaaggacaaaggaaaacgaaggaaagaaaaaagtcaccatgagtgagaaccaagaaacaataaagtgcagtttaatcagatctgaaatgactttacgtatttagaagtatctgacgtagaatattaaataagtgtgcttaaatatgtttcaaaaatagatactggaaaatatgagcaaggaataaaaggcatttaaaaagcaaaatagaaaaggaaatgaacagaacatcagaaaattaagaatctaacagttgaagttaaaaatcttagaggttgaacaccaaagtggatacatacgcagaaagaattagtgaactggaaaatatgaagaaattgtttagaatgaggcctagagaaacaaagagatggaaaatatgaagaagttaacatacrtggaaggtagaatgaaaacgtcctacatatttttattggacttctaaaacgaaatatgacataatggagaagaaaaaataataaacaatgttaaggcttctaatttctagaattattgaaagaaatcaaactccatactcaggaatcccaagaatcagaaacagagtaaaaattaaaagtccatatctgggtatagcataacatgctactgtagaacaccaaagacaagcaaaaacctaaaaaagcatccaaacagaaaaggcatatcatctacaagggaatgacagttaaaatgattttttaaaaaaatattattattattacactttaagttttagggtacatgtgcacaatgtgcacgtttgttacatatgtatacatgtgccatgttggtgtgctgcacccattaacttgtcatttaacattaggtgtgtctcctaatgctatcccttccccctcccccaaccccacaacagttccgggagtgtgatgttccccttcctgtgtccatgtgttctcattgttcaattcccatctatgagtgagaacatgcggtgtttggttttttgtccttgcgatagtttgctgagaatgatggtttccagtttcatccatgtccctacaaaggacatgaactcatcatttttatggctgcatagtattccatggtgtatatgtgccacattttcttaatccagtctatcattgttggacatttgggttggttccaagtctttgctattgtgaatagtgccaaaataaacatacgtgtgcatgtgtctttatagcagcatgatttataatcctttgggtatatatccagtaatgggatggctgggtcaaatggtatttctagatctagatccctgaggaatcgccacactgacttccacaatggttgaactagtttacagtcccaccaatggtgtaaaagtgttcctatttctccacatcctctccagcacctgtggttccctgactttttaatgatcaccattctaactggtgtgagatggtatctcattgtggttttgatttgcatttctctgatggccagtgatgatgagcatttttccatggttttttggctgcataaatgtcttcttttgagaagtgtctgttcatatccttwgcccactttttgatggggttgtttgtttttttcttgtaaatttgttkgagttcttgtagattctggatagtagccctttgtcagatgagtagattgcaaaaattttctcccattctgtaggttgcctgttcactctgatggtagtttgttttgctgtgcagaagctctttagtttaattagatcccatttgtcaattttggcttttgttgccattgcttttggtgttttagacatgaagcmcttgcccatgcctatgtcctgaatggtattgcctaggttttcttctagggtttttatggttttaggtctaacatttaagtctttaatccatcttgaattaatttttgtataaggtgtaaggaagggatctagtttcagctttctacatatggctagccagttttcccagcaccatttattaaatagggaatcctttccccattgcttgtttttgtcaggtttgtcaaagatcagctggttgtagatatgtggcattatttctgagggctctgttctgttccattgatcgctatctctgttttggtaccagtaccatgctgttttggtgactgtagccttgtagtatagttcgacgtcaggtagtgtgatgcctctggctttgttcttttggcttaggcttgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttcctagccatgagcatggaatgttcttccatttctttgtatcctcttttatttcattgagcagtggtttgtagttctccttgaagaggtccctcacgtcccttgtaagttggattcctaggtattttattctctttgaagcagttctgaataggagttcactcatgatttggctctctgtttgtctgttattggtgtataagaatgcttgtgatttttgtacattgattttgtatcctgagactttgctgaagttgcttatcagcttaaggagattttgggcttagacagtggkgttttctagatatacaatcatgttatctgcaaacagggacaatttgacttactcttttcctaattgaataccctttatttccttctcctgcctaattgccctggccagaacttccaacactatgttgaataggagtggtgagagggggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatattctggattacatttattgatttgcatatgttgaaccagccttgcatcccagggatgaagcccactggatcatggtggacaagctttttgatgtgctgctggattcagtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctgttgattggaatagtttcagaaggaatggtaccagctcctccttgtacctgtggtggaattcggctgtgaatccatctggtcccggactttttttggttggtaagctattgattattgccacaatttcagagcctgttattggtctattcagagattcaacttcttcctggtttagtcttggaagggtgtatgtgttgaggaaattatccatttcttctagattttctagtttatttgcatagaggtgtttatagtattctctgatggtaatttgtatttctgtgggatcggtggtgatataccctttatcattttttattgcgtctatttgattcttctctcttttcttctttattagtcttgctagyggtctatcaattttgttgatcctttcaaaaaaccagctcctggattcattaattttttgaagggttttttgtgtctctatttccttcagttctgctctgatattagttatttcttgccttctgctagcttttgaatgtatttgctcttggttttctagttcttttaattgtgatgttagggtgtcaattttggatctttcctgctttctcttgtgggcatttagtgctataaatttccctctacacactgctttgaatgtgtcccagagattctcgtatgttktgtctttgttctcgttggtttcaaagaacatctttatttctgccttcctttcattatgtccccagtagtcattcaggagcaggttgttcagtttccatgtagttcagtggttttgagtgagtttcttaatcctgagttctagtttgattacactgtggtctgagagacagtttgttacaatttctgttcttttacatttgttgaggagtgctttacttccaactatgtggtcagttttggaataggtgtggtgtggtgctgaaaagaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattattgtgtgggagtctaagcctctttgtaggtcactcaggacttgctttatgaatctggatgctcctgtattgggtgcatatatatttaggatagttagctcttcttgttgaattgatccctttaccatcatgtaatggccttctttgtctcttttgatctttgttggtttaaagtctgttttatcagagactaggattgcaacccctgcctttttttgttttccatttgcttggtagatcttcctccatccctttattttgagcctatttgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttattcctagccttgatggtctttacattttggcatgattttgcagtggctggtaccggttgttcctttccatgttcagtgcttccttcaggagctcttttagggcaggcctggtggtgacaaaatctctcagcatttgcttgtctgtaaagtattttatttctccttcacttatgaatcttagtttggctggatatgaaattctggattgaaaattcttttctttaagaatgttgaatattggcccccactctcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataataccctgcagggtgttttccaacttggttccattctccccgtcactttcaggtacaccaatcagacgtagatttggtcttttcacatagtcccatatttcttggaggttttgttcctttctttttattcgtttttctctaaactcctcttctcgcttcatttcattcatttcgtcttccatcactgataccctttcttccagtcgattgcatcggctcctgaggcttctgcattcttcacgtagttctcaagccttggctttcagctccatcagctcctttaaggacttctgtgcattggttattctagttatccatttgtctaattttttttgaagtttctaacttctttgccattggtttgaatttcctcctatagctcggagtattttcatcgtctgaarccttcttctctcaactcgtcaaggtcattctccgttcagctttgttccgttgctggtgaggagctgcgttcctttggaggaggagaggtgctctgctttttagagtttccagtttttctgctcygttttttycccatctttgtggttttatctacttttggtctttgatgatggtgacgtacagatgggtttttggtgtggatgtccttttctttttgttagttttccttctaacagacaggacactcagctggaggtctgttggagtttgctagaggtccactccagaccctgtttgcctgggtgtcagcagcggtggctgcagaacagcggtggctgtagaacagtggattttggtgacccgcaaatgctgctgcctgattgttcctctggaagttttgtctcagaggagtacccagccctgtgaggtgtcagtctgcccctactggggggtgcctcccagttaggctgctcgggggtcagggacccacttgaggaggcagtctgcccgttctcagatctccagctgtgtgctgggagaaccactgctctcttcaaagctgtcaracagggacatttaagtctgcagaggttactgctgtgtttttgtttgtctgtgccctgcccccagaggtggagcctacagaggcaggcaggcctccctgagctgtggtgggctccacccagttggagcttccctgctgctttgtttacctaagcaagcctgggcaatggcaggcgcccctcccccagccttactgccgccttgcagtttgatctcagactgctgtgctagcaatcagcgagactccgtgggcrtaggaccctccgagccaggtgcaggatataatctcctggtgtgcaattttttaagcccattggaaaagcgcagtattggggtgggtgtgacccgattttccaggtgccatctgtcacccctttctttgactaggaaagggaactccctgaccccttgcacttccgagtgaggcaatgcctcgccctccttcggctggcacacggtgcgctgcatccactgtcctgcacccactgtctggcactccctagtgagatgaacccggtaccccagatggaaatgcagaaatcacctgtcttctgtgtcactcacgctgggagctgtagaccggagctgttcctattcagccatcttggctccaccccaaaatgattcttaatatctggatgcagtgggctgaataatggactccaaagatatccaaggcctaatcctagaacctgttagtattaccttatatggcaaaggacattttgcagatatgatgaagttaatgatcttgagatggggcgattatcttgggttatctggataggtgttaaatgcaatcccagcatctttataagaggaacacaaagggaggtttgactgtatgaaagaagaagaggtgatgcaaccacagaggcagagcttggaatgatgcagctacaagccagggaatgctgacggccaccagaagctggaagaagtgagaaacatgtctcccccagggtctccaaaggagggcatcctggccaccaccgagatttcagcccagtgaaatggattttggtcttatggtctccagaaatatgatagaataaaactctgttattctgaagcactaagtttatgataatttgttaatgcagctgtgggaaacttacacactggacagcagtggaagctagaagtcagtgccatattactttccatgtctaagagaaaatagtagtcgacttagaattatatctttcaagagtgagataaaaataaaggcatttcccagcaaacaaaaactgagtttatcaccaacaaacccaaaktaaaggaaattctcaatcatatacttcaggagaaggaagatgaccccagatataaggtctgaggtctctaaaagaagccttaccaataaactaatgaatattggttacatagawaaatattggctgtatcaaacaatagaaataatgtgtaatgggaaaatacaaagaaagattgaattaaaatactggaggtttttagcgtgttagttgggataatggtgattggaagtaaacattaaagaagagagtaaaaatactgattaacttcacactttattagatatgcatattaaaatatctagcataaccaataaaagataacatagaaaacataactgccaagggtaggtaaataagtaaagataggaaacaaawcattttaaagggaaacaaacaaggaataaagagaaaactccaaaatgtataatataaataatgttatagaaatcaatccaaatatataaataatcataatgaatataaatggattgaaatttctactaaaaattcaaatatggatgtaaaatatctagtatattaggtttacaggcattccaactaaaatgtgagacagagaaagactgatggcaaagagatggaaaacgttagagcaggcagatgctaaccaaataaaactcatgtagctatattaatatcagacacaatagaccataaggcaagatgtgttactagaaataaatagggtatctatatgatggtaacatttaattcagcaagggctgtctttctatactgtgtgtaacgaataaaaaaaccccctggccaggcacsatagctgacacctgtaatcccagcactttgggaggccgaggcgagtggatcacctgaggtcgagttcaagaccagcctgaccaacatggtgaaaccccgtctctactaaaaatacaaacaaaataaaaataaaaatagccaggcgtagtggcatgcgactgtagtcccagctactcaggaggctgagacaggagaattgcttgaacccgggaggtggaggttgcagtgagccgagattgtgccactgcactccagcccaggagacagaacgagactctgtctcaaaataaataaataaatacataaaataaaataacataaccccaaaatatattaaaaatagccaatattcaaagagaaatacacagatttttaatggacctaaaaatgrccattgacaccaacaaatgaacagtgaatgcacatgaaacgttcatgtagtacaaactgaccacacggtaagctacaaagccagcctttccacaaagaaccaaagttagatgggtttgtagcctggttctaacaaacattcctgaacgtggagaagatacccgtagcaggtgacaaaggctttgtatctagaataaaaaaatatattcccacaaattaacatgcaagagaaccaactcagtggaaattggacaaaagcacaaatgcaggaaaggcaatacaaatgattcataagtgtataaaagatattcaaccttattaagaattagggaagtgaaaataaaatttaacaatgctccaatgcrtacttaccagactgtcaaatattaggaagtcatacaatatcaggtgtaggcaaggaggtagagcaacagaaactcccttaccacatatgattataactttgtaaaaccactttataaaaaggaaaaatgaaaaaatagcaaaatatagaatataaataatatgacagaaatcaacccaaatatataaatttattttacactttacatatttgctgttacctagtaaatttgaatatgttcctattttctaatcaaggaactttaattctagatatatatcctaaagaaattcttactcaagcacaccaagacacatgcacaagacaatgtacatggaaactttgtaagggcaaacaaacaaaacagtcaaatggtaatcaacaatagggtgaataaattgtaatatagtcatacaatgtgattgtgcacagctttgaaaatgaataaactagagctgagctgcacctatcagccatgaatcaatcactaatgcttaatgttcaaccagtggttattaaatggtggtgagtattggaattatctggaaagctaatggggtacccagagacgttgcttgttgaagtgggacaggactggagttttgtaattttattaagttcccaagtggtactgatacacaacgaagtttgagaaacagcgtgttagaacacagttgcaagaggcatacacattgtttagcttacccaaagctaaacagaataaatgagactaaactgtatgttatttgggttacgctacactaatcagagcatgatgaaggctgcttctgtgaggaggaaggagtaagcttttgagaaggaggcatccaaccaagatgtgggtaatattttatttcttagcttgatgaaaggcgcactgaaatcattttattattcatatttaatgtatgtaatgtttgtacataagatatatttcacaatataaacttaaaaagtaataaaatacaaaaggcttattttgagcccgtgcactcagtgagcatctgtgtatgatgtgttacttttgtctgtgctgctgacttgctgacttctaatagtgttgtatatacattatcttgcttcttctgctcattggctgcactactggagggaatctttgcccaggacaaagggaaagtttgttttccaagaagccacttggattgccctctgcacacttaagaaggtcccgaggtcggggtgtctcatagtagtacagagactgacctgatgtgtgcagccaggaaatgcagcctggtgtgtgcagcctgacatcagtgagcagggagtggatgcatccctatactcacccctgtggcactacaagagacccaggaggaccaacaggacaagagcagggcctggcatgaaacttctagaactgactgatcacacaggtttgggacttacgcaaggagaaaagtgacctttttaattgaccccaaggaagtggggaagctgcttctgtggcttgttagattctgattgcaaatatctctggattgtacagtaagaataatcccacaagtgcaaggaggtgggtaggagtacattggcagccagcatacatgctctgacccagagcacatggatgaaaactggattaggggaaacaggaagttctgcaaggtacctgcagaccctcactgtgaggaagacatatggcagctaatgggttggaaagggagccttcaagaattcccaggtgggtagaatggaaaagaaacagtgcagactaagggagttgggggcaggggctgagcccacttgatgtggtggctgcccttggcccacttagccactcactccaggtgctgccccaggttgccagggaaagtgatggttgtgtttacagaaacgtactgtgcaactttgtaagtcaactccactacagatttccagggtcctgcttggggtgtagtggggagagctcagtgctgcagattctccctccagaaagttgaggaagcaggagaagtttaatcaaaggacttctaggaaaatggcctgttattcctacagtgccctcagccatcaagagaatatgggaaaaacgaaaggcatgagacacatccaattcctcttggaggtgtactggctctgattctctcttttgtgcataatttaaattagggtcttcatgacctccccaggtcctttatattctgtctttcaggtaaaactaactaacctactcattgctttttcttatattcttactttgtctcagattagaatgtgatttctcttattctgtatcctgtgttcggggcagggccttggtcaccaaggcagctaagagcagagctgagcatgcacatccaggctcagctgtgccctctgctcccctccctgaagcccagctgtgttctaggcccattccatctggtagtcctgagatatggacattgtcaatttccccacctttgactgtctgtcggttccaatctaataaaatcatcttcccttgaacagacttttgtctgaaatacagtttagtagtttaaacccaaatccaatatgtaatagcatttgagttcttttgaaatccctgtaattcagtatatttaggaaatattaattatcctaaaaggatacaatccttaatattttactttctcccagacccagcacccagtttcaactgaccaggcttcacacacatatcagcttcttaagacagtttctgaaatacattgtttaccatcttacccttaaaaatgttatgttcttgtttaaatgattttgaaaccctcatcactaattcccaacctcattagcttcctttttaccatcatattgtctcaaagctagaatgtgtcacatgcaaggagaaagatttaagacttatttcaaaatgtagctatttgtagttaaaattttgtcttgtaatttaccgctgacttagtcccttcttagaaagagtgaaccagagcttttcttaacctggctagccctctcttccatcactgaaattgttggcttatacaggctgacttatcctgacttagaatggtttgacttacaattttttgactttacaatggcatgaaaatgatacacattcagtagaatacccagtttagtacccataaaaccattctgtttttcactgtcagtacagcattcaagaaattctgtgagatattcaacactttattataaaataggctttctgttgggtgagtttgcccaactgtaggctaacgtgagcattctgagcaaggctaagctgcgatgttcgtcggctaggaggattaaatgcattttttatttatgatattttcaacgtatgatgggtttgtcaggatgtaagcccatcttaagttgaggggcgtctgtatgtgttagtttccatttttgttgtagttcccatgttgcacacagctacagagaagggtgctctcttctctgctctctcctcctccagttttgttcctctctaatcctctctccctaccgcagtcagagattttcaaaaatgtaaatctatggcttgtttgagcccagatcctttcaagagctccttgtctcccttaatattagcattttgtggggtgtactgaccctctgttctcccatctggccctgaatggggctctagccctgccactgaccactgttccttctgccccacaagcattccctgcaggggaccagttgctctgtccctccccaggtcatctaaggctttagcatttcacactccctgctgcctctaccctctacctggaacagggagctattggcagctccctccaccttccttccacagcaccaccaactcctcaactgcaactgtgccctgcctaccagcggcactttggctagcaagtttctcctccagaacttgttagccagaaacaaaatctgtattagtcagggttctctagagggataggactaataggatagaagtatatatgaaagggagtttattaaggagtattggctcacacgatcacaaggtgaagttccacaataggctgtctgcaaactgaggagccagtctgagtcccaaaacctcaaaagtagggaagccacagtgcagccttcagcctgtggccgaaggcctgagagcggctggaaaatcgctggtgtaagtacaagagtccaaaagctgaagaacttggagtctgatgttcacaggcaggaagcatccagcacgggagaaagatggaggttggaagactcagcaagtctgctctttccagcttcttctgcctgctttattctacctatgctggcagctgattagatgttgcccactgagattgagggcgggtctgcctctcccagaccactgactcaaatgttaaaatcctttggcaacaccctcacagacacacccaggaacaatactttgcatccttcaatccaatcaagttgatactcaatattaaccatcacaagtccaccccttgtcagattcctcatggaagccctgttctggaaagagctcctgtggtctcctccccctgctatttctatgctccacagtggatcataccaggatgggatgttgtgagcactaaataagctaatgtgagcaaagggctttttgtagtcaatatagacagcacataggtttccttagccctggaacttggcataatccatcctaggatgcccatgagatttatgggacaggatagggcctgattttttyctggctgtatccacagtgcttagtacagaacaaacttcagagatataggtagattttgtggaatgaatagtgaataaatgaatggatatattctcaaaattcgtgtgcaaatattttgtaaaatgaatgtaattctggaagaattcatggaaactcattgtatattgatcaactatggcagagaaacccagctttccttgtcagaatcaggtaggtgactcccaaaaggaaagttagcctttctgtcttgctaatgtctaccatgaccttttatggcattagttcckaaaagcttcacacctgtggaaaccagtgcaccagtggtttagtctcaaacgtctttttctagccttcagggaaaatgttgactaatcttgtttgcctctaagggatagcaagtattatttgtgaataagcaactaatgaactgtgtgacctgggcccaatcccttgccctctttggcatcagcttttcaggctgctggcctagatgcctcctgataggtctcttgcagagatagttcatgagtggatggtaagcatgggcctggttatttttctaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcaggtcagtgctcagcctcttctctccagtcccctccaccaagagtctcacccacacccttggccaagggagacatgtgggggcctcctattgccaccaacttcaattactagagctctgtcatttgttgaaattgaaaccggttgactgggcagtgtctctgaacagcacgagcaggcaattatgcctgttgtcagcagacagggcttattggctcaccgggtgtctctggtatttaaaagtcacatgcatagagggtaaagagattcctgtctcttatgtctctgtgatgacttctttgtgggaatgtgttcatctggcagggctgggggtggagtcttctttgggaagtgatcattttgaacctgttttaggttcttgttaatatagacacgacccttgcaaagcaagatgggactatcccagcacattggctgagtgctgaggcttgggtcacccaggacactgttggatgctcagctgagcagggaggggcaggacagcaggaccataacatggaaccccacccgcatggttccttccaaggcccagaggtaccaagtgtttctggtcagtccttcaaccctaagtatgtgcagtcggcactagcttgtcttgggccttggaatacgatggagagctatgtgcctagtgtaagaggtggtttctctctgggtgtttgggagcaacagggaagtagtgtggagagtacccactggcagcctcaaatccacttctaggttaggaatgtggtgcctcagaaaactttcactgatgcttagtgagagcaccaggacagaaggaaatttcttccacttgggtttgtggaaattgcacagaagtttgtacatgtgatatgcttgccattcagcatttgaaactagttccaccatctttacccagccaggcatgagggttagaaattggggttgcagaacagagacggctgtatctgccacctgagtatcagccccaccccataacattttgctctcactgtatcaggggctgcacattttgtggaagggaatttgtggaatcttgagtagggtgtggacatgtgtcaaatttgccaaaggaatgaatctactctataatctcatatgtggagagaaaaaggaaacatgcctcaacggatggtaaacatgagaaatgttttcttggttgaggtggaaacacagcagacattgattttagctggaataatccccattccactagtgtctgtgctccagggagcccaccagagtgtctggggtctttctaaggcggtggaggggtggccaagagagtggacccaaggcccccgcatcactcatggactcaagagccctggacacccgagtcagagtgaaaggcaagagtttacgttgagatgctgctggtttattctgccttcctgtatgtggagtctggaagaaatggcgaaggccaagtaagttcctctcactgtgcctctgtagtcatgattcccagcctccatgtgggtggaaatggccttaaacaatggggctcagggagtgtgtgcccattcccacccagtgcagcgggagaggggaatccctttgctctctgtggggccagagcctgtgagggtctcactccctgcagggtctttctagcttctctctcctttgaagggcttcctccctccccaaatacatggcacccttgcctcatatgccctaaatcattctctaggtcttagttaaactgcactcagtctccttgaagaacaaagatggggccactttccatggcacagaagtgtctgcaaaggttagagcaggggaaagaagaaagtgcttcttgttgaggcctgtgatgcccccttttgctgtgggtgaaaggcgcaggtgggccctttggttgcatatcagacacattggatgcaaaaagtcttttcactggaggagagagaaagagagactgaggggttcaaaggggaatctagctgagggcctacttaaatgacacgtgcccatggagaggagaaacaaaggcacagctcccagatatgtggccggacatcatcaaatgaggtaaatgcagtgtcagatccaggaaccctgggacactatgcctccctctgttcctgstgagacccaggcattgcataaagagcaamgctgaagtgcaacactacaggaatcttgtagtaatagcagcaacagtaaaagaggaatcaagtcacctgggttcaaatcctgataactctagttactagccaattatttcattattattatttgtttatcattctgcgcctcagttccctcctctctaaattgggggttagaatattatcccccagagtcataattaaaattaaatcggagaacatacggaaagcattcagttcagagctggctattagcagtacagttgagtatctctaatatgaaaatccgaaatctgaagtactctgaaatctgaaatttttgagtgccaaaatgacactaaaaaaagtgcccattggggtatttcagattttgcatttttggattaaggatgctcaactggaattggaatataatgcaaatatttcaaaatctgaaaaaaaaaaatcccaaataaaaacacttcttgtcctaagcatttcagatatgggatacttaacctattatcatcattactgtggaggtggacaggtacattcagggtttccatggaaagggtgaacatagccttttttttttttttttttttggtgtgatttagtctacctatctccaagcatgctttttaaaggcatcactgcaggtgggagggcagtttctatctttccagccccttatcacaggctttgtgtaccacttactgtccacatctctcccatgggtactcaatcatagcttccttgcttgggagatgagaggctttgtattttaggctcatgtagttctttatacaaggccacaagaccctgctcattgaagacccttgataaggaattaaaggatgaatctattaagaatgcaggtctcagtacaagttaaactgaccctagatgcctctctctctctctctctctctctctctcwctmtccatatrtatrtrtatatatatatatatatatatatatatatatatgtatatatgtaaaacactttattaaaggaatctctgtctccatttgttgcatctgcttccttgcaaggcggtatcatgagaggaaaatgtggatttatgtattcatcctgcccaacaactacttgggcagctggtagattcatctcatttacaagccattcccttccagtttcctccatagctattaccacttctttctttcttaatgacagtgtggaaggcaaactaatttctactagcctctagctgtgagatttatcgagaagactctaacatgtttagaacaactcaaggaaaaaaaaaattatgtcatggattattaactttgtcttgatgaaattagtgaagatccttttggaaatggagctctccagtccatctttcttcccccccaccaaatggctgctcttgggaagatcattctgktttagaagtttctgggaggaccaagaagaacagggaatttttgcaagagtatccatcccttrgcttctctattgagctggcctcagaaactctgtcatcctctatgaggcttgtggtcagggctttctgtgctctaaagccaaccaagaactattatagcaaatcagtttggttcctatttagcagaaggaaagtccctgggaagaaaaatacctaaatatgtgacccctagtgctccaaaagctttgcatttgccagcatgcagcactgttgtttatttttccccacaaagcactgtcttatttgtgtgtttttgattcttgtttccttgacaagttagtttaggacttgtctgactcagccagtaataaaagtgataaccagtccctcagaaccctgagactttgctaagatttcacagacatctttgctcagaggagaatctgtaacgtactctgtctctggaactgtactgccctgtgacatcagggctgcaattgaagtaagaggcgtattgtcacatagccatccccccatttatattcaaatgtgtttctaaggggtgacaggcaaatgatgtaaactgtgttgtgtggtcactgtggagccggatccctgaattaagctttgggggctaatgtggtattaccataaaatgctccctcaggttgaaatttctcttctttgtgcattttaaaattgtcgaatggcttgattgaatcattcctcctctgtgctgcacacactctattagaggatttcaacccctctccctctaacatccctattttttagggttttctgtactcttccatggctaaaaggtttttgtcaacctgttggtagaagcttgtcctctggagcttcactgagcctccccataccagctaccttggatttcatgtcactttcaatggtttacttagccctaaaaacccatatgggagcatttaacatggagagtggggaaggctttgtcggagacaattgcgcaagtgttctccttggctgcaactggctgctattctggctgcaggcagccatgtgtgcatttggagcccaggaagccttgggtgtggacagatagccctcttcactttcacaccgtcgcctcagattcagcagtgagtggagctccctgcatccactgtgccctctcttaccatctgcttcctcctgaggcttggctgtggtgccctctcccaggacagctggactggcagcagtttggcagagactacacctggcatggatttctcaagctgtgacatctgggtgtcaacttgtcctccccgctgatccctctgtcagctgcttgtctaactttgccggccaaccacaacctgtctgaggatttggtcagaggtcagttcctrctgtttgcctctgtgatgtctcactgaactgtccactttgcttgattaatgacagagggaagagaaagctgggttcttcagaagcctggaggaaatgcagcctttcttaatgaaaacattttccacacttccagctttggtgttgggaggataatggtctggttctgaccctggcctgtgattcatcttccttctcctccaagaatgatttttaccttgataatgcggatgcacaacaattccctgggccccagagcataacaaatactaggctggaataccctaataaaacgtgactgaagtctcagacttactacagagaaggcatgtgctgctgccaggaaggcagatagcctggccacccggcaggcacaccctcctgtcctccaggggcctctcccccactgataggggcagaggtcttagctggatcgacctggcagcctgcagcactcctgaggagctcaacacacttcatggggggtttatatgcttattatctctggtcctgatcctgctcccagggactcaataactgaccagaacacctgggcttccaatgtgcctgcctctaccctgcccagtgcttgcccaggtggaaagtcagtgccttcctggtttcaacaagacaacaaattcccttctgcacaagacatccactatggtctggatgtttgtatccctccaaaatttccatgtcgaaacctaatccccaaggtgacagtattaggaggtgggacctttgggaggtgatgagggggggagccctcataaatgggattcgtgcccatataaggagctgaagagaccagacttctcctcttccactctgccagggcaagatgagaaagcaccacttaygagccaaaaagcacgtcctcaccagacacagaatctgtaggcaccttgatcttgtacttgccaggcttcagaacggtgagaagttaaatttttgttgcttataagccacccagtctrtgtttttttgttacagtgacctgagtggactaaggcagccttcgcgtctcctcaggagcctcagagcccagagccggtgttgtacgcgatggggagttgggtggggcatttgcattgtagctgctcaagcaggattcagcctttgaagcccctccccgctggggaatgtgcagtgtttctgagcactgcttccctgcccccagtgctccattatctcctcatcttgcttgcttccctgccctccctccatttcctccctctgggtcttggttccttattttctcatgaagatcaatttaaagtctcactggtggcctttgctcctgctgccacaaggtattttcctaaataaaatatagtcactgatgtaatagaaattctggtaataactttttaaaaaatctatttttccatccctggtcctcagtcaacttcttgtgactcatctctaattatccagcagccgagagtgtccatctgggtctctcaagagctgcaagcccccaacaagagctcacggctgagttctctcctgcttcccagagacgcctcctacctttcccattatctttctgaggacccacctcctgcatgggcaactgatgttggaaatttataccttgccaggatcctgctatctcagggaaatgcatagcctgggattctggtgggagatggccaattctacatttattcacacagagctcccatctctttccccagcagcctctatccaccaccacttgtcttctaagaagaggcatcttttttgcaaatgccttgacatctctttaactttatgtttctaagaacatgtttaaaactgttattcaactttcagtaattgcataaatacccatttatgcatttgttatgcatttcttcttatgttagacctttcataaatgttccttcctaattcttataaacctctcaaaattaggaattttaatttccatgttgtagcaggtcctgattagggaaactggcatgtgcacaggctcagaggcctgagagagcaggggaagagttcactgtgcctggggcaaggggtgagaggcaagaagttgggaagtaacttggaggggacaacagcaactggggctctgcccttggtgatgtgatgtggaagacgtgtatctgagaaaggcaactctgtgcagtgtggaaagggaggatctgaggctggagacaggttaaccagtggttaccatctccctaggtaaaaataagggcacctgaactccacccccaaaatgggaggtgaccattgagtcctcactcaattgagtcctcatctggaagcttctccaggactgaaacccctgagctggtcagagggtggagtgcagagcacatgccttccatggatgctggactgcagctggcctttgttccagccataccctgcctgccttccccacctcccctgcacacctcgctgatctcattgcagaatccactgtgccaaaggctcccgtggctgagccagccttgctatgtgaatgtctggcctttgactgcagcaggccacactgtctccctctcaggaaccagagtcagggtattataaagcttccccctccaccctccaccacacaacacacactctctgagccttcctgtgtttgtaccttttatgaaacatcctaggggcagagaagtggcctttcccttaaagggcagccctgcaacacctcagatcatgtagccctgaaaggtgtggctcagaccctgggggctgtggcagctgtggctgtgctgctggggcctggaggaggccagggacatgtacacgggtgctcaggtgagcagatttcaggtgggactgggaattaatattcagtgctgattcttgcttgatctctgaccctcaagctataggagtcagacatgatccctttgtgcctttggaaggctttagggacccaaggggctttgtgggagagaacgagtggtgttggaggatacaaatgcattttcacagtagtcctcatgttctgcatccagactggtgctgaccccagcttctggggacatccctggaggagctctcagctcatacatattgaaatctggaagctgcatagatattttatttgcctcttctattcatttctgtctctgctccctctaaagatgaagatgcatgcaaagatcttagaatagtacttggcacacaggggtattaccatctgcattccacaggtgggtaaatcagggctgccacattgtacctctccaggggcccagatcacactgtattttattgttatcaagataagtctcagagtgttcaacagcttgttcaacatcactcagcaaatggatgctagtggagatctacttcactcgttccatcaacatttatygagtgcttgctgtatccacgcactactgtggagacctggggtccagcagtgagcaaagctggtccaggctggaatgaatccaaagctgttgctgttcctattagaccacttgcctaagctgcaaccctagtgtgagagtcgtactgtatggtaattagtgagagaaacttgccgaaaatctctggagtggctaaatgaaaccatccagtccctcttccagctctctcctcacttacaatagagcccatgagctsccaggaaggcctcaagcccttttcctggcttctgtctggccttgacttcactccctctagcatctctgacctggctccaggtattttgctttgcagccaggtctctcctctgccatgcccatggccttgacactctgacctctcttttgcttctcaaatttactcttacctggaatgcttttttggttcctggaattttatgctgcagtgttcctaggtcacccagagccctgggctcctgcttgcatggggatgagtgtttaaatagtgacagcatctgcttgcttgccttacctttgctaatggactctgtactgtgcataacctacaatatgagggarggaggcaaggacttctccaagccgggcctcattctctgcacctgtggcctgtgactccagcctgggctgttggcccctggtggtcaatgacgagtgagcatccatgcatctgggagcctctctccttccagacttccttctcaggggcttggcatgaccaaccctgacactgatatccagccatcttccctgaggaaaggcttcttttatgtttatcaggctctggagagggccccaagcataaactgcctttctaccatctacttgtgatttttttcatccaagaatcccttctctgaataggttgtgaggttagggcctttcctaccctccgcatccccaccagtgaactgtcagctaaagtcagtttgcacaaagtaggtcgtctcagtgaggatgctgaggttggagagaagatgggggagccacagattattactgcagtgttagattatgcccaaggcagggagagacaatatcttaccagggaagagttaggagtaagtggagtagatggaaacagctccatgggaagatcaagaagatgttttgaggaggttttagacaagaacaaattgctgtttgaacaaaggaggctctgtccaaagtcaaagttggagggataaaatctcttttatctgctatccattttctataatttctcttttttgtaaaacatggttagtgtatgccttctgagaaaatccatccatccatcaatcactccatgcatccatccatccatccatccgtccatccatccatccatccatccatcacttcatcactccatccacccatccatccatccatccatccctccatccattacttcatccatccatccatttacctatacatctacacactcatctatccttccatttgtgcatacatgtgtctaccatgtgttcggccatgaaacatacattaagcaccagctatgtgctttgattggtgctgagttctagagatagtacttaaagagctcaaagtttgctgagataaacacattcatgagctggcaacatatataatggaagaggggtacatctagggtgatatgtgggcattgggaaggcctgcctatctatgcctggaaaagagcattgctcaagcctgttcccatgaactgggatgtattcacccttccaagcagacatacttgtgggaagactgagggcttcctttggcctttctgagtcatgtcctgctttttcctctttgttcaagacctctctgcattcatacatttgttgagtaccttaattgattgtgaatagaagtgctgaagtgaaagggagattccactgggttctggtcagagccacagatgcgctggtgctgtggactctgccctgatgtgtgagtgtgtggatgggtgggagtaggggtcaaagagacctggctggttaaatagcatcagctatcagttggtggctggtagacccatgaatgtcttgagaagagaaatcttcccatcgttaaggattctcagcttcaagttattctcttgggaaaagaaagaaaaaaacaacaaaccaattctaaatggcttgtattccttataacaacatctccatcatgggtttgttttccagaggggaggaagacttatcaacacatgcagtggtgggggctcctgagggctggggagttgacagcaacaaagagtgaattagtcctgctcattgaggaaatgctcctctaggcctcaagtggctgagggcacagttctgtcatggtgttccctgtgcagtgagggggtgagctcccagtgggtggtggtacttagttttccctctgctgtcaagtaagctcttgtgtgctgcaggcccctgaagaaggtcagaccaggcactgaccttctactccccctcagctcaaggctcttgctttagcacactcttgacacctctgcaacatctggccatcctccacctacctgttacacctacagaatgcagaggccctaggcatacagcccacaatggtcagagctgggggacaggacagtggcagacaggacagagctcttcagcaatggtctgtgcacaaggatacctacaggggaggcagtcagctctgcctggatgtgacatgctgggaatggcccttgagggctggacaggcatgacggggcagatgtttgtgatgccttgcacctcctattggctcatctcagacttcagcttcagttgctggagagttcgcgccacctaacttctgatctaaggttctgcttttggagcacctggactaagaaacatgaggaagtaaattgcaggcagagaacaaggcacagaggtgttgtggtacagggacatattgaggagagtaggggtgaggctgggggaggaggggttctttttgcagcccaaggagcctatttgatcttcccaggagtcctgtgaggctgacatgatctcctatttttatctggtgattttgtttttctaaaatatttttagcagacgacttgctgcttaggcgttcagagaatggtccccttgacccactttggctgagggttgtttgtgcaacagttatcagtggggggccacaaacctgactgagggtggacgctacctcgccctcaccgccttcccttctcctcctcttctcctttgtgctccaatgtccccatggagggctggggtggtgtgaaggtgacatccgagaacagagctgtccttctcccccattgggctcccgctgggcccctgggagggtgggtgccattttctagctcctccacatccagatcggggtctatagccacactcaggaggctgagcctggcctgcccaccctggaccccacacatgggttgggccccaatgctgtagtgtcgttcttcacacttctaccctagattctcagtcatggccttgccctccagagcactgagacagggatgtgtctcctctaccactgagctcacatcagacaactaagcagaagggtggtcctcagatgggcacagttgcaaatcccaaatgtgttccctgggtggcagtgactccactgcagagcaggcaccagaatcctcatctcttgttaccaccgtcctcactgttacctcgtcactcaggccaccattcaccctaggcgtgtccggcgaccagagtggtctttctgaggcccagatctgatctccagcttcctgtacactgacccaacaaaggcgtccttctccctacagtcacctctgttgctagtcctccttagtaagtccctaagtctttgcagggctcaatccctgcttctctcttgatcctgctccctctgtattgtacccattgacacagtcgtcttgaactgctttcagttcctttaacccaaggatccrccagcggtggccratagagcaaatccagtatattgcctcttttggaaaataatgttttattgcacatggcagcacccatatgtttatatattgtctatggctgctttcaagttataacagtagggttgagcagttgcaaaagagactactaagcccaaaatctttatgagctggtcctttacaaaaaactctggtggactgtgctgtacctggccctgtctcttgacaccttcatgcccttgcaaatgctgtgccctccctttatcctactaatccttcaacgctgagctttctgcttatccttccctccatcctcccttacctgagtaggtaacttacctgtgtgcacatctcaatcagctacagataagggttctccttgttgatgtacacatgcacatcccactctagttcctgaggcagggcaaggtcttattccattcaggactctagaagctggctgggtttttgaaagtacacctaaaagccgaggatcttggcatagatactgggcaccacagcttaatgttggcatcctgcattcctcctcctttctgtgggtttctccaaagctctctagaaatgcacytgtggaaagggtttcactgcctctgtctttgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaaggtacgtgtgagggggcacccccaacctggccaaagacaggccccttcttatacctccactgtgttcccctctagyagctggcctgaagctaggctctgtgtggctgccccagtaggcccctccccattcctctctccttgtcactcttcctgtcccagcatctgcaggccaggtgagctgtggtccatgaatacatactatcattactgtcttcaatttaatataagaacttctgagaggttaagcaacttgcccttggctgcaagtaggtatgaaatggaggcagctgcctatcccgtgtctgcaaggtacccctctatgcagaacaccactccccaagaaacgagtgcacctgtatgtgcgcttgtgatgtatctcatgtgctgaggagggatactgaattagaaagctggatttgaagtgaattgagtaatctatggatgatttgttagagtgaattcacytttagaggcttcaaaagagcatttagggaaatccatagcgttaggaatttagtcacaatgaattgcatgtggtttcagtagcagggaacatgctttagtgtaggtgagaatctactacagcccagggcagagccagggccccttctgggccaggtgtttctgggactctgtagggtcacagggactatgagagataaatcttgatgagaatctcaccctgggcttggagagagaaaggggctcaccacggctccctcagcctcctgctgcctccttctcctatgaagcccactgagccagtagagagaggcatggagaccacagccagtctatgctggatgctgtgctttgtacatattttctcctttagtctttgtgggttctatgatgtggagttaattaacttcaggccaaagctgggagatgggcaatgtgcccaaggtggcacaggtggcaaagccaggatccaagctagggatcttgctgtgccctccaatgcacatgtttkctgccctgcaacttaccatcatgtgtctgatatgtctcctgttgacctttgaattttctcttgggttaggctaaggtgagcccctggaactgattgcaaggggaggactaagcttcaagagggcaggaacaaaagctaccaatgtttaatctcatggctagcatggtgcctggcacatagcagggactctaagcatatagatggtatgaatgacaggtgcaagccttagggatttctcccataagcaaatatcctagaaagtactgatcctgctctgagggcctaggaccactagcccatcttgtcctcattacagcctgtccatggtctcaaaactgattgctccgttcttggtgaccacttccttgctcctcttagcctttgggactccatcctctaccttaaccagattttccaatgggtttttctcctcttctgcagggccacatcactggcctcactggggtgatggagtttcgggaggacagttcgaatccctatgtccagtttgaaatccttggcactacctatagtgagacttttggcaaagacatgcgcaaggtaagcctcaggctccctgtcttccaatcttcctgctatggtgccaccaaagacagcaacagctacagggtccctgagctcccagcaactgttaactagcacagatatcctccctyctagtctctctctgctgatgctaccattggctggtgtttatagggcatgctagggagtaggtgcagagaggtttccaaacagaaattgcctctaatggagtctstttgagtagagcasgggtacctggtaacaactgggtcctactgcttggatcaggggrctgcatggaggctataaaggacaatgtgttttctcagagcagtgaaatcagcccgaccacagggacaagtgtgaattgtggttgaggcaggaggcagaggttacagcctgagtgtcctccagatccaggagtgagacaaggccacaaacagaaaatggagctgcaaggagggtggaaattggaaaatgccagaggccagcggaaagataaatgagagacagaggagttgaacaactcagactgaggtttggcttttttatttggtgctggtgctggtgcaggtggcagcctgggtcttcccagtgatacttttcctcttcttccacctcttatgggtgatagagaacagttttcaggactgtggatagtggagagtggccttttatccagggtggggatccccaaagttaagtggactcrtgacacaaagagtctaacagggctaggacaaagaggccgacatggcaagtaagggcttagaacaattatccaagtgaaggaccttggatgtggtcactgtgagccaatgtggagctgatggtgggtatcctggtgtggtcagtggctggctgtcctgggccagcccaactctactggcttggatgcacttccagaaatagcctgtacaggagaggccagagatgggactactcatggtgtagatgggccacagtggcttggtcttctccggaaataatgaaagcattgactgattggcatgtactcaggcacagcctcatgtattcacagacatgctcacacacacacacgtacacacttcacacacttcgaaggaagatgtctctactaatgatggtgcctggagcatgaaggacagtcctcgcaagtaataagctctcagcaggggctggataagccctcagcaaagagccctctagcctgatgtcaccattggctagaagcagtggagggagaggcaagggctaaatgatgttggggtactgagaatctgggtgggggaattctttggttttgctcctgagggccagggtagaaagatgcatgtgtggactggtggagggtgtgagagctggggaacagggagggagccgtgtagagctcatcagtgacagatggggcagaagacaagctccccagggagagactgggatggcctgggtccatgtgtgatgtgggggatggtgcgggggatttttagcccactctgatggaggagagagtcatggattggtcatataaataattgaagtttcaataatttgttgtgacacaatatctgacatacatggcttgatggcattttggagctcagaggtttgttggtggcatcctagagggagtcggctagcaactattctgtgacttcccatgtagggccagggtgtgacctgcaatgtccaggaagccagggctggcctatgatgtctgttaggaatgcccaaagctgtgagacttggtgaggggatgggcatgagtggtcagcattggtctgggtcatgaccacaagagatatgggcttgcattgggactcccaccaggtaaggagggctctttcaatcactctggtgtgaaaaagcttgccaagtgtagctggctgccaaaataactgttcacatcgaccacggtcctggcgcacttgccttcatccccaagtcttattttgaagttaggtcctgcctgccagctccttccgtctcccacctacttcttttggtgggaatgctggctgtggaggtccctgccttgtctcaagcagctgaccctccagtcctgtgcctggcgccaggctggccacctcaggtgcctgagagagggggaggcactatgtcctccacttcctgtttcaggtgtctggaccttccacgttgccaaggcaatgcgcctcaaaaaccctgaagccagtgggagctggcatctctcaatataagaagctttgagcaggaggcctgaatgtaattgagttggaagggaagctgattttcaagtcggctttattttaaaatgtatctttttgtcattttaaaatctgcccttaataactgcatatcctrgttgttatctgtctgcctagcagcttatcgctgctaaggggaagttatctggaaagcagggagtgggatttactgtagcaaatgtttgtgattcaggcctagggtgcattaaagcaagtccagggagtttcagatgaaccaaggagaagggattaggaccgtatcatgggggtagggcagcatttggaggcagagctgagtggtagtttcgggtgggagacggggctgtgaagggtggggctgggaaatcggggtaacttaaaaataaaggacattcacataagggagaaaaaaattgaggatgggtggcaaatttgagggtagggtcctgagccacaccaaaacagtgccaagatcagtcatctaaggagtgcccaaggtcagagtccaaggagtcgcagctctcttggccatgcaaggtacacagctgctagaggagccgactgggcagactcctagatcctgtgatgctgggcaggggcagcattccctgcaaagattatatatgtcatatatgaacaaaaccagacacagacaaaacagtttctttcagacttaaaccaagaggaatcatttaaattaagtagcaagatattttcttaaataccctggagggaaatctcagggatggtgagtcacccagacattttagattaagtggcatcaagagactgtagattactcagccccttcattggagggaaggagtgggtgatcgcctttcaactgcagggtgctggacaaatactaattcaattatctcatccaggaagtgcgtttttagtgagtgagctttgtatggaaaaatcaaaggtctatatcatcagcttgctgtgtaactacaagcaaaatattaattgtctgttttgtacttggagctgtctggcatgggtctgccaccaggggaaaggtttgctggaaactcttccagctctcacaggcattggcctgacatttgtcttgggggtggggggtggtatatgcttcttttatcctgttggtgtcatgtttttttcagggctcagaactgtaacaggacctccacaaatttctacttggctttgtttctctttgttcagacaggaatctccaaaagaggattccatgaacgtgtccatgtaaatgtccttagctcatgattgagctctgacagatctgtcagggccacctgtagttaagtttccaaaggtggtgtgtgtgggaagctgctgggtgtagggagcgggcaggaactgttaagcatccacagtatccaaaagtgcattgtacgtatgttgtctcattgacctgggcctttgctttgctcctggctctgcctctcctgagtttttgcacaacttcccttttctgaacctttgtttcttcagaggaaagttacaggtaatatgagcctaattgttggatggaggggtcagtcagtgtaatgacactgtgcagcacttggcagtgagagcatgctcatatggcacagggcatcagctttgggcaaatgggactgtgtgttttctctgagcgtatctatctcagactccacaagagcagagaggcacaggaaggcctaaaacacagcctccagcctgacagtgccctagactatagctccaaagccaaggccagagatgggaggctccctcttgcagccttgagctggtgcagctgggatcactcagccctgtgtgccagggcagtgccaaactccccttctatgcctggcagcagatgtccactccatataaagaccaagggctgagagggatctgtggaacttcacctctgataagattttattttcagggctgttttggtgttggtgtaatcattgcaagaagaaaaacatggttgtcttttttttcctccacaagcatgacttgcctggataggagcactagttatagcccagaggaaacatttctccatgacctgattgctgaagctgttcgcctttctccatcctaatggcactggtgtaggcaactcattctcttccactatctccgggtcccttgtgcaggaaaaccctgggagaattgccaactgctcgcaggccctttgaacctcattttccgtgggtggcatccacccgattcagtggctcagtggagggcagcagctgtccttgggcaggagggtgggggaggtagacaggagcatctgggcagcctgtggctttgttttatgccttgcatcctggatgagggagaccctgatgtggtgtgagacaacacagctgttttcttctcctttctagaatcaagttaggaccaagagaggctgaaggagtattttgtccagggggtcaagctttactctggccctacaaagtctggtcaagcaggatcttgctgggacccaaatgtattaaacagtcatagaagcacatgtgctggttgcaataggtrgggaattggggtctgcacagctaagtttaggaaacagaggcccagagactggggagatgcatagcaccagcaagcatgatgctgtgctgggcttggaaggcagatttcctgggagtgaggggkcttggcagaggacccagaacatcatttctgaacttgaggcgatgcagttctgtgactccctgtctcctcttcagctcactttctgctccaaccttccccagccagcattagggcatcacagtcccttcctgttggctgggagcctgctgaattgaaatttccaccactgcccttggctcagcctccctgttccagcgatttcccagggaaatggaagggcctcattctcctttactagtttaagacgcttcttctaacttctctgtcaattttgattcttcataaaagctggctttggatgggaatcaaatgccccccttgatgttgcatccctgggagagccttgtgtctgctgataattcactgagtaataactgctctttgtgcagggattgccacgccataggaccccagtcctccctgagcttgaaagtgcatcattaacatcctcgtgcagatctgctatgcagtgttacaaattgccccaaattctcgggttcagaagttgtaagaggtgaagccaggttgaaaaggctaactcgtaatgaagtagaagctacctttacctggtggctccagcagttggtgctaggagcctgggaagkgggcacagcagtgaggagggggatatgggtggaggtggggctgggaggatctagtctgaggactgtgcagtgtctctattaagctgctcccatagagacttccagctgtgcacagtgagtcgcagaagagaaataaacttgagtctcttcatggattaacattcttccagtgtattttcaaagtaaaatgtcaaccgttctgaacccttgtgcagaactatttttgacagagccgagaactgaaacaaacactgctgcttcatcccagtaaaggaataaggaaaagatgcaatcaagtatttcattttaggtagtgtttttatcaatacatacccattaagggtagaatgttcagraaacacagataaatgaaaagaagaacgtaaaagtcagctacaatctttaaaccaagaattaaatactgttaatgtttctgttgtattttcttgttgtttcttctcccttcatacatagagatcatgatatgtatatttatcaaattgctctttattgtaatacattttatatcctgaccttcctactaaatgttatattgggaatatctcctcatttctttaactatgctttacaactatgattttttcagtggaaatacattactcaacttacaggcagccatcatttatttcatcttcctatctgatgaatatttaggtattttcaccacattattatagaatagtgctgtcataaacatctaaaatacatacaattttaattatatctatatttatttccatactatattttttaagaagtagaattaccagaacaagaataataattcttttaggctcctgatgtacatgatacatattttcaaattgattatagaaaggcctaataactttcacatccatgagtagtatataaagtctatgttatatcacatgctaaaaaatatggttgatatatattaaacatttttgctagtttggcagcaagatgaaaaagtgatatactaaatttgcatttcttgtgagattgtacattttaaagtataattattggtcatttgtatttcacatttttgtaaattatacctcaggttctttgcacattgtaaacttatataacctctctttcagaaaggaattgatagttatttgtgttcaatattttgttccaataaatagtttgcctttgaatttaaaaatattttcacatacagacattaaaaaatatatgtggtcaaataattagattattcatttgcattttcttatatttgtgttttttaggaacttatacccaattcacaaagtagatactgtttactcatactttcttccagttatttttgtggcttgatttttttttttcaacaaaatctaccatctaactgggatggatttgggataaattgtgacatgatggcctagcttttacatttttccactaaatgctttctactaccatttatacagcagaccttcatttccctattgacttgaatatcacattttattataagctatataaatttgcatatctcctcattgatttttagaaattattaatcatttttcttttttctctgagctttaatttaattcacatttgtacattttcagaatgtggtggcttcagataacagaatgtccaccttaagtggattaaacaataaggaagacttactatttcacattaaagaggactgcaactaggaaggcttcagggttggccaattcagacactcctgctgagcccaaaggcccaggtctttttcatatctcaacttggctattctcagggcatagtcttaatttttctcataatttcagaatgactatggcagttcaaactgtcatacccagaaagatagcagtaagtagaagaagagtatcttttctgtgtgtctccattctgtaagtgaagagccctttcctagaaattggtcctggcttactgtgttattttatatcattttgtttttttgttatagcaggtgagggtttcctgctagatgcgtaggtaacattggcagaatttctctctcagatgcttgtgttcagcttgtgttaggcttgtgctcttttcataacatgggaaagaaattgctcattcttttgtacttgcataggcagagctcttgaacgctggaaagaatttgactgtacaattttctgggctagctgctggttttggagatattacttttgtatcttggaaactttatttcctggtttctacatttcatttaatcatttttagcaatctgcttcactgaaaatcttgcagttcactggaattttcaaattcattacttacagctctatatagtacttgtaaacaatttaaaaaatactgagctgttgacatatctccctcttcattcctattattacatatttgtgttgtcttgctttattttttgattagacttgacagcagttttttctattgattttttttcaaagaactaggtctaatttgtttaatcatgttttgtattttttttctgtctgcctgctgcataataattgttttattcttatttatttattacttttcgagacacagtctcactctgttgcccaggctggagtgcagtggcacaatcatggctcactgcaacctctgcctcctgtgttcaagtgattcttgtgccgcaggcccacgagtagctgggactataggcacatgccactatgcctggctgattttagtagagatggagtttcaccatcctggtgacgctgatttcaaactcctagcctcaagtgatctgccccctcagtctcccaaagtactgggattataggtgtgagctactgcacctggccaattttattgctattttaaaaaactttttatatgaggtggtagattttatttttattctttcttgttttggaatgccttgttttattctgaatatagttgtgactgaattcttagtggttttactaatataaactgaagtgtaacccttatacagaaaaatttctaaatcttacrtgaatcacagtgaattttcaaaagtgaacatgtacatacagacaacactcacatcaaagaacatcaccagcaccctcagagctctcccctgtgcacccctttcatcaccacacccaccaaatggaaccagttttgatatctaatgcccttaattaggtttttcctgtttttaacttgatatcagtgatatcaaatgttccatactcttttgtatcgtacttcttttgctcaacattatgttagtaagattcatcattattgttgtatgtagttttagataattcattattgggttttacaaggaaagttttattatcatacaggtatagagaggccaacaaatcaggggacgactgccattgaaaagataggttgttacagttccccagaggggcatgcgaagcacactagacagggccacagggtcagtcaggaggtggaggaaaacctgagcaagcttcatacttatttttcaagacagacttggtgattcttgactctttgtattttcttatacattttaaaattagatttttattttccacaaaaaaatttgggattttgactgagattgccttgactcttgatcaatttgggaagtgttaatgtcttaccaatattgagtaacctaattcatgaatatagtatacccctcaatttatttatggcttcttcaatttctctcagtaaagttttgtagctttcactgtagagatttgaataacttttgtttgatttattcctggatattgatttattattatatgtagtaaatttcaaattgatttttctacttgttactgtgtgtatatagaaatagaattgggtttgcatatcaaacttatttctagtgaactaactgtatttgctagtttagattattttagattttctgtatacacaatcatgtcatctatgactaataaaacttctatatttgcatttctaattgttttttttttatttctttctcctgtcttgttgcattagttagggtctttagttcaagttaaatagatgtaataacagtggacatctttattttgttcttgatatcagaagataatttataataatttattctttaatatgtttactacataattttggttgaygttcttttttcagattaagacaattcccttgaattcctagtctactaatagtgttatcaagaatgagtgttacatttatttaaaggctattttgcatctatcaagataattatataatttttattcttgctctttcctgttaatatgataaattatgttgatgtattccttyttgttggtgctcatttctctttattgcaccaataccataccatgctgttattattattttatagtatattccaatatttgctaagtttgataccatctaatttctcttccttttcagaatattttataattaaatttttattttgagttggtatagatttacatgcagttttaataaatagtatagagagatccagcataccctttatttagtttccccaatgataacatcttgcgatactgttatgcaataacacaataaggatactgacattgatacaagctatggatctcattcagatccacattttcccagtttcatttgtgtgtgtgtgtgtgtgtgtgtgtgtgtgtgtgtgtgtgtgtgtgtatttagttgtattcagtattttcctgtctgagctgatatatcccctaccacatccaacacacagaatagttttgttaccaagaagattccttccccattttctcttttatgaccacatggacctaactcatacctccctgcccttcttgttcctacctcctgataaccataatattttctattctacatttctaaaattttgtcatttaaaaaatattatatatgttgaatcacacagtattataatttttattggctttttctaactctagaaaaaaatggcacaattttctagaggttccatccaagttgttgcatgtgtcaagagtttctctcttttatagttgagtattatttcgaagaatggatgcctcactatttgtttaaccattcacccactgaagaacatctgaattatttgcagttagggcagttatgaataaagccactatgagcatttgtgtacaggttttctgggataaatgcccaagagtgcaattgctgtgtcatatggtaattacatgtgtagtgttaaaaaaaaattacagccaaactgttttccagagtagctgtaccattttatacttcagccatgaaatgcataagaaaatgcctctacatcctcacctgcattttgtgatatcactattttttatttaataattgcatggagatatcttattgtggctttaatttgcacttcactgatggtcagtggtgttgaatkttttttatgtgcatgtttgcctatttgccatctggataccctcttcagtgaaatgtctgtccaagtcttttgcctgtttttctaagacgattgcttatattgtactgttgagttttgagaattctttatatattctagatactagtctcttattggatatatagtttgcaatcattttattgcaatttgtatttggcttttccttttctgttgaggattttttgcaaagctaaagttttacattttaatgaggctaagtgtatcaatttttccttttatatatcatgattttggtgtcaagtctaagaattctttgcctatccctatattccaaagattttttcctatttttttaaagtttgatattttcatattttatatttaagtctataatccattttgaattaattattttagacattgtgaagtttaggttgaagttcatttttttttccctataggtatccaattgcctcatcaccatttgtttaaaagacagtccatcctccattgaattgcttttggacctttgccataaatcattttggcatatttgtgtgggtctatttctgggttctctagtctatcccattgatcaatgtgcctatctttatgaccctgtcttgattaccaaaacgttttacacattgttggattgtatttgctaaggcgttatgggggatattgctattctgagttcatgagaatattgaggtgtaggggttttttttgttttgtttttgtttttgttttttcgctgttgtactatcatatctgctttaggcatcagggtagtattagcctcataaaatatgtaggaacacacttgtttttcatcttttggaagagatttgtagaatttggttttaattgtttaaatgtttgatataatcctctagtaaaatcattatagtctggggatttcttttacaggagctcttaaattacaaattaaatttctctaacggttattgggatattcagattatctattkcatcatggttgacttctggtagtttgtaggaaataattggtcatttcttctaacttgtcaaatttatgagtgtaatgttgtttgtattttcttttattgttcaaatggctatagcatctgtaatagtatctcttgtgttattcctgacatttgtgatttgtcttttctttattattatttttgttagtcttgttagaggtttatcacttttattgattttttaaatttttattttaagttcaggaatacatgtttaggcttgttacatacgtaaatgtgtgtcatgggggtttgttgtacagattatctcatcacccaggtattaagcctagtacccattagatatttttctgctcttctccctcatcccatcctctgctctccaataggcctcagtgtgtgtttccatctatgtgtccatgtgttctcatcatttgactgccacttataagtgagaacatgcagtatttgattttctgtttctattctgctaaggataatggcctccagctccaaccatgtccttgcaagggacatgatcttgttcttttttgtggctgcatagtattctagggtatatatgtaccacattttctttatccagtctagcattgatgggcatttaggttaattccatgtctttgatattgtgaattgtgctgtagtgaacatacacatgcatgtgtttttacaataggacaatttatactcttggggtatatacccagtaatgggattactgggttgaatagtatgtctttctttaagtctttgargaattgctacactgtcttccacaatggttgaactaatttacacccctactaacagtatataagtgttcccttttctccataaccttgccatcatctgttatttttgactttttcataatagccattttgattggtgtgagatggtatctcattgtgcttttaatttgcatttctttaatgatcagtgatgttgagctttttttcatattatttttggctacctgtatgtcttcttttgaaaagcatctgttcatgttctttgcccactttttaatgttttctttttgataaatttgtttaagttccttatagatactaaatattaggcctttgtgagatgcatagtttgcaaaaattttatctcattctgtaggttgtcagtttaccctattggtagtttcttttgctttgcaggagctctttagtttaattagatcccatttgtcaatttttgcttttgttgcaattgcttttggcctctttgtcatgaaatctttgttcatacctatgtcctgaatgatattgcctaggttgtcttagagagtttttgtagtttggggctttacatataaatttttaatccatattgagttaatttttgtgtatggtgaaaggaaggagtccagtttcaatctgcatatggctagccagttattccagcaccatttattgaagagggaattttccctattgcttgtttttgtcaggtttgttgaagatcaggtagttgtatgtgtgtggacttatttgtgggttytcttttctgttcttttggtatagatrtctgtttttgtaccagtaccatgctgatttggttactgtagctgtatagtatggtttgaagtagggtaccctgatacctccagctttgttctttttgcttaggattgccttggctattcaggctattttttggttccatatgaattttaaaatgttttcttctagttctgtgaagaatctcaatagtaggttaataggaataacattgaatctataaattgctttggccagtatggccattttaacaatattgattctttctatccatgagcatgaatgtttttttcatttgttaatgtcatctctgatttctgtgagaagtgttttgtagttctctttgtagagatctttcacttccttggttagctgtattccttggtattttattctttttgtggcaattgtgaatgggagtatgttcttgattgtgctctctgctttacagtggttgatgtatargaatgctagtgatttttgcacattgatttttgtaccctaagactttgctgaagttctttatcagtttaagaaacttttgatcagagtctatgtggttttctaaatataggatcatatcatctgcaaacagggatagtttaacttctcctcctcctatttggatgcactttatttctttctcttgtctgattgccctggccagggattctaatactatgttgaatagaagtggtgagagagcgcatccttgtcttgtgccagttttcaaggggaatgcttccagcctttgcctattcagtatgatgatggctgtgggttttttacatatggctcttattattttgaggttcaaggatattggtctcaacttttcttatttggttgtatctctgccaggttttggtatcaagatgatgctggcctcatagaatgagatagggaggagtcccttctcctcctcaattttttagaacagtttcagtaggaatagtaccagctcttcttagtacctcaggtagaattcagctgtgaatctctctggtcttaggcttttggggtcggtaggctatttattatggcctcaatttcagagctcattattagtctgttcagggtttcagtttcttcgtggtgcagtcttgggagggtgtatgtgacacgaatttatcaatttcttctagattttctagcttatatgcctagaaatattcataatattctctgatggttgtttgtatttctgtggagtcaatggtaatatgctgcttttatttctggttgtgtttatttgaattttctctgttttcttatttgtctaactggcagtctatctattttattttatttttttcacaaaaccagctcctggattcattgatcttttgaatggttttccttcagtttagctttgattttggttatttctttccttctgctagctttgagatctgtttgcttttggttctctagttcttttagttgtgatgttaggttgttaacttgagatctttctaaccttttcatgtgggcatttagtgctataaatttcacgttaacactgccttagttatgtctgagagattctggtacattgtgtctttgttttattagcttcaaataacttcttgatttctgctttaatattattatttaccagaaagtcattcatatgatccatgtaattggaggctttggagtgaatttctttgtcttgatttctaatttaattacactgtggtatgagagactgttataattttggttcttttgcattggctgatgagtgttttactttggattatgtgatcaattgtaaaakatgtgccatgyggcaatgagaagatgtttattctgttgtttttgggtagagaggtctgtagatrtccataagttctatttgatccagtgctgagttcaggtcttgaatatcttaatttcctctctcagtgctctgtctaatattgtcagtggggtgttaaagtctcccactattattgtgtgggagtctgagtctctttgaatgtctctaagaacttgctttatgaatcttggtgatcctgtgttggatggatatatatttaggatagttagatcttctcaccgaattgaacactttaccattatgcaatgtacttctttgtctttttttatctttattgatttaaagtctgttttgtcagagacaaggattacaacctctgcttttttctgtttcccatttgcttggtagatttttttcctttctttattttgagcctatgtgtgtcactgcatgtgagatgggtctcttgaagacagcataacaatggatcttggttctttatccagcttgccacttgtgcttaattgtgggcatttagatcatttatatttaaggttattattgatatgtgtggatttgatcttgtcatcattatgttagctggttattatgcagacttgtttgtgtggttgctttatagtgtcactggtctgtgtacttcagtgtatttttgtagtagctggtaagtatttttttccatatttagtgcttccttcaagagctcttgtaaggaagttctggtggtaacaaattccctcagcattttcttatctgaaaatgctcctttgctaatgaagcttagtttggctggatatgaaattctgggttggaatttctttctttaagaatgttgaatatcagtgctcaatttcttctggcttgtaggatttcagctgagaggtctgtagttagtttgatgagcttcccttgttggtgacctggtctgttcctctagctacctttaacattttttctttcattttaaccttggagaatctgatgattatgtgtattggggatgatcttcttgtgaactatctgactggggttctctacatttcctgaatttgaatgttaacctctctagctaggttggggaagttctcatggatgatatcctggaatatatttaccaagttggttccattctctgcatctctttcaggtacacaagtcagtcataggtttggtctctttacataatcccatatttcttgatggttttgttcatttctttttattcatttttctctgtttttgtctgcctgtcttatttcagaaaggcagtctttagactttgagattctttccaccttttgtcttctgctattaatacttgtgattgcattatgaaattcttgtagtgttttttcagctctataaggtcagttatgttcttctgtaaactggttattttgtctgtcagttcctgcaatatattatcatgatttttaccttccttacgttgggtttcaacctactcctgtagcttcgtgagctttgttcttatccatattctgaattctatttctgtcatttcagtcaccttagcctcagtctggttctgaacccttgctggagagatgatgcggtcatttggaggaaagaagacactctggctttgagttttcagcattcttgtgctgattctttctcatctttgtgggcttatctaacttcaatctttgaggttgctgacctctggatggttttttttttttctccttttgtcctattcgatgactctgaggacttgattgtagtataaggtggattcactaacttgctttatttctgggagattttcaggggccagtgctcagctcccaactcctggactgcatgctctaactctggagaacttgtattgggccccaactttgttctctgactcctagaggtttggagtccactgtgctggggatgccaaggtgcgacagctgcaacagagtgttagcatgggcaggggtgccagcctcactgtgggcattcaccatagtggcagaggcaaggcagctggtagtaggaggaaccctgatggagactatgtgcactgttgtgctggaggtggagttggtttgggacaaggtgctggctggcataggtctgggtgctttctctgtgcccccataagctagtgattgctcaggttgtgggaggatcctttgttctctgtgcagcattagcacaagtatgggacactagtggaggcagggcttcctggctgtgtgccacgaaggctctgtctgcagtgacagtcggtggtgggggtggggagacaaactgcactcccacatgctggcagggcaagtaaagcaaaacccacctgtgcagacacatgctaacaatgtgatgtgtggagttgctgtgggctcaggggaagctgcaatatggggaggtggcatgtgggctggtgtgcagccacaggagccacttcattggagctctccacctgtcgggcttggtcctctggtgcagaagctatggtgtgtgccaccagggcacctgacgctgccttataagcaggcatggtgatgctggggccccaggagaggtaagcaggccaaggagtgctcaggttggaccagtcctgtttgatgtgcaagaccaccctacagagatcaagtctgacagttcccctaaagctaaagtctcttatttaggaggaagttgagcctagggagatagctgtacctggccatgctccactacagctgcacctataccaaagcctctatactctacatcagctggctgctgccccaccacttctctaatcagctatccctgctatctcaagtgtccgtgatggtcaaggggtcctctcctgcctggaatccagaggcctgtggtgagagtgggttgctycttgccagttcaattcatccattcccctagagctgttgtaggtcaaaaatgaatcccagggctcagtagcccttgtggggttaacagttttctccctcttcaatctagcttgtgtgtctttcctccatccactctcggtgccttccctctgaagatctgttaaaagcataccagtcatttccatccctccatgggagctattccacttgtctacatctagttggtcatcttgtcctcccctcctttattgattttttgaagaacaatattttgtttcattttaaaaattatatttctattttcaattttattaatttctgctctcatcttttatttctgcttgctttgaatttattttgcttttttttactccttgaagtagaaccttagattatttgagacatttatgtttttctaatataagcttttagtgctataaattttcctattagaactattttggctgcattttacataatttaatatgttgcatttcatttatattcagttctatatattttctaagaatttcctttgaaatttactatttgatttatggcttaggttaaaactttattgttactttccacatgtttaaggatcatccttttgtttttctcttattgaattctagtctgattccattataatcagataacatactctgtatgatatcagttctttaaaattcattgaagtctctttattgtttaggatatgatctatctttgtgaataatcagtggaacttgaaaagatgtatattctgctgatattgggataaatgttctatatgtgtcaattagatattattggttgattgttgtattagtctgttctcacactgctaataaagacatacccaagactgagtaatttttaaaggaaagaggtttaattgattgactcacagttccacatgactgggtaggcctcacaatcatgatggaaggcaaaggaggagcaatatcacgtcttacctggcggtcagcaagggagattgtgcaggggaagtcccatttataaaatcatcagatctcatgagacttactcactaccatgagaacagtatggggaaattgcccccatcgttcaattatcttcacctggccccacccttggcatgtggggattattacaattcaaggtgagatttgggtggggacacagccaaaccatatcaattgtgttgttcagagtttcaatatccttgttaatctattggttctatcagatgccgagatggggttgttgatgtccccaactataattatggacttgtctatttttcttctcagctttatcagttttttcttcatgcattttgaagatctgttgtttggagcatacacatttaggatcattatgtcttcctgatggatttttccttttaaaattttgtaatgtccctctttatctctgttgattttatttacctgatattaatatagtcactcctactttttaaaaattaatgtytgcatggtatatttttgaattttttgacattaacccaccatgttattgcctttgaagtaactttttttttgcaaacagmatttagttggatttttaaaaaatctattcttcccatttttgccttttaattggcatatttacatccttaagataagtattgttgttttagcatttaagtaagtgctaaatcataattgtttatttcctctgtttttaatttttctgtttctcttagtgtatatctctgtgtagttttcttagtggttgctctgactattacaatacacatatgtgacttatcagtttattggtgttaacattttgccactttgagtgaagtgtagaaatcttacttccatttaggtacctttacctttcatacttttaaatgtcattgtcctgagtatcaaatggtgttatagtttctgtttcaattatcaaataaatttataaaactcagaagaagaaggatagtatatactcatatttctgttgtttttacttcctaaagctccaataatgcttttattttctttttgcttagtaaatgttatttatccagtctcgaaggattggtcttctaggcacatattcttttggtcttccttcatctgagaatgtctttatttcctctttatgtcagaaagacagacagaatttatggttgagagttcttttctttcaggaatttaaatgtgttatgccattttctactgattaccatagtttcatattctcaattcactgtagttttgtattcttctgggtagtttctttctaggtgctttcaagatttcttttaaaaaatttagttttcagaagttttattatgatatgtcttgacatggatttatttgggcttatcttgtttgaattcttcttgaatttccaggtttacatcttccacgaaatttgtcaaactgctaatcattatttatttgaatagtctttcagcctcagtctctttctcttcgctttctggaatttcagtggaattaatgttggcgttggatctcttgttattgtcccatacacccttgaggctctgttcatttctttatcaatctgttttctctctgtttgtcacattgggtacattttattcatctgttctccagtttgctgactgtatcctctattatctaaacactatgattgatttcatccagtgagtgtttcgttttagttattctatatttcaattccataatttccatttagttctattctatatcttcttgtcctttgatgagattttctaccttttgtttcaagagaatttgtaattgcttgttgaagcatttttatgattatttatttaaaattatagtcagataattaaaacatctgatccatcctggtcttagcatcagttgatcattttttcttattcaagttgtggttttcctagttcttgattatatcttgaacattgtgatattgtcttaggaagctgtgtgttctgcttaaatcttttttttttttttttgttgggagttatatcctggttagttttagcacacatgtctggcctacttttatctgctgtgctttcagtgactacttaattttaggagctggtgttattttgtggtactattttggtctacttagtttatctggtgctgttggggcttcctctgatctttctttgtgattcccaagaagtatgacagggattttccaggctgggccgcctggtttctgtagttgaagaatggcctgtgagaatgaggaacacttcccaggcagggcacttgtgacaagactatcctgcctctagggaaaggagggcacttccctggctggggactgcttgtggcaggatcccccttgccaatgccacctgctgacwctgggtggaggagaaaagattccagcctatagggatgaagagtttttatgggctaggtggaatcacccttgctggtcctgcccagctgcctgagtatctctcagtgggggtgtggagtcttggaccctcartgacagagaggattcctgggctgtgtccaataatgatgagatctccttgccagtgctgctcwtggtgcctggtttctcatggtggttcaggggagtcccaggttggtgtggagggtagttagtgtggaagggtagtgcttctagggctgggccatttcttttcagcaggacttctgattgattgtccttttggtattgcttgtctggtctggctgggagaagaatgagcctacccggaccatcttctgttgcttggttggaatttagaaaattctaggtctgtgtttgttgcattttttatgttgttgggggccrtaagacaccctgtcactatgtttttcctctagcgctgagttccattactattttgtcttcctcttcccatctttcagaattctcctttcattgccttttgcattatttccagtgtttgtagttgtacatagcagagaagarcagggagaaatgagtctacatcatcttcttcagaaactctcacactgatgggtttttggaagttgagccatttttcattgctcaaattatgcttagtaataatttattatccttgttgtgtatcrcatttgattttctaacattttgttaataatttctttatgttcatggagaatttgtctgaaattttcttatgtggcaatgtccttttcagttttagtattcaatagtcttattattaagactattgaatgctggggctcttataatgagataaaaagtgtgtatttttctctatttctgaacgagtttgtatgaagttgctgcaacttctttcttaaatgttcagaataattcactagtgaagcaaactgtcattgaatatgtatatttacacacacatgctagtatatacatttagattttatattatttcttgagtcagtttgttaagatgtgattttcaataagtatttccacttcatctaaattgtcaaatatcatggcacaaaaaaaattkttttcttaccctgatttttgttgttttcatccctttattcttttcaaaaaacaaattttggccttattactttgttttgtttaaaatttttattaatctttgttcttatttattttattttccaatatattttattatgatttgttcttttttctggcttcttgctatgtgtggttagataatttatttttgtgtttatttttctttcatttaaagctatgaatttactttacagtactgttttagctgaattccgtatattttgacatattttactttcaatgttatccagctcaaacattatttcatttactaaacaaaattgtttttgacccagggtttattagaggcatattgcttattttccaagcatagaagtttttctagtcgtttttttggttagtcatttaatagtttctaacttattttcactgtgatcagcaaatttgtaaatgattttggctctttaaatattatcttggcttactatatgaccaccatagaggtaaatatttcatgtgcccttgaaaagacggtatctcattttattgtttcatattgtggttgtggatttacctatttttttcttatttttattttatatcttataaaacttattttagcttcaggggtatatatgcaggtttgttatataggtaagttgcatgtcatgggggtttggtgtacagattatttcatcacccaggtaattagcatagtacctgataggtagcttttcaatcctctccctcccaccctccaccctcatgtactcaagtgtccatttgtactcaatgtttagcttccacttataagtgagaacacatagtattttgttttctgttcttgtgttagtttgcttaggaaaatggcctccatctccatctaattttctgcaaaggacatgatctcattttttttttatagctacatagtattccatggtgtatatgtaccacatttactttatccagtttaccattgatgggcattaatgttgacttcatgtctgccattgtaaatagttcagcagtgaacctacatgtgtatgtgtctttataatagaatgatttatattcctttggatatatacccaataacgaaattgctgggtgaaatagtaattttgttttaatttttgagaagtcgccacactactttccgcaatggctgagctaatttacattacaccagcagtgtagaagcatttgtttttctccacaacctcacgaacatctgttattattttattttttaataatagctattctgactggtgtgaggtggtacatcattatagttttgatttgcattttttaaatgattagtgatatgtaacactttttcatatgcttgttagctatgtgcatatcatcttttgaagtgtctgttcatgtccttttcccactttttaatggggttgtcttttgcttgtaaattcatttaagttccttacagattctggatattagacctttattggatgcatagtttgcaaaatttttctcccactctgtaagttgtctgtttactctgttgatagtttcttttgctgtgcagaagctccttagtttactgaggtctcctttgtcaatttttgtttatgttgcaattgcttttggtgtcttttttgtgaaatctttgccagggtctatgtccagaattgtatttcctaggttgttttccagtgattttagtttttggttttacatttaagtctttaattcatcttgagttaattttttaaatatgatgtaaggaaggggtccagtttcagtcttctgcctatgactagccagttatcccagcaccatttattgaataggaaggccctcccccattgcttgtttctgtttactttgtcaaagatcagatagttgcaggtgtatggctttctttctgggctctttattctgttccattggtctatgtgtctctttttgtttgagtaccatgctgttctggctactgtagccttgtagtatagtttgaagtcaggtaatgtgatgcctccagctttgttctttttgcttaggattgctttggttatttgggctctttttggttccatatgaattgtaaaatagttttttccaattctgtgaagaatgccattggtagttcaatagggatagcattgcatctgtaaattgcacagtagcatggcatcagtatggccattttaacaatattgattcttcctatctatgagcataggatatttttctgtttgtttgtgtcatcttggatttctttgggttgtgttttataattctcattgtagaaatctttcacctctttagttagctttatttctaggtattttattcttttgggggatattttgaatggaattgtgttcttaatttggctctccacttggacattgttgttgtatagaaatgctacggatttttgtgtattgattttgtatcctaaaactttgcagaaattgactatcagatcaaggaacatttgggagagactatggggttttctaggtatagaattaatcatccacaaacagagatagtttgacttccaatctcttgctattgggatgccctttatttctttctcttgctgattgctctggctaggatttccaatactgtgttgaataggagtcatgataatgggcatcctygtcttgttttkgttctcagcggaatgcttccagcttttgcctgttcagtatgatgttggccctgggtttgttayatatgacttttttttttgaggtatgttattttaatgcctagtttgttgagggtttttaacattaaggaatgttccattttatcaaaaccttttctacatttattgagataatcatgtggcttttgtttttagttctgtttatgtgacgaatcacattaatttgtatatgctgaactaacctggcatcccagagataaagcctacccatttgtggtggattcgctttttgatatgttgctggattcagtttgctagtattttgctgaggatttttgcatctatgttcatcaatgatattggcctgatgttttctgtttttgttgtgtctctgctaggttttggtattagaatgatgccagcctcatagaataagttaggaaagagtccctcctcctcaattttttggaatagtttcagtagcaatattaccagctcttctttatacacctggtggaattcagctgttaatccatctagtcctgggctttttctggttggtaggctttttattactgattcaattttgtaactaatttttagtctgttcaaggattccattacttcctggttcaattttgggaggttgtatgtttccaggaatttattcatttttttctaggttttctagtttgtgtgcacagaggtgttcagagtagtctctaagggttgttgtcactgggtttttttttgcatttcagttcagtagtaatgttctctttgtcatttctgactgtgtttatttggctcttctctcttttttcctttattagactagatagtgatctatcaatcttatttattctttgaaataatgaactcctggatttgttgatcttctgtatggtttttcacatctcggtttcattcagtgcagctctgattttggttatttcttgtttactactccctttggagttgttttgatctcttttcttttctcatttctctaggtatgatgttaggttgttcattcgagatctttctaactttttgatgtgggattcagcactataaattttcctcttaccactgctttagctgtgtcccagagattctgtctgctatgttatatatttattttcattagtttcaaatcatttcttgatttrttgcttaatttcattgtttgcccaaatggcattcgggagcaggttgtttaaattccatgtaattgtatggtttttgaatgattttcttagtattgatttctatttttattgcactgtggttgaatgttgtgtttggtatgatttcatttttttttaatttgctgagaattgttttatagctgattgtgtagtcaatttcagagtatgtgccatgtgcaaatgagaagtatgtatattcttttgtttttgaatggagatttctgtagatatctgttaggtccattttgttgagtgccaagttcaagtcctgaatgtcttcattagttttctgccttgacgatctgtcgaatactataagtgggctgttgatctatcccattattattatgtgattatctcagtctcttttcaaggtcttagaagaccttggtgcttctgggtttgatgcatatatatttagaatagttaggtcttcttgttgaatcgaaccccttaccatttatgtaatgccgttcttcatcttttttttttttttaaccattgttggcttagtctgtttggtctgaagttaaaatcgcagtccctgcatttttctagcaaggttagataccttcatggacagtatcctcaaattcgctttccaagttgcttgctttctcttcctctctttcagtgactccaagtcatagatttggcctatgagtcatagatttggtctcttcacattttctcatatttatcagaggttttgttcattctttttaattctctctctgtctgtctgtctttgtctgactgatttaattaagagaattgtttttttttcgagctctgagattctttcctcagcttggtcaattctgctgttgatacttgtgatggtattatgaaattctcaaagtgagttttttagctctatctgatgaatttggttcttcttcaaatggccacttcatttttcagctcccatatcattctattgtattccttagactccttgaattgggtttcagctttctcctgaatctcaataatcttcattcctatccatattctgaattctatgtctgtcatttcagccattacagcctcattaagaaccattgctggcgaaccagtgcagtcattaagaggtaagaggatactctggctttttgagttgctagagttcttgcactggttctttctcaactgtgtggactcatattccttcaatctttgaagttgtcctttgaatgagattttttgctttcattttctttgatgcccttgggggtttgattgtggcataatgtgggttcagtcaactagctttatttcgggaagattttaggggatcaagccccagctcagcactcctgggctgcctgctctaactcttgaggcttggtgccaggcccccagctttgttctctggccccttgaagttaggaacctgctgtgctggaggaactgaggtgttcccattctgttggcccaatgatctgatgggagatgctggccagagtgcttcatttaaatggtggcagcaggatccttgctcacttgtgcctgccagtagccacagcagtgtggcagggtgtagggtgcagtgtggcagggtgaatgtggcagggtgcatgtgttggcaagtgtggggcactggcacaaatggagtaacagcattccggcacatgcttacgcccgcaacaacagggtgggggacgggggagggtcacagttgctggcatctgtgaacatgttcacagggattttcccttctttttagtctgaagttatgtcattggggatgctagtcattttattggtttttaaaaatcaaatctaatctgacaattctagacttttgcttgggttttgttttgttttgttttgtttttgacggagtctcgctctgtcgcccaggctggagtgcagtggcgcgatctcggctcaccgcaaccttcgcctccagggttcaagcgattctcctgccttagcctcccgagtagctgggattgcaggcatgtgccaccatgcccagctaattttgtattttttttttagtagagatgagggtggtttctccatgttggtcaggctggtctggaacacccgacctcaggtgatccacccgcctcagcctcctaaattgttgggattacaggcgtgagccaacgcgcctagcctgattgcgggtatttatctacttacagtcaatatagtgactgatttatttgggtttatggttatcacttttctcttttttatttgttattttatctttttttcctcttcttttttaccttaatttattgaagaatattattctgttttctctttcataacttaaatttatatatatttgaaaatataagttattgataatcagtttgtgaatcaatattctgtgcattacacacatattttttgtccagttgttttttactattttttccattctctttttgtgattatgttttctattgcatttctctcttaccatatttttgattgaccatttaaaaaattagttcttttgccccctgtattaacttgttaccttttgctattcctttagtgaattccctagagattaactaatacatttgactcattacaatctagcataaattattcttttaccttttccacactaacactgaaaagtttcagtattagcctattttaacataattaaattcaaatgcttctgcacagcaaaagaataatcagagtaaacacacaaaccacagaatgggagaaaatatttgcaaatgatgcatctgacaaatgactaatatccagaatctacaagaagctcaaataaatcagcaagaaaaaaaaaaacaatcccatcagaaaatggacaaatgacatgaatagacacttttcaaaagaagatacacaaatggccaacaaacatgaaaaaatgctcaacatcactaatcatcagagaaatgcaaattaaaaccacagcgaaatatcaccttaccccagccagaatggctgttattaaaaagtcaaaagcaacagatgttggcatggatgtggtgaaaaggaaacacacactgctggtgggaatgtaaattagtacaacctatatggaaaacaatatgggcatttctcaaaaaactaaaagtagacctatcattcaatctagcaatcccatgtctggattttttttccaaagggaaagaagtcatcacatcaaaaagacaccttcacacatgtttattgcaacacaatttgcaaagatatggaaccaacctaagtatccatcaactgatgagtgggtaaagaaaatgtggtatatatatagtgtggcatactactgagccataaaagagaataaaataatgtcttttgcagcaacttcaatggatctggatgacattattctaagtgaagttaactcagaaatggaaaaccaaatatacattctcaattataagtgggagctaaactatgtgtatgcaaaggcatacagagaggtataatagatattggagactcagaagactggaaggttggtggtgggggggtggtgagggataaaaaactatatattgggtacaatgtacactacttgggtaacagatgcactaaaatctgagattcacagctatacaattctccatgtaaccagaaaccacttgtacctgaaaagctattgcaattttcaaaaatgtgaaaaaatgaattaaaaaacaaccaaaaagggctgggcatggtggcacatgyctgtaatgccagcaccttgggaggccaaggcgggcagatcacttaaggccaggaattcgagactagcctggccaacatggtgaagcaccatctctactaraaatacaaaaattaactaggtgtggtggtgtgagtctgtaatcccagctacatgggaagctgaggcaagagaatcacttgaacccgggaggtggaggttgcagtgagccaagatcgcaccactgcactccagtctctcgccggatcgtactcttgcgacaaggcaagactccatctcaaaaaacaaacaaacaaacaaacaaacaaacaaaatcaactctttttaagtcttttcctcttttgctttattgttgtaatatactttcattgtgcatattttaaaacccttaatacattgctattttttgaataatgatcatttaatcactatttagttatacttattcacacacttaatttttcaattgttcttagtcctttctacttttctctgggatcctttcctacccaaggaactttctttagtgtttctttcaatgcaggtttattggtgcccagtggattctctcagtattcttttgaaaatatattttttccagcactcattgatgatggttatttttactgggtgtggaattttaagctagtagttatttttcttttataactttaaaaggtattattctactttcttcttgattccatcattcctgggactgtcagtcttatcatttctcatttgaaagtaaaatggtaacattttttcccctgactgttttaaagttttcagtagtcttactgtatttagatatagttttttttcatttctcaagcttgatattcacagaattatttaattatttgcatttaaatatattatcagtattggacaattctcagtttgtatttaatcttatattgcttttggtgaattccctctcttctctctgaaatgctaattatacacattggagcttttaagcatgacccacatgttactgttttaccccctctttggttttagtcattatgcatttttaattttctgtttatttttgtttatatatattttaattagattctaattatttctcaaattatctttatttttctcttttttgtaatttaaaaaagtttcttgaacatatcatggatttttcaataacttgattgagtcatattttacaaatcacwatgcacccatttcaagtgtatatttcagtgacttttagcaactttactgagagatgattgaagtaaaataattgagattttgacaatgtactttttttttctttttttattatactttaagttctagggtacatttgcacaacgtgcagatttgttacatatgtatacatgtgccatgttggtgtgctgcacccattaacttgtcatttacattaggtatatctcctaatgctatccctaccccctccccgcaactcaygacaggccctggtgtgtgatgttccccttcctgtgtccaggtgttctcattattcarttcccacctatgagtgagaacatatggtgtttggttttttgtccttgcaatagtttgctgagaatgatggtttctagcttcatccatgtccctacaaaggatgtgaacacaacattttttatggctgcatggtattccatggtgtatatgtgccacattttcttaatccartctatcattgttggacatttgggttgtttccaagtctttgctattgtgaatagtgccgcaataaacatacgtgtgcatgtgtctttatagcagcatgatttataatcttttgggtatatacccagtaatgggatggctgggtcaaatggtatttctagttccagatccctgaggaatcgccacaccgacttccacaayggttgaactagtttacagtcccaccaatggtgtaaaagtgttcctatttctccacatcctctccagcacttgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatccttagcccactttttgatggggttgtttgtttttttcttgtaaatttgtttgagttctttgtagattctggatagtagccctttgtcagatgagtagattgcaaaaattttctcccattctgtaggttgcctgttcactctgatggtagtttgttttgctgtgcagaagctctttagtttaattagatcccatttgtcaattttggcttttgttgccattgcttttggtgttttagacatgaagtccttgcccatgcctatgtcytgaatggtaatgcctaggttttcttctagggtttttatggttttaggtctaacgtttaagtctttgatccatcttgaattaatttttgtataaggtgtaaggaagggatccagtttcagctttctacttatggctagccagtkttcccagcaccatttattaaatagggaatcctttccccattkcttgtttttgtcaggtttgtcaaagatcagatggttgtagatgtgtggtattatttctgagggctctgttctgttccattggtctacatgtctgttttggtaccagtaccatgctgttttggttactgtagccttgtagtaaagtttgaagtcaggtagcgtgatgcctccagctttgttcttttggcttaggattgacttggcacattttaataattttcaggatatatacacatatacatatatatatgcatacagacacccaaatttttgttacgatcaagataaacaattatttggatcaccctcaaatttgcctgtacttctttgcaatccatgtctccctctaacaccacccacagtcaactattgatctgttttctttttttttttttttttttttttttttttgagatgaagtcttgctctgtcacccaggctggagtgcagtggcacaatctcagctcactgcaacctctgcctcccgggttcaagtgattcttctgcctcagcctcctgagtagctgggattacacgcacctgccaccatgcccagctaatttttgtatttttagtagagatggggtttcaccatgttggtctgctgggctccaactcctgacctcaaatgatctgcccatttcggcctcccaaagtgctgggattacaggcatgagccaccgtgcccagcctgatctgttttctgttacaatggtttatttggtgtttcctataattttatgtaaatataatatataatttgctttttttttactctttcttctagaatgtgattttgagactaatctacactgttaatgtttgttaagaggtcttttctttttattgttgagtaatttcattatatgggaaaaccatatttctttatctgcttatccgttgatgagcatttgcattgtttctagattttggctatttttaataaagctgatacaagcatttgtgtaaaaaatgtcttcatgtggatatatatttatatttcccttgaatgaatatcaaaaaggcagaatggttgggtcatattgttgatgcttaatttttaaagaaacgtccatgctgttttccacactgcatatttgatttttaatttccttcagcaatgtattaacatttcaattcttctacagccttgcctccgtgtagtatagataagtttaaaaatttttagccattataaatggtataatggtataatagtggtatcttgttgtggcttttataattaaaaaaataattttagaatttgaaaagacagcacaaataattatttgatgtacttccctcaaattcctttatttttaacatctcacacaataattataaatatatcgaatctgggaaattaaccttggaataatatattaacccatttattcctgaggttgcagttttttgaatttgaaaaatcagaccttggcgatgaccttgagcagtaggatatgaagaactcccacatccttagcgtcccaatagtggaacactagacatatgaagtaaactatggactttattatgattttgcctgttttcctactaatgttcttttcctttttcaggatcttttccaggaatccacatagcagttagtcatcgtggctctttcctcctccaatctataacaaattgttagtttctttctttttttaaagaccttgtcaattttgaagagtattyatcaggtattttgtagaaagctcctcattttgagtgtatcagaagttttcttttcttttctctttctttctttctttctttctttctttctgtttctttctttctcccttctttctttccttcctcccttccttcctgcctgcctgcctgcctacctgccttcctgcctgcctgcctgcctgcctgcctgcctgcctgccttccttccttccttccttccttccttccttccttccttccttccttccttccttccttccttcctctctctttctctcccttcctccctccctctctctctctcattctctctttctttcttgacagttttgctcttttcgcccaggctagagtgcaatggtgtgatcttggctcactgcaaccttcacctcctgggttcaagtgattctcctgcctcagcctctcgagtagctgggattacaggtgcccaccaccatggctggctaatttttgtatttttagtagagacagggtttcaccgtgttggccaggctggtctcgaactcttgacctcaagtgatccgcctgcctctgcctcccaaagtgctaggattagattacatgcatgaaccaccatgtctggccagaagttttcttatgattagacggaggttatgaattttggggaagaacaccacctggtacccttctcattgtatcatatcaggggatacatgatatccatatgatgttaaccttgattgcctgtttaaggtggtgtctgtgaggtttccccaatgtaaagttactagtttttgtcatatgatatttattagaagcaagttactaagtccagatcatgttgagatgttgaggaaaggggagttaacattcatcacttggtgtggggagtaacaaaaagttgtgggtacttgtcaaaatcacaataattaataaacttctgggggaatatgctttgaaacggtgcaaatatcttatttctcctttaattttttcccactaattttagcgtttatcagcgaatcctgcatgcagcaattgttgctgttgtgctttttgtggtgatttgatgtttcccttgttcctcttactttacttggaattcttacgtaatgaggatttgactcttcccctccctcccatttatttatttgttcaaacatgcattatatcagtatgaactcatggatttttttatgccaatctttgagttataatcaaatactattgtgcaggacatggtggctcactcctgtaatcccagcactttgggaggctgaggcgggcggatcactcaagctcaggagtttgagaccagcctggtcaacatggcgaacccctgtctttgctaaaaaatacaaaaaaattatccaggtgtsgtggcatgtgcctatagtcccagctactcaggaggctgaggcacgagactcgcttgaacaggggaggcagaggttgcagtgagccaagattgtgccactgcactccagcctgggcgacaaaatgagactctgtcaaaaaaaaaaaattactattgctacatttttctggctttggttactgggaactgtgtcaagtagcctcctatctcctttggacatgcctccctcatcctttttgaggacttctttattttctcatgctataagatgctctgttcccatcttgtattttccttgcctctgacctagaattagccatgtctccaaggagctctggcttattttattggtatctggcttatttcagtggtatttagaaactaaaatatgggtgattaatgtatctgcttttactgagctatcactgcttcttggaccttttaatggacaaagtgaggaagtatatgcatgtgtattaactcatgtatgcacacacatctctatttctgtctgtctgtctatctrtccattcatccatccatgtgtgtgtgtagatgtatatttgtagatacaaatagatggaaacataggtagatataaacacacatacatgtatgtataaataatcatgatttctaactcatccatcaggaaggattcattctagtcttctctttttacttatttgttacttcactctttgacagtgagaaagttggcttccattatctacaaattatttacttatttgtccaacctttggatacatggagtatcagaactgctaatcagcatgcatgtgagaaccaaatttaccaactaaagaacagcatttaaatacaattcttttggtatttaggttcagagtatccaagcaaatcactgtttccaaaagctacttaggtcaactccctttcccccactgccttcagtgaggttatgcctttcatttgtgctacaatgaaattcttttttttttctgagacggagtcttgttttgtcactcaggctggagggcagtggcaagatctcggctcactgcaacctctgcctcctgggttcaagcgattctcctgcctcagcctcctaagtagctgggattacaggcacatgccacactcctggctaatttttgtatttttagtagagatggggtttcaccatgttggccaggctggtcttgatctcttgacctcgtgatccatctgcctcggcctcccaaagtgctgggattacaggcgtgagccactgcacctggccttctgaaatttattttttatagccaactttccatcytggaatcttttgacattctggctataattttttttaatgttgttattattgagatagagtcttgctctgtcatccaggctggagtgcagtggcacaaatatggcccactgcagccttgacctcttgggctcaggctmtcctcctacctcagcctcttgagtagctgggaccatagggacatgccaccatgctgggctaattttgtattttttgtagagatgggtctcactgtgtttcccaggctggtctggaactcctggacccaagcagttctctcactttggcctcccaaagtgctgggattacaggcatagaacttaaaacagaattaccattcgacccggcaatcccattactggatatatacccaraggaatataaatcattctaccataaagatgcatgcatgtgtgtgtttgttgcagcaccattcaaaatagcaaagacatggaatcaacctaaatgcccatcaatggcagactggataaagtaaatgtggtacatatataccatgaaatactatccagccataaaaaataatgagatcaggtcctttgcagcaacatagagctggaagccattgtcctaaggaaactaacacagaaatagaatatcaaatgctgcatgttctcagttataagtgggagctaaacaatgagaacacatggctgctaggaggggaacaacagattctggggtctacttgagggtgaagagtggaaggagggagaggatcagagaaaaatacctatcaggtactatacttattacctggatgatgaaattatttgaacaccaaatccctttgacacacagtttacctatataacaaacctgcacatgtacacccgaacctcaaataaacrttaaaataataatgataacaaaaagcatgaaaaaattatacaataaagtttacttttgtggtgtgcggttttatagattttgacaaatgcacagtgtcatgtatccaccaacatggtaacatgtggaatagttccatcaccctaaaaattgtcttgtgtggcttctttctattcaaccccacatccttaaaaaccagccaggcaaccaaccactagtcaaatttttgtctctataggttgactttacaagaattttataagtgagttacatgatatgtatgtagcctttggggtctgtcttctttcacttagcaaaatctatttaagattcatttatgctgttctgtaatttgtttcttcattttcttgctaaatagtattccatcattggatgtaccagggtttgtttatccattcaactcttgaaggacatcttgattattttcactttttggcaattctgaataagggcattatcaaaatttttgtaaagatatttatgtaaaagtaagttttaattcatttggatgtataccttgaagtagaattgatgggtcatgtcataagtagataatttattttcataagaaactgccaaactttttatcaaagtggctgtataattttgcwtttccaccaacaatgaattcatgttctttttgctccacatttttgccagcatttggtgctgccaatttattatcataatatatatttttttaaatttagccattctaataaatatatagtagtacctaattgaggtgttaatttgcatttaactaatgactaatgatgtaagcttttttttacaaaaaaggagttgttttgctttattgttgaagtattaattttctatagatgtattcttaatagaaggtgttcattagataagagttttaaaatatctttccccatctctgacttgccttttcattacttaatagtgtatttttgcagaagaatcagtacttaaattttgataaatttcaaattacatttttttggtgtattgtgattttggtgtcatatgtaaaccttctagaaacctaagttcaagaagatttttctctttatgttttattctagaagttttaaagttttacatttaagtctgtggtccaatttgagtttgtatctggtgaccttgttaaacttacttattagtttactaacttactacttactagtagattttaatataattgtttagttttttctacatagagaatcattttatctgtgaataaagacagttctatttatttctttccaatctatatttcttgtatttcttttgtttatttttattgtcttattacatgccttccaatatgatggtgattaggaattgtgaaataaggcattccttcctcgttcccactcttagggagaaagcattcagtgtctttcattaaatgagatattattgcagatttttaaaaagatgtcttttattaagtcgtggaagtttccttctgttcttagttccttgagagtttttatcatgaatagatgttgaattttgttgaatggttcatggagatgattatgatttttttctctcaggttttcagtgtgatcatatggcgaattccagcaattgatttttgtatgtgaaagcagttttgcattttgggcatgaacatcacttggtcatgatgtattatcttttttatatgtggctcctttcagtttgctggtattttgctgacaattttgcatctatgttcacatgaactgttggtctccagtttttctgtaatgaccatttggttttggtatgagcataatgctgacctcataaaaagagttggtaaatattctctcctcttctgttttctagaagaaattgtgcagaattggtattatttcttcctgatccatcagtgaaactatargggccttttgaaaggtttttaactacaaatttaataactttaatagatatgagggttatctcattatctatttcttcttaagtagtttatagtagtttgtatgtttcaaggtattgattattttcatcaaagttgtttaatttatagacatagaattattaatggtattccgttaatatcatttaaaagtatgtagtaatgtcctattttaattccagatgttagtagtttgtgttatttctattcattacttggacagactgactagaggtttatcaatcttactcatcttttcaaagacactatcttttagtttcattgatttttctctgttgtttttctgtttttaacttcaatcatttctgcttttacctttattattttccttctattgcttgttttagctttaatttattctttctctaattacttaagttagaaacttaggttatttattttatatctttattctttctttaacatagcatttaattctacacatttccctctaagtcctgctttggctacatttcacaacattacataagttgcataattatccatccatttattttcaatctgcctggcatttatatttaaattgttgcttgtatatgcagcccayggcagggtattgctttttgtccactctatcaatatctgcctttaaattggagtgtttggcacattgtataattttgtgtaattattgatagagttgggtttatgtctacaattttcttattaattttttggttgttcagtctccatatcctttttcttgccttttttgaattatttaaatttttaaaaatatttcattttatttatttacattttgggtatgtattttctgtcaatatttaagggatttacgtagcattaatattgtatcactttatgtaaactttagaaaatttctagcatggaggtccctataactctcctcccttacccctatgctattttgcattatagatgtcatatatatctgcatacactgaaagatctaacagatgatataattttttatttcaacattcagttgcacacatttaaaagtacttaagatataagaaaatagcctagatatttactatttattttattctttaatttctgaagatgcaagtttccctctggtattgtttaccttgaatttttttaaacataagtttttaaaaaatgttttaaagcaaattttaaaaaacatttttaatattgtaggcctgctgtaaaacttctatttgtttttcttcttgtgagaagattgtaagtttcatttgttcttgaaggatatttttataggatataaaattctggtttgacagttcttttttttttttcagcgtttcacattttaaagatgttgttccactttattctgacttccatatcctctgatgagaaatcaatggtgattccaatcctgcttcccctgtgtataatgtgttgttttcttctggctgctttcaggatttttccttttattttgttttcagcaatttgattaagatgtatgtagacatggttttctttgtgcttatactttttggagttcactgactgtcttgaatccgtaatttatatatatatatattttatcaamtttggaatgttttctataattactgctttaaatatttttgcatgaaaatgtttttctcttcttctggggctccaatggcacrtcaattaaaccatttaatgtagagtcctagaggctctgatctttctttttcaatcttttcccccttcttttctcttcagattgaattgtttctattgttctattcaagttcaccaaatataaagcaatacatgagtttccatgctaactttaggtaccaatgctgccattaccaccatgctgatacacagcaagagccctcttaagttgaaagagagcagggkaatatatatatacacacatatgtgtgtgtatatatatataatatacacacagatatacacatattaatacacatacatacacatatatatgtatatatagacacacacaaatatgtagtgaaagagagagattggggggagggrgagagagagagagagagagarcttctgtttgcttgtttagttttgactttcattcacaatctgcctgcattacctcacactttagagtcctcaggtaattattttctgcatttttttccagaaattatagctccaactagcagaagggctgggctgtaatggattcctaccagcctagcggaattggaattccagttatgtcttttaagtaaattaagaggtttaaaaaataataaaatgctaatcattgctatctccaagagggcttttacagccactatacatcactgccattatcacaacatatatgtcacctttgtacatacaccctgatcatcattttttgaagcacatttccacaggttatcaagttccaggtttgtaattttctttattttaatactttatgtatgtaatcttattctcatgtcatagtaaggtttgattttttttctctttctcctttgtgtatctgttctaactatgatttttgtaattttgtgtgttttcatgatggtagttatcatcttttcacttccagatgtaggactcccttaatcatttcttttaacaccagtaaagttgtgaatcattcctgtagtttttgcttatctgggaaagactttatttctccctcctttctaaataacagttttgcctagttcttgactggcagtatgtttttctttcagcactttctataaattattccattcttttctggcctgtaagatttcttctgagaaacctactgttggtctaattggaattctcttatacctgacttgctgtttttctcttgctgcttttagaatgctctctttgtctttgattgatgattagctctaatgtacgtgggagaggatgtgtttgtgtttaatctatttggggtcctttgagctttctggacctggatgtccatctctctctttctagacttgggaagttttctgctattattttatcaaaaatgttttcctcacctcttcccttctcttcaccttctgattgctcataatgcaaatagttattcacttaatggttttccataaattctgtaggctttctttatttgttctttctctttttttgtctgcttttgttatttcaaaagatctgtcttgaagtttagaaattctttcttttgcttggtctcgtctgttgttgaagctcttgattgtattttttattccattcattaagtttttcaggtctagaatttttgtttggttctttttaaaaataatatctatctctttgtttaatttttaatgcagatactaagttggcttcctaatttaattgaatcgtttatttatattatcttgtatctcactggcattttgtatatttcctttgatttggggtctattactgcaaaattattgtgttactttggaggtgtcatgtttccttgctttctcaagtttgctgtgtccttacattgatatttatgcacctgagggaatagtagcctcttccaattttatagaataggtttcataggaaaagccttattcctrtagatgggtttttatatgtcgattggctgggatgtactgactttggttcttggtacataaagtagtgcagtttcttcagatgtaatccatgttagtgatgtttgatagtgcctcagtggcctaggttgtgaggatttgtggtggtgatgacacagcttcttcaggggtgggcttgctgaagtgtttctcaggctagggtgtatgcatgaacacagtggatcagccaacttgagggctggttcactaaggtttgtgccaccaggatgttttttggactttgggtgcaggtgctcaggatgagtcagctggcttggggactggctcaccggggtcagggtctctgggttattactccaactggagacatgagtcatgcctgtttggctggcttggagtgggtctgccagggttgggtctactcagctatttctgtggtcagggtaatgggtgcatagccactaagccagttcaggcatatgtctgcctggggcaggtccaccaggctgtttttctgatggggaatatgatgatgcagatgcttgggagcttaggggcatgtcggccggggcaggtttgcctggcttcatctccagttgggagtgagggtgcatggtagttaggtcagcttaaggccaggtctgcctggaatgggtctgctggagtgtttctcttaccatgactcaggcacacagctgctcatctgctttggggccttctctgctagagtcaggtctgctagactgtttctccaactctggccacagctgcttagcagctcaagggtgtgtctagccagggtcaggtctgctggactgtttatctggccagggacatgggtgcacagcagttcagctgacccaggatggcttacctgcagtgtggtaagggagcaagggccattcctgggcccaggctctgagcagctggggtcatgrtgttacagccacccatgtgggtggagagatggtggaatcccatggttggaggcccaaagttgctactggcccccagggcagagcacactccartagtggctctggttttaagatggcaccacaccccagcagctggggtcatggtgttacagccacccatgtgggtggaaagatggtggaatcccatggttggaggcccaaagttgctactggcccccagggcagagcacactccagtagtggctctggttttaagatggcaccacaccccagcagcttgggtaattggataatggaagtacaaaacttgtgctcctaatccagtgaaaagcagccatgtgaattccagacagctcccagactgagctgagggattgtgaagactgtgggattcttctgtagtaaagactacaggggggctatagtggcagtgagggctgctgcaggtcctctgctttccctttcccacaggaagaagtccctccactctgagctgatctcaataagagagatggttcagcagagggagggtgccttgctcccctctctgctaccctcttgagtctctgaacactgaaatgacttcactactcctttgttacacttcagcactttccctctgaagtttcagtaaaagttttagttgttaatttacttacttggtccttttttataaggagaaatgtgtggcaggtctttctaattacccatcttgctgatagcactccttttgtctaggcagatttttgttctgaaagtcatccatcctattgctgctccttttaaaggaacatacttttttgtctagctgcttttaaaattttctctgtgtttgagttttgggagtatgtttataatgtgtttaggtaggtgtggttttgggagtatgactataatgtgtttaagtaggtgtggcttttattacttttatcctactgaagttattgagggattggtttgatgtgttttattaaatttaataatttaagttgtgatactttctcttcttttgagacaacaattaaacatttattagacatttttaacaggaacttgtatcttttatgctctgtttttttcctcattttatttttttctctgtgaatcagttgaatattgggtataaacatatttataggttaacgagtcacgtcttctgctgtgtccggtccattttattctgatttagtgaatattcgattttatattttattttacaattctcgactgtatttataattttttgtggatttaaattatttgttcaaattttttaacttttcattcaggttgtctctcatttcctctgttttctttgacatacaagcataatatagacataatatttatttttaaatgctggtctgttcactcaatatctttaccttttaaggtcttaattctattkactattttatctcttgattatcagtcattttctgttttttaatatgtgtaatagtacatttttacgtttcctggacattgtgggagatacgttgtaccatctttggtttatgttagttttgtctgattattgtaaaatgctatactaaaagtcatttttgttgctaacaaatcatcttggtcctattgaggtatgattttcaatttgttgtgggattctattttagccttttcctcactcttacttagatcatgcttgcactgaaggcataacctcccttatgtgtcacttaaaagtcattgacatttattcatcgagatgtttatactttgcctgggcctaaagtttaacgtatttccagaactttgtgacctctgaaatatgtgctaatttctccattttcctagttggtcagtgacatcatcttagactttttgcaagctagttacgtgtcataggagtcatccaagagtttgcaatttttacagagatattttggacttctttttaatttcaaattgttcctttctcttaacatacttcacaaatttttctcaccttggtaccacaaactcttatttctattcccttcacctagtgagactctcattccgtgcttgtgtttgatttccatgcaaaactgatttaaaaatatctgcaggtaataatgtctggtgtgaatatgggcctcctgccatgtttttcttgttattgcaggagtaaccttgtaattgtttatatctaaggcctgaaatcagttattttctacattttgatagattttataattatttactatgggaacttcccttatttttatgattctattatatatttattcatgccatttccctgaagtgttgttcagtttaaatagatttgaactttcaaataaaggtatctcctgggctttacttttaaactcaacactgttatgttaataaagtttattatatgtgcaactatgttgtttaatttatattactgatgtacaagagtttctcttgactatgtacagaaatggaattcctgagtcttgtgaataataaacttaaaaaatcaacttataatatctatttgttttccaatgtggttatattaattatacttccagcagtgaatacaatattccactgatcctcatcttcttcaccccttactattttttaggcttcttatttatgccactcgagagaatgtaaaatagtatcacattttgatcatgttttgcatatccctgatcactatgaaaactgagcagctcttcatatgttaatttaacatatgtttttttccagttaatattcatttccatttctcattttttctaygggaatatttatctctttctaactgattaatgagagttcttcatgtagtttctgaaacttctaactttttgattttaagtcacatgattatctttcatatattcgtatcattcttccctccatatttttaaggtgtctaaaattactaattcttaatcttaataaatcaagattctttttctttccttttttttttttatttgaggagatggaatcttgccctgccatccagaccagagtgcagtggcgtgatctcagctcactgcaacctctgcctcctgggttcaagtgattctcctgcttctgcctcccgagtagctgagactacaggtgcgcgccaccacacctggctaatttttgtatttttagtagagatggtgttttgccatgttggccaggctggtctcaaactcctgacctcagatgatccacccacctcagcctcccaaagtgctgagattacaaacataagccactatgcccagcccaagattatttttctttacagttaataaaccaagattttttttttacttttaaaagcagtactatttgtctgaatccaaggtaaaatatatattcttacattttgtaaagtttaaaaaaatctgttgagatgtaatttacaaatattaaagtgcacccattttgattgcatgattagattagtaatgataaatatgttcatacaggtaaccaccaccctatttaagcactagaacctttccatgacactaaaaagttctcccattccccttttgaattgaatgcccccttcattgtaggcaagtttttgatttctgtcactataaatattatctattctagaacatacaaataaagtacacagtcatcttttatatcaattttcttttaattagcctaatgtttttgagttttccacgttgttttgtttattcctttttattgaattgttcctttttatttgagtggcatttcattatatgaatattatcacaattttatgaaaatttgtttttttttccaaacttgggttatcataaatccagcttctgagaacattcacatgcaattatttgtgtggatggggacgtatgctttaatttgtcttaattaaatatctagggttatgataaatgtctagccatagtctaagaacacagtctaagaaattgctgaactgttttccaaattggctatatccttttgtattctcaccagaaatatatggaatttccagttgctccactttcttaccaacacttggcatgactgtgttaatttttgtcattctggtgggcatatagtggtatttgtgttttcaaattcttctataaagactaataatattgagcatcatttcatgtgcttgttggtaactcttaatgtgttcttttgtgaagtgtctattcaaatcttttgcccatttaaaacattggattgcttgtcttctttgattgagttatataatttcttcaatattctggataccattcattaattaggtgtatgtattgtgaatattttctcccagaccatagcttgcttgtcttttccttaatggacttttttttttttaaagcatgatagttatggggtccaatttatcaatctttcttttatggctttttgtttcctattaaaaaaactttgtccatcccaaagtcacaaatatttttccctatgtttttgtctaaaattttatagttttatgttttacttttctggctatgattgattttgaattattgttttgtatgtgttgtgagggaggtatcaaggtatttatttacctatttatttatcatatgatatctaattattgaaaaggcatttcttgccctaatttattactttgggatctttgttgaaaatgcattcagcatgtatatgtggatctttttccagactctctagtctgtttagtttttaaaatacacttatctttaagctaataccacaccttcttcattactgaagctttatagtcacatgatgtaaattcttcacttttactgccttggtaaacattattttgtctattcttagtcctttaaatttttagaatcacataatttcttagagtcaaattgtctgaaaacatctgggattttttgggggggattgttaaatcttttgaccaatttagggtttattggacatcttaacaatattgagtctttcactcatgaacatgccaaatcttttcatttatttaggttttattttatttttctcatcaatagttttttagtacacagcccttgcatatatcttattaaatttagtattatgtagtttatgttttgtacactgtttcaaaagttgttttaaatttcatttttcagtggctaactaatggtgtgtagacagataccaggtttttgtatcctgtgaacttgttaaatatgtattagatctagaattttatttctatattttattattatattcctatatattatgtatagtatgttcctatattctagtatatttttcttatcttctttgcattttttagatatatgaccaaaagggcagtcaacttcttccttccttttctcccttctctctcctcccaycctcttttttccttcattttcttttcttttcattctgtggttttttcttttgtacctttactataatgttggaaagatgtggtaagagctgacatccttgtccccaaacttaattagaaagtattcaggttttattattaagcatgttgtgaaatgaaggtttttttgaacatgggctttatccagtttttttgttgctgaggcatttaccataattcagctttgaatgtaatacaatttttactgtgattgttatggtaatttgttgccttattctgttaatgaggagtgaattatattgactgattttttttgaaaggtaaaacaaccttgcaattctatgacaaatacgtacatagtcataatgctatatcttttttatatataagtgaattagatttattatgatgaagggtattaatctatgatttttttcttgtaatgtctttgattttgaatgagtataacattggtcatataaaatgagttaggaagtaccctttcccctgttctgtctgaagttgtttgtgtgaaattggtattgtttgttcccatatggttgtgtaaagccatgtagacctgtattttctttgtatgaggcttttgaattatgaattcaatatctttaattgttacaggtctatttagaattcttagttcttctaatgtcagttttggtcatttggatctcaaaactttttttttcactttattttttcaaattcattggcatattatttatagcagtcttttattatcattttcatgttcgtagaatcagtagtgataccctgtcttttactccctagatgggtaatttatgcttttttttcatttttttcttccttaactagtctaaatagggttttatcaatttttattgttactgtcaagaatgaatttttgtctttatatattttctgttttttttcaatttcattgatatcccctatttagtgttccattaattctatttattttgtgcttactttgttcttcttagctccttaattgaaagcttgggttagtgactgtatacctttctcttttaaaaaaatataaatattcagaactataactttttaaataaatactgctttgactgtgtcccataaactttgctatttgagtgtgcattattttttagctcaaaatataacaaaaagtataaatgtgtgaggtgatggataccccrttgactctgatgtgattattatgtattgatgcttgtatcaaaacatctgatgtaacccacaaatatatacacttaccatgtacccacaaaaattaaaatctaaaaatatattttctaattttcattacagttttttgaccaattggttattttcacatatgttgcttaaatttctttatttagagctttttttttgaaaatgcttttgttattaatttattaattaattttgttttggtcacagaatattttctgcttgattttagttgttttaaagttattgagacttgtctgatagaaaaacaatagttaatctaggtgagtagttcatttgcactgaagttgttggatgtggtgttccataaatgtcagttaggttaagtttgtatgtggggtttttaaaaataaattaatcgtatttttagtgggtacataataggtgtatatatttataggatacatgagatgttttgatacaggcatgcactgtgaaataattacatcatggggaatgtatccatcctctcaaacatttatcttttgtgttacaaatcaatccaattatactcttttagttatttttaaatatacagttaagttattattgtctatagtcacactgttttgctatcaaataatagctcttactcattcttttaactatatgttttgtacccattaaccatccccaccttccacttaccctccaactacccttcccagcctctggtaaccacccttctggcaaccaacctcttgtccagtgttggaaaacaatttttattgtatatttattcctgtttttatttatggtggaagtgctagtaccaattactctctgtctccatgagttcaattgttttgatttttagatcctgcaaataagcaatttgatttgaatgttccttggtgtgtgtgtgtgtgtgtgtgtgtgtgtgtgtgtgtgtgtgtgtgtgtgtgtttattctgcttggatgcttggagttctggtgagattgcaggactctcttcatctgtctctcttctctcaacggtcacagttctgccctgcctcttgtccagtgtttgaaaacagtttttttttgtatatttatttctgcttttaagttatttattggtggaagtgctagtaccagttcctctgttatgaccaggattaggagttcttcctattaaaatttaattttttttccttttaaagataagatctgaatctatgtggagataaattttgtgcataatatgagttggcatacaatttcatttttaaaaggttacgaataagcattttaccacagttctatttatccagtagtcctttgcctaatgatttatcatgcctcctgttttctataggcaaattttcatattcatatatatgtgggtctgcttctgggttctctattttattgtgatggtcagttgatctatcactgtaccaatactgaactatcttaatttctatggcttaataataaatcatataaatcatattatctgttaagttgggttctctctcccagttcttcttcagaaatgtcttagctattcttggctctttattccctccaagttccttgtgaaatgttgcttttttgattagcatttctttggctgtatagaacaatttcagcgacagttgatatccttaccatattatgtcttgttttccttgatcatgggttaacagttcattttaaaattctttaatgactttcagtaatttttataacttcctcttacagatgttgcacatttttgttagatttatttgctattgtaaatgctgtcctttaaagatgttttctctaattgtttggtgtatagaaaaacaagtaacatttatagagagattttatatttgtttatctaaattcatctcttatagctaatagtttttctcaagattatttttgtttgttttatatataaacacgtaatctgaaaataatatctcttaatttcacatatctaattcttaggtttttttccctataattgtatattctagaacatgtagtataatgttgaatagatttgttaatattgaacatcattttatgttctgattttaaagcagttgctttacattttcccacttatggttatgtttattaaatgtactttgtagatcccttttatcaaaataaagcactttctttccattcctaatataattttatcataaataagatattaaatattatggaaagttttctttgtctctgtgaggtgatgacatgggttttctctattaatttgtttaacaaaattcataaattctgttgtatttagttatttagaatttgttttaaagatttttaacacttttatttagacattttacatttatattgacaaataaaatgaatagtcctgtaaaattttcttcttgaataatttttatttcttttcagatcaaaattatagtggatttataagacgagttacagtatgctccttttgcttatatttctaaaaagaacatgcatcttgtaaatttagtaaaaattgcctatgaaaatgttaagaacttctttgtgggaaaacctttaattcttttaatttttttcaaaagctaacagaattttcatgttttatttcttattgaattattttacattaactttaacaaacaaattttctaacttctaaaagttattagcataaaggaattaataatattctctcatattttagtttttactctgttgttaattatgtcactttttaaatcataatattgtttgtttgttgtcactctttatttctctctctctccaaatcaataatcccagaggtttgcctattttattattctttttaaataattgasttttatgtatattggagtctttctattttaacgaaacagctcaaactctgtagccagattctggctccagcaattactagctgtgtggttctgtgttaattacttaaactctctgtgcttccgtttctatctctgtaaagtgggaattatatccacctcataggttgttatgatgattagaagagttaataactgcaaagcactcgtgctgcctgacacatagaaagtaatatataaagatttattaagtaaataaataattgtgttaatttctgtccttatctccttccttgtatatttttgaaattaatgttactctctttatagattcttaggttttgcttctcttctaatataagaattggaagttaaatattttcctcgaattaccacttttgctatattctataaatttagctatgtggtcatcgttttggggttttgttgttgttatagttctagatggttttgaactatccattatggatttttctatgatcttggagttatttacaagtactttaaaatttttctctatgtaacaatatcttatgtttttgtttctatcttgtaacctttggttaagaacatagtttgttcttgtttagtatgtaatccagtttcgggactgtattataaatgcctgagaatgatgtgtgtttttatattgtctgatacgcaactatatgctcattaaattgtgttgttcacatcttctataattttggccattggtttgcttgaccaatgaggaagttccttagaaattactcacttaatagagttttagagttttttttttgtaattctatatgtgtatatcttgtgactaatttattaggcacatacttgtttagacatgcatgaattagatatgtgtttttgattcattaaatgctttcaacattctgtagtgattttctatattccctatactttttaattttgtcttttaattgacacataataattgtgcatgtttatagggtacagtgtgatgttttgatacatatatacattgtataataatcaaatcagcataattagcatattaattacctcaaacatttgtcatttctttgtgatgagaacattcaaacttccctcttctagctattttgaaatatayaacacactatctttaactgtagtcaccctactatgcaactgagcaccagaagtcattactcctctttaactaattttrtacccaataaacaacctctgcccttctccacctccccactactctcccaactttggtaaccactattctactctctactcctatgagattggcttttttaagattccacgagtgagaccatgtgacatttttcctgtgcttggcttatttgggttaacgtaatgtcctctaggttcatccattttgttgaaaatgacaagatttaagtcttttttatcgctaagtaatattatgttgtgttgtatgtataacacattttaaaaatctattcatccattggtaggcacttaggttgattctatatcttagttattgtgagtagtgttgtaataagcatagataaacataggagtgcagatattccttcaacataatcatttttcatatatagaagaaaacagttctaaacttkgtatggagctacaaaagatcccagatagcaaaagcaatcttaaacaaaaagaacaaagctggaggcattacactttctgacttcaaagtataccccaaagcaatagtaaccaaacaggttggtaccaatgtagacatggacatgtagaccaattaaacaaaagagagagcccagaaataaatacacacatttacagccaactggttttcataaaggtgccaagagcagacattagaaaaagtagtcttctcaataatgatgctggaaaacctgaatatctacatgcagaagaatgaaaatagacccttatctcttataaaaatcaactcaaaatagattaaatactaaaatgttagacccccaaactatgaaactaccagaaaaaaatatgggagaaacacttcatgacattggtctaggcaataactttttatgtaagacctcaaaaaaaagacaacaaatacaaaaatagactaatgagattaaatcaaactaaaaagctgcacagcaaaggaaacaatcaacagtgaagagacaacctgcagaataggagaaaataaatatttataaactatgcatctgacaaggggttaatatgcagaatatacaagaagctcaacaactcaataacaaaaaaaaatctgatttaaaaatkaacaagagatcttaatatgaacttctcagaagatatgcaaagagacagtatgtatatgaaaaatgctcatcactaatcaccagggaaatgcaaatcaaaaccatagtgagatatcacctcactccagttagaatggctattacaaaaaaaacataacaaatgctggtgaggatgagtagaaagtgaaattattttaccctgttggtggaaaggtaaatagtacaaccactatggaaaacagtttggtgtttcctcaaaaaactacaaatagaactaccatataatccgacaattccactactgtctatatattctctatactgttttgccttaatttctatattgtctgatagtgacttagtttttctttttattagaattgctttgcatatctcttcttattaccttcactcttaaagcctcagcctccttaaagcaaaatttgcaaagaagacatagcagatattttttccaatcactgccttcaaactgacaataatatttattgtgattgttaagaacttaaaatagagctaccattcaactcagcaatcccattgctgggtatatacgcaaaggaaaatagatcattgtactcaaaagacacgtactcatatggtcatcaccatgtattcacaacagaaaagacatggaatcaaccaggtacccatcaatggtggattggataaacgtggtatatgtatatactgtggaatactatgcaccactaaaaagtatttcattggccatggaatgctatgcaactataaaaaagaatgaaatcatgtcatttgcaacaatatggatgaagctggaggctataatgctaagtgaactaacacaggaacagaaaaccaaatactgcatattctcatgtataagtgggagctaaacattgagcacagatggaaagaaacatgtgttgtaatagacactgtgggctgggcgtggtggctcacaccgtaatcccagcactctgagaggccaaggcgggtggatcacctgaggttgggagttagagaccagcctgaccaacatggagaaaccccatctctactaaaaaaaaaaaaaaaaaaaaatacagatttagcccccagtgggtgtggtggcatatgcctgtaatcccagctgctcaggaggctgaggcaggagaatcacttgaacacgggaggtggaggttgcagtgagctgagattgcaccattgcactccagcctgggcaataagagcaaaacttggtctcaaaaaagtaaataaataaaataaaataaaaataagtacagaaataaataatagacactgtggactactagagttggtaggtggtgaagaggatgtgaattgaaaaaccaacaattgtgtactatactcagtacccgagtagtgagctcaatacccatgtaacaaacctgcacacataccccatatatctaaaaataaaagttgaaattaaaaaaaaaggaaatttgaaattttgayttaaattatccagtgttttgaggttttttaaaaaactctttttcaataataagaaatttaacagcttcataccatatcatcctgctattctctttcattcccattttggtttcttatatatacactttatcctttccatttgggagtgctcttagccttttaaaagacaaaataaaattttccaggtattttatcactcctacttcatgtatctcctgcagcatttgttaggtttgtttcttttcttatttggatactttatcacaaagtctttctaaaatgggtcattgttagacaaaaccaatgaagccttccttgtatgtctgaaaatatttttatgacgtttgaaaggcaatttgtctggatataaaatttcagatttaatgttcttttacttaaaatgccttaaaataccttactccattgtcttattgaaactaatgcttctgttgctcttgaaaagtctgatgtcaaattgttctgaaaggttatttgctcttttttttttttgagttagatcattttaactatgagcttaaattatttcagtgttcaaagtcattgcttttctaccatgatttgcccatctagatctcttaattttcagagtggctagattatatattcacgctgtttttccaagcaagccacttttgattatttctgagccttttatatcttgcaatgggcttcttagtccggaatgcacttcttgtggcattacataagttggagacatttactcctttctgttgttgtttctagggtataaaatggaaggtctgaaataaagcagatttttagttaataccattttttctctgtaagaatttgttatagtatgtattctttgtccaattaatattttaatcacaatatgtctaggtttattttaagaactttgtttagagtgtgataagtccctttggcttacagttgattattttgaaattcaaaagtatttctccaatggtgtcttctttgagcctgtcaaagttttgtgggttttctggtttgtgcattagttttcccagaattatctgtgattccagctttgatctttattctctattctctccacaccattccccttgtccttgtcattgctatctctgaccattcctttcacattgtcaggaagagaaggcttcccatgactgatccagtcttttcttcgtcaattccaatgctgggattagaggtttggttttgtttgcaaccctcccttaactccccagctccccttttaagctcagcttgtcattttttctgtctcttcctgtgactctccatctcagtctgttttcttccttcagttcttcataacagtttcattataaacatgtcctctgaatcatttggaagatgttgtttactgttgtgtgcattgttctacccatggtcactttctctagattgctcagcaagcaactgcaagccctgctgtaagatgttgagattctttgtaatctgtcttggccaaatgtgctttgctggtgggcattatgggtgccaggattcgacgtgccgttgcctgtctcctttctcctccacttcctgttttctgtcttcctgtttcctggtaattgttttccctaaattaatttagagcattttctgaaaatatgtttcagggaacactagttcttcaggatgtgtatagatgataaatgaaaaataaaaatgccttgtattcaagtgcatttaagaaatattgaattaaacaaaatcattacaggattgtttactaaatggcttctgagagcctttgatgactgtggctttttgagataggactagatgaagctctctgaggtgcgtcttgtaagactgacatgctgcagaacaccttttagaatcttttgctgtcatatgtttggggagatgcagaaaatggtctggctgccccaggaacaggaagcacacagtagaggaattgctatgtactattcaatttgacataaaccttgggcctccaatttcaagaacaagcaaagaaggaatgaatgatgttagaatatccttctgtggtgattcagagtggcgaggctgtcctgtcttttgaacaaaagcataggtagtccagtgattatatttctcgatccatatccatctacctatattcaagggaaattcctaatatttacagtgggatgactgtcagtattgtcttcatcttttttctatattttcatcatttctgtgtctttataaatatttagttagaagttgggggagaatgtgtcatctgccattttcaactggagacctatgtaaatagtgcaagaggttggtaagtaatccaccttgaatttgctgtgtctttcaggcaggaaaagcaatcacttggcagtatgtcagcttcacacttctacatcagtgtttgacctcaagggcatggctatactgtcttatgattacaggaggcaaatgcagggtcttatctccacatcagctgcctttacatcacttgggtctattagcacccagtggtaaatactactggctgcaccgcaggcactggcttagaagtaaaactttgaatttgccattgccattacttaacccccatcaaaggtagattgagagaaacaacacttttagtagattacctgacagctattcaatctgtcaatcctttggacactaacgtttataatcagcaagattcttccagtggagaattgctttcctctgtgaagatccatttaatcaaatatttttggtgtgatgtcactggctttcattcaagagcatgattagaaacacacttataaaattcattattgactttattgtgaacatgatcctgaaaacattcactgcctgacacacattttctctttagcaccgatgctctgagattcaatctcagggacggaaatagctgtgcttgtttttgtcctatgttataaatcatataaatgattaggttactgatcatattaagcagctaaaatgatggataacagagttgatatttaaatcattatggcaggctgggtagaggctaaccaaataacctcagcagtggaaaatctacagccttcatttgggtaaaaacaatccattgaaacacctgttctgacagagagattaattcagcatttccaaaagtgtgctcggagatgctgtccttcaaggagatgcttcttgaaggaaagaccccggagagaactaagtatgggaaatgctgcatgttaaatctatcttatcatgattcacaatacacattagcatattaaaagtctgtagtaaagaaatctgtttaattctgttgtttccagtttttcttcctaaattcatttaatgcagggcttttgttcttgttgtcattcctggtaggacccaggactatcccaggaatgctctgcagagttcattttagaaaatgccaggttaaatcattcaacctaagaccagtgagttttccttcccactgttgattgattctcactataataatgcttttattttttcatatagttttcattacctttaccatggtagtaatagctatcatttgtggagtattttgtatgtgccgtaccttgtaaaygttactatcagtgagcgtagcagagatgccaaatggtgaagccctgcagagaccatcagaccctgaagaggctggaaaactcacatgatagctgttggtccaagggcagaactggattcctccagtcatgtctttcctgaccttcttccaggcctgggctgggttatgcagataaagttatgagtaagaaatatggtctttgtctccaagagcttaaaattgagatcactgacagacaatgcatgtaagaggagctgggtaagagactccagaagagaaagtgattgcttagtggaggttcaagtgcagcttgattgcggagagcacacctgtgctgctggatggacagcagctgctaggtgggggcaggctaaggatccagcagaagatgcaccagcagagtccctgcaggatgccactcaaggagtgcacatggaagtgccaggagttgcttctggttgaggcagtggatttcgcatggctggatcatggaaccctttgggagaggaagatggaaattggacgtggaaaggcttcaaagcccatcgagagtgttgagctccagaaaggaggcatgcctgcactctggagctaatatgtggcacttgccagaagttgtatcatgaaaaagctaagggagggatgggacaagggtgtggcagagccctgaagcaggtactgatgacatcggagtaggcatctgacttaatctgaaatgtttcatgccttcctcactgccatcattgtgacaggcaagtgctcctgctgacacttctctgtctgctctgctggcccaccttctcagagccctgtaagtactctgacgggaactcagaataagggtcattgtggcctactccctgcaggactctgggtgtcatttccatcattccactgggataccaggaggaagaggcttcgagcttgagaggaagaacacagcttcctgagaggtctggagtggccctgcctttgaacctgccccatggatctgggtgcttggacagagctgcagcagtcacttcatttagccagcattgtgaggagtggaaagagagagaccaggatcctgaggccttcggcacctctcagctcagatctcaagctggattcctccagagtcataaaccctatatcctgccagagaacaaatcattccagcaagaaagaggattctggcttccagtgtctgatgacttatgaagtgcagccaagagtgaaaatcattttaaaaatattgaaaggcacctcgccagggctccctccactggtggaaatatgaatacaggatttatttgaggccccaagtgctgtggcatcatccagagatggggacaacactgtctgcattttagagctgacagctacaacttgtttcttcctgctgctgtggctgcgactgctgccaccgtcaggagcttcgagcatcagggcggatctctggtggcactggcagttgaggcataatccttcaatggtgtagatgatggtttcagggaggctgaggtcccaggcctgtggcaggaggatttggggaaagccatgctctgtggtttggccagcttgggtagataacttaagttatgcactagctcatgaatacacttaggcttccagaacctaaggtgaggacactcttttggactggctccctggcctcctgcctgggggccccagggactcagctgcttctcttatttctgacactgcatcttccccattggaccacagcccagccctctccctatgccccctgcacaaaagcccagggtcccctggctttgtctcttccctaagctgaactatttgcttttcatctctgtctgttgttttataatctcttctttgaactcttgtatctcttcttagatttctttttccttcaagagaccatgttctctgtaacttttttgagactggggagaatatttgcctgaactattaatcttttttcccctaagagataattccttgtgatcgattgttacattttctttatctgcttttctccccatgctggcttctccctcccttactcatgatttggggacattctgttcatatatatattgtcactttctttctggttatcattcaccttcaaagagagctggctccctgtttcagaaagtgtagggagggactggggaccagggtcaggagcttgctggggccgtccttggcttctgtgagaattggtgagttctctctttccaagtttttgattcactttgtcctggatgtgtatctctccataattttcaggattcaaaatggaagggaactttcagaaaattcttctaagatctgcattgcgccagtcagggttttggcctctgccttcaggtcctgtgctccatctcgccatggggcatctttcatggcctgggtgtggctggaaaccacaacacagtttctgccttgcttggcctcctgttggatttgggggccaacctggactcagtcacgtcgtctgtgggctccctgaaatgctcttatctgaggacatctgtgttctgctcggacctgagctgccaggtgggtatcgatattgggtgtcactgcctgtctggtgtgcttctgtcaccatgggtggccatcgctagggatgaagtcactcgttgtctctgggaaaggcaggattagaaggggagtagataaccatggaggcagtagagtgtgttgcccccaggccctcaggaaggctagaaccaaatcccagcaagtttctctactctgctcagagagagcggggctgtgcctggtctctaaagagcagaggagctggggagagagggtcctgtgcagccaggacaagggcttggtcaaggcacttgagaggttgtgaggagcgggtggttgagaagccgggtggccctgcacagtcagccactgctgttctctgtctcagatgcccaatcatagagcagggaggtgaccattctcatatgcacctgacccagacagaaggcgaggggaccaagggcctggctgctccctgccaggaggctcctggtctgactcaggacagggcctgccccaaacctagtgaccccagcatcccctggtgccccatactgacatggcctgaactccacacccttccccccactccctctgcccagacaggaccttcctttgatagaaacatccttttgccccactctgaatctccttcatcatctgcctgtcctgcagtctcctcacagatgcagaccttgtttgtttctttccagtttccctttcccaaggcctgaaatggcctctgggtgtggagccaggtcccctgaggacaattgcctagtgacaaactgctggggcttggcagcctctgtgtcatctcatttaatcattctcttgttccgtctatatttattgagttcctggtatctgccagtcatggattcaggtgctggggaatgacaggggacgaagggaaacacagccttgtcctcccacatctggggctggccctcacccgctttggtggacaggctcagtcatgctggagcgctgtgataggagaggtgggtggacccaggaacatgcagcagtggtcccagcctggctggaggaggatgaattgcccactgggaaaagcttccagacaaagtaaatctaagctgaggccagaggcagagtcaggaaaagggagagggctctccggagatggaagagcaggtgtggatgccaagagccatgagggcgggtgctgccactgcagaacttggggctcttcagcctgggggaagccagagggtcccagggcctgatcactcagacttgcaaactgcacttgtgtttggactgtaggtttgcattgaatgagatcacagtgccacagtgtggggatgttcaggacccaccccctgctcttggcctctgctaccctgactgtgaggcccctaaatctcctgggttcctgggggattgtcccatccatgggcagttctgaagccagcctggttccttcctctcagctgtgaaacctgaaagtgtttgctgctttaattgtggcaaaggaattcataaagctacagctgaaagggcatcctctgaagcctgcctgtgtcaccagaggggctgtttaataataggaagcatacttggatctgggcactgcacagggagctttgagacccattttcaccctaagaggtggtctttcttccaagctgccatgttctataaattcaagctgagacccagggagagagacacctctatattatccatgattctcctggatagtgctgcccagtctggagtgctcacaggtcctctccacactgcggctgctctggcatcttccccagggccctctgggtgggcaccagcctgcacacggatggcggtactctgtgcagtgtcagctttggcaggtgtcttggctccagagccagctctgtggttcctgcttacacagtcacaatcctgaaatttgaaaatagatcataaatagacatgtagatgacctgaatccaagcagagggggcaccctgggggaagaagacaaagctcatttatttatttatatttacttatttatattctgcctccttcccgaaaaggatttctgacagtttacagaaacacttaatgtacaatgggaggtatcttttgttttttttccctcttaatcaagaaatgggggaaattagggcaaagagaaaatgagggcagagatgcaagatgaaactggtggaaagctaagtatacaaatgcatgtacccaccctacctcccactgaccccgagttctctagcttagttttatttctcagccaagtcctaacttgggctgacatctccaaagcagctgaaagccctcctggctggtgcagtctggtgctcagcaactcatctgcgaaggacttgattagttgctagaggtcagctccagacactccatatgtgcctgtgcacctccaactagccacagtgaggaggcaaacaggtcccatttcacagtgcaagactttcctaacggaagaataaatcagtgacccagaagatgacgagacttcccagacctctactcaggcctgaaaaagtctgtgggtaatgacttatgtgtgggacaattagggtttgcctgtcactgtggagtaaattcatgaggttggccaagaaaacttcactggccccactgtgggccagccacattggttgatgttacagataagaccgtgggcagacagactcatccctgctttaatggggaccccactctttaggggagacaagaccataagaaagaacacacctaaacataataattaagtgctaagtaggaatagaggggcttccaaagtgtgctttgggagcatggactgcggacaaccgtgagcctcttctggccaggctcactgcgcctccctgccttggccatgttttataagaaaagtttctcccacagagaaagagcaaaccatgaaaggaaaaggctggcaagcatctaggcagtcaataattcctgattttttttccccctcattcatcagctcttaattggtgtctgctgtgtgtcagacattctgctaaggggtaattaaaaggcaaaataacttctttttcttttcttttctttttttttttgtgaagtttatagtctccagagggtgaccgatgagttagcagatccttgtgatgtgctcagtattttgcaggggtaacaggagacaagagcaaagagcggaaccagggccagaccctggggagggatttggaaatggattctgtgagccactggggaccttctcagtcccaggagcagaagcatcgggagtagaaagaaaccggagagagggagtggctggtggtgtgggggcccctggctgtcagatgacagcagggcacagcagcagagaggggcaaggcggggtgggcttggcagcagacccacccatttaggccggctgggtgatggtggggatgcaactgggcagtgtgctgagctgaggatttacctggctccactgtggtccacacgagtgggtggtcctgtgtgtctcagaagcagtggatgtcacagagctgggcaggctcttggaagggaaatggagctggctgggcaggagacacccacgacatcagccccttgttgttccctcccaggattcaaagcagagctccagttcctgtgggagggatgagtgagaggaatgaggcctacatttttcaaatccagcagggaggtgggtgcccagccccaggacatggcaggagctactcaggccgctagcttcacccacaggacctcttatgaactgggtccaggtggacagcagactcagaggaaaaagcagagtgcatggccaagatggacctgaggacagagtgttcagatccaggcaatgaggatgtcagcaccagtaggcccaactggatacctgggagtggccagggcaggggcaggcacatttaccaaacccttccaggactgtcctggattcactatgtctgtgatctcaccaccacactgcatgaatgggaatggtctcttcagctaccaatgggaacaaggctcagagagtgtataagtaactcactcaatgtcacagtcgtcttccatgggtgctgtgctctaaccagggctgcaaggcattgatgggagatggtggatggcagctgggaggcagagggggagccctggggcaagccccagccatggctctgcccccagctctcacaggtgtgacctccaggcaggctggagagaggccccatttcttaatggctggtttattttcaggttgaaagcttctccctcccaccacccctcctccacgccctgccctttgcagcctgggccctgggaggccatagtgacacccaacactcgcagcaggttcattgccttctgcacaaatctccttcctatcagccgggtcctggcggggggtggggcatgctaatctaatcggccctttcccatctgtaattactgtaatctataacaataattacagtccattttattttagtgccgcttatctaaatgtggatgtgcactactgagattgccaatagaaataagcccctgggtgaggcagcagggtgggagggatgtcggggagaaagctatgccttgcgggcccacgtggttccaatgtgctcctctccagccctttgctgccctcctgaggcaccctgctgccctgtggagtccggcatgcctgcagggggtggaccactgagcaaccaggaaagagcaggggttgtcacatcaatgctagagtttagtgacttccctcggaacaggttatcttgaatcctagagccagcatggcagctgctacaaacccttttgggaacagggatcatgccctcagcgcccagtttctcagatgccaagtgcagtgtctggtgtgtggttggtgcctaatgagtgcttggtgaatgatgtagaaatcacactaaaatcatatcgtgtcacttaggctggctattgattcaggcagctttcccttcatgaatcaggtctcactgcctctgtaatttggaaagataactacttgggggaatatcatgaaaaaaattcattttatacagcatgatgtagctgggctagagattgtgtgtgcatatgtatgtatatggtgtgtatgtgtctgtggtatgtgcatgtgtatgtgtatgtgtatagtatgtgtacgtgtgtgtgtctgtgtagtgtgtgggtatggtatgtacacgtgtgtgtatgtggtgtgtgcgtgtgatgtgtgtgtgtctgtggggtgtgtgtagtgtgtgggtgtgggggtatgtgtgtgtgtgcatttgtttaatgcactttgggctgctgttgcctgttcttctggtggaggagagccaatctgtctttggttttatcctgagtcacataaagttcctgatttcaggtttgggagtctgggggtggagatggctgtggtggtaaagttgggtgtaaaccatttattaccggggcttcaccatgaagtccaatgaggctgctttactgaatttactaggtccctggaacactgaaaaaggaagtcagtgcctgtccttggcgactggaggagacagatatttcagtctagcctagaagccttagactccagaagtcatgatcccttcaatatttaaaaacagcttgagatttcatccagcttatggaggggaacccaaagcctgccacggcagagctgtggtcattctcagggaagccccttcctagtccccacttttcttgtctctttccgcgtccatggaattcatcttatgattattttgcttcctgctgtgggtctgtttcctctgctttgctctgaaccactgtggaaccaaactcttttcctttgatttgtaaaggagcttctaacacagggctgctgcaacagcagaatttcagtgaaggtttggagtgttcagagaccagcatagtgaattccttacctgaatatttagcctgtaagtttaaaagcatttccatcccgttccagtttatttctcattcgtgtaaaatccaaaatgagtgttcctgattgctagggtgcacaagtgtgtgcatgtgcatgcgcctctcagtcaggccaggccccagatcaaatgactggttcagragccatgctgggtgacattatgctatctacatacaagggagagcatcggggatctcctctgcaattgtgtagccagacttagaagtgtcacctgtcacatctcattgagcagaactcagtcacatggccatggggacaggaaagtgaggctgaaaatgcagtccaattgtgtgctcagagaaaaaaaaggaatcttgataaccagtgaaaacactattccatagttagcccttgtgtttaccaaatgtttcatttattttcgctcacatagagcatgcacacctcgtccttaaagcagacaaccttcaaatcccacccagcctctagatccattcaaaagcccagaacttctggactccatcagcttaagatgggctccttgctgtactgtgactcaggagcttaracaagcaaactgatgctcacggttgtctgcagtccatgctcccaaagcacaccagacacggtcctagaattgggacaggataaatgcagtaagcatcccacttggtagaagggggaaagggagatgcacggccatcattcagggcgttgctgaattcctgggaagccccatgagcacattagccatggcggtggacagagtgccccggacagactctagttctgtcccctaggaagaactcccttgacccattgtcctctgtggcctctgatcctctgtctagaggtctgtactacccattagcctcctggacacacctgaggtgcatgctgtggagtgtttatgggcttgaggattggtttatgtagtcagagcctcagagatgagcaaagaccccactattgaaagtaaaagttctttaatttacatctggcatgcttttaacatcttgagctagatgattcctgtttagamcctcaaaataattcttgcaagagaaggttcatgtttcagttttcttaatatttacattatttcctttgcaagatgttccccagctcctttttaatctgtagcagattttgctgaaggtttgacatgttggagagtggttacatcacagccccacctaggaaatcacgaagaagctgaacattacatgctcttgttcttaaaaggccctgggccccctgatgccagcgatatctcccaacctcaactaaccaataacccccacatgacatgcagcatcctgggagtggccaggctatctcaaagaatgctcttctctgggtactcttgggaggttttattttggctcaagtaagcttctggtgacaacagctttatatatttttttggagtaaaacaattctggccatgctggatgagagggagttttgggcaggtccctgattgcctatttgtctgtgcactgaagcagactcgtggcagttttctaaagtgatccctgttcccaccagtggtaatcctcagctcacctcatgacacaaggaagaagtgtttttagcaagatccttggctcctacaaaggtatgtcattttcattctggtttattttctgtgaatcctcagaggttagtcctcccctggcaaccacaagagctatattcagtgggtttctgggcaatgccacgacagtcctgagctcactgtctatctttctgtccataaaatcagattcgaggaactccattcggtgaggattacatgaaggatgagaggtcttgccccacttcttgatattataaacctgtgtgtggtcagtctctctgtcagagagtagcgccttcagatgcccagccctctctgcacccttggcagaactggtttgagcaccttgcactttacctaagaaacagggtctgggaagcttcttgtcgccttcattgcaagggtgctgctagcgatgctgttgtccactttgcttcacagagtctggatatatgatcccccgggagacagtcttttctaattacaatgccaaaaacwgttttaatccctcagattgagttgttggcacttattctctggggatggtgcatttggtgatgaatagcatttccctgtttgtgccaactgtgactcctaggaggctgagaagaaaartgaggcccagctgttggagacgtggagagatcatctttttaggcatttctagtgccgttctggctgtagtttatttccatccttattcattttctttcttcttttgatcccatgtcaatgtgtgtcttttattgcaattaactgggtcagctgcccaaaattcctcctggaagaagatttagacgtgcacgtacactaatttgtacttgaatcttttctagaatagtctctgaggcccatgtgacccrgtcccctgtgacatccctggctccacagcagctgccctggcagtattgcactcattttatgcccaccaggcatgcatctacgtcagggcctttgcactcgctgctccctcagcccagaatgcccttcccctgatactcatttgccttactgcccccaatctttcaaggtttttactcaaataactcttcttcaatgagattcttttgttcacttaacatttcaactctaacacttcccattgctcatcccatataacacctgtattagactaccttcactaaattgtaacatataagacagcagtgatttttacttgtttttttaattgctgggtccccaaggtttagaacagggcctggcatgctcaataaacatttgttgaatgaatgaagaaattctgttttcaagctgtcagtagacaatgatactgcccgtcctacagagatctcataaaaggcattgattgtcaattttccaaacatttccttgcatgatgttacaatgtggattctgattactgtgtaagtgcgtgtgtgtgtgtgtgtgtgcatgtgcactcacatttcttgtctgagggtcagttgttaagtgtcgtaattggtattattgctgttattgtgattttgggctaattgcagtagctcccagacctggctggctttgtaaacattttaaaaatgttatgaaattattatgagaacattaatttggatttattgtaattaaactttaaattttttgcctttaggaagattaattttgacaaaaaagactaacaaaaatagatcaaaccaatgttaaactgttgagaattcctggcctcctaaataaccattgaggtctggaagagcttgtcagggcctagtgattaagatgatggattctaagcccagacatttttgtgtataaatccaggcccagcaagttactgactgtgtgatcttgaactagtttttggtttttttttttttcaaatgtacaatatatctctctttcttcattggaaattgaaggccatgatacttacttcacaggcttatataacactgtcctctgtgtaaaatgcccaacatgaggccagccatgtagtagatgctctttaaatacagattttactcaggaggcttgagggaatgagttagcatttcctgagtcacatgctgtggtctgaaagtttgaccctcagtcacccacttgttacctacgctccagcatcacacaggcattttatcatctcaaccaccacgtttgcaactggccagccactgctatactgcagctcatgtaatcaataatgttgtattttacaaaagtagattattcatttgtcagaracatactacaaaaaagtaactatatggatttcagggaacaaaggattaatttctgatggagctaatcatgcttatgtggcatagtgggagcacgcagagatgtctcaatatttgaagggaaatgttcttccccaaatgatattatgactcagaagtccaggggaattagctttagtctccttctagcagaggaaaaattatccttaatttgatattgattttttaaaattgggttctgctacttttactttccatctgtgagcagagattcaaatgccagcttttaatcctagaagcacctacttcatttccccttctggttggggagatcaggcgagccctccaaaactctgtagagattggaggaaacttcatgtaatagagaaaatcattccttcccaggagtgggctcctgagcccagtggctgcttggccctcctttggaaactgggtttccaagcactctggtgttcaccatggacacacccctgggccaagcagggcattttctggtctctctttacaagaccacacttgtgcaattataatagcaacaactatttataaaacactatgtgccaggaagtttttgaatggctttgcatcaaatgcctaatttaatcctcagaacaccactgtgacttgacttccatgattaagcattgatattgaccccattttacagaagggaggcgtagctcacccaggatcccacagcatggcagagtggaaatagggtctgacctgtactatctgcctccaggctgggtgttcaggaagctggctcagaagtgccattgtcataactaaccttgtatgaggcccatggtgtgccaggcatttcgaaaacatcggctcagtactggtaagcagcagccccataggagggattatcatccacatcctagtgatgggggagctgaggctgagtgaggttaagtaatgtgctcaaggtcacagaatagtaattaggagaaacaggacttctgccccgtggtgcaggatgagaaacagggctctctgtaacaccagattataccagttcttctcactccagccccacttcctcctctacctcctccaggtaggcctgggtttgtaaatctgtgggggatgtggtggccattgcatctgggcatgttctgaatcccagctgctgatggctgtggttctggtctatctggactgcagtgcccatggcagcaaggctctgagtggacagtggcctcgcagatcctcctctcctctctggtaaatttgctctgatgctctagggctgggattagacaacgatctcaagatgtcctcccaatgccaagcatggtgcgaggtagagctgctctgccccttttatttcatccaatcttgacttggcactgctgagccttaagggagcacatgacatgggctagtgcctggaaagaagatgggatggagaatctgcatggtgctgcacctgccctagtcatttaccccttccctttctccggcaggcatctttccaacatcccacagactctgctagcatgcaaagccaaccaggtccaaatgcaaaggactgcttccctgcacatggtgccttcgtagaaagcacccatcatttccatgtgtaactttccttttccctttccgtcttcatctccacagggctgcattgccagtgcctgttgtgtgagattaggaggtattagtgactgctcattcaggggcaarctcatagaacatgcctggaaggggcagttaggacctctttagatgatgtaattaacctcgtcacatttctgcttgtagagtggataatgctgtcaaatgctgtccaatctttctggtattcaacatattttgattaaaacagaaaagcccagcctgggccgggagaggatcagttgagcctgtcctttctgatttgcaaaggagtctatcgttacctgggtgtctgtccttctgaaacatctgggagtggtgatgtctgctgggagcacagggcctggcatgcagtagccagtgggtactcagtgagcatctgatgcctacactacatggtagggatgaaaccctggcaggagaactgagaagactcccatcaagttagagagatttcactctcctaaggcaggttttggatttttccagtagagtgaagcaggggaacaaaaattgagtcttgttcccatttgatgtgctttatgtgtttgcctggaggccttcgtagactgagaaacagcagcaaattcgacaaggtcctcctgggccggggcttccgagctacattttccttccttgacaggcagcagagctttttcacccaacttttctccaacagcagcttggttgcatgaacagcatgaagaaataaaagtatttaacttcactgaagacattttgaaaaatgacaacttaaatcatttccagaactgttttttgtttaaaggcttggctgcttctcagacttcatagctgctttcttctccttcatcctcctctaaatattattatttcctggagatgctgtctttattccacactcttcccagctatatctgtctggtcttccatgattaagcactgatattggccccattttgcagaagggaggcatagctcacccaggatcccacagcatggcagactggaaatagggtctgacctgtactatctgcctccaggctgggtgttcaggaagctggctcagaagctttgaaggctttttgtatactttttctgtctcagaagtttctctaaaacaccttgctatgttgtttttactgctgggaattcttggttttctgttgagtgtaagttaaaatacaaatcatcagcacagcacacaggtcaaacttgtctccttgccctgaaattgttttgttttttcctcttcccatgcactagaaagtgagttttccgaggtcaggaactgtatctttttgcttatcacactatcctggggcgctataatgatgagcagaaaagggaagcacaatgaattattttttgggggtgaataccacatggttcctgacaacctagccctggagtggcatttcattcccagtgacacttcattcaatgctgtccccacctcycaacccctgctctggcctacctcttaccttgctgagccacctgttcctcaccttgtcactgcatggccctggtccccatcatgattcccactggagtttctgcttgtctagcaggtgtgccagacacgggttcatctcatgcccctgagctctcacagctgctctgacacttccagagcccctccagggccagtgccaatgctccctgtgtgtgctcctcagaaccccttttctcgtccatgtagttctagtcccattgattccagcttcatcttttatttatctcttgaattccacaacagaacatagtgtcttccaacagatcccatggacaacagaacctgacaccaagatgcccaagaattgttaattaatgagtcttgagatgatagaccatgtacagaaatacatttggggtgtggatttattctttcctcaatatcatccccctagttttaattaggactaaatttctgcrtacaagagtgtctgatgattgctgaatgcctgtctatcactgctgagtgatgttgtgtccttggctgtggtaaccaacattcctcatttgcccaggactaaggaatttcctgggaggtaggactttcactgcgaaaactgggagagtcccatggtcagttcatcctcctatcctgagctatgaccagttgagaagtctctttagtaggcaaaaagcaagtaaattggcaatttccttttacatgaaatcatggctgttttctccattagattgtaatttctatgaagacacatgatgagaacttcaaagaaacaaaacaagacaacaatatgacatgggtctccagtccttgctgtatgttagaatcacctggaagctcttaaaaatcccagtgcccaggtcctaccccattctacttamatcataagcccaggtgtgggagccaggcatcagtctattttaaagtcttccaaggataccaatgttcagcaaagttgacaggcattatggggactcctagaagatatgaatggatttgttgagtggacagtaggctggaggtaggcaaagctcttytggaaatattacaggctgggagaaaggagggcccaggggagagagtggaccccaggtttttgtagcattggcctttgcccactgctaattctgggaacatccccacctccctgatttagatgcccacttattagggcagagggcatggttggtaggccagaggagaaggtgcccagctgtaattatacattaggttggagaattagagaggaaggtggaggtttgtgctgatataggaccctttcccattacaytgggaagkaatgcattttattgtcaaatttgctgtttgtttttatccagataatgatttcagctgccaataccacagtttgttgtagctataggtagcaaatgcatttctttgctagcctctcactgtggtctgctttctgcctccctgtgtccccagaaagcttggctagtgagcaagccacacaaggactagcagacttgagattcagtggacacagcagagatttgaggactatgccagaacatggctgttagcttcatccctgcctcactttactcagttcagagagccagtgcccttgcaggccaacctcctctgcgttggcagaggatgttgggcacctggatcaccggtagcatttgcttgttgacatagaggcttgacaatctgagttagggctgcggtcgctgcgcttggtagagtcctccattctaaggtgtggcttccaagcagtgatctccccttctgctgcctcccctcggctgctggctatgtggaggtctcaacacaggccaccccagttcttgccacttccctggagaggtgacctcagctctgccccagccaggaccctggcactgtcttgcgtgtgtttctatttttctcctaagtggagaaggtgggagagtatttcatatttatttagtaaccttttatatttttctctgctatcaattgtctgctctacgttctttgttgtggaaagcatgaaattgatctgagcctcacttctgtcccttataaaaagggttgtttttaggattaatttttatttgacattgcataggtgaagtgcttattcctgggcccataacatcaagagctgcttgcttatctttgtagtcttctcttggagcagcaaaggccttacaccaaccatttcctccagcaggcaagggcatcgtagttaagaacgtggaggtgttgtgcctaggttgggacacaaacccaagtctcttcagtgcatggcttctaactagaccatctggctaactaatgagaccaccaatgcttttttgagtatgttttttttttctgatctcagttacatatatttaaaaaaattcattaggttaaatctgttttgattgttaaactatttgattatattatatattcatgtggtgcaaaaatttgaacaaaactattatatagtgaaagtcctgctccccacccacaaagagagtgactcttttgtgtttagtcctcacttccaccctgcctgaagagatgcctaatgttgttattttctcatatacagttctttaaaccaaataaattggaatagatatttctcaacccccttttcaacaatattcttttacaaaaaatttaaaatttttaaatgatttcaactattattttagattcggggggtataggtgcaggtttcttacatggttatattgtgtgatgctgaagtttgggctacgatggatctcattacctaggtagtgagcatagtacccaatagttagttctgcaacacttgccactctcccctcccttcctcctctaggagtccccagtgtctattgttgccatcttttttttaaattttattttattattattatactttaagattttagggtacatgtgcacaatgtgcaggttagttacatatgtatacatgtgccatgctggtgtactgcacccattaactcatcatttagcatcacgtatatctcctaaagctatccctcctccctcccccgaccccacaacagtccccacagtgtgatgttccccttcctgtgtccatgtgttctcattgttcaattcccacctatgagtgagaatatgtggtgtttggttttttgttcttgtgatagtttactgagaatgatgatttccactttcatccatatccctacaaaggacatgaactcatcattttttatggctgcatagtattccatggtgtatatgtgccacattttcttaatccagtctatcattgatggacatttgggttggttccaagtctttgctattgtgaatagtgcctcaataaacatacgtctgcatgtgtctttatagcagcatgatttatagtcctttgggtatatacccagtaatgggatggctgggtcaaatggtatttctagttctagatccctgaggaatcgccacactgacttccacaatggttgaactagtttacggtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttcagaagtgtctgttcatgtcctttgcccactttttaatagggttgtttgttttcttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagattccatttgtcaattttggcttttgttgccattgcttttggtgttttagacatgaagttcttgcccatgcctatgtcctgaatggtaatgcctaggttttcttctagggtttttatggttttaggtctaacatttaagtctttaatccatcttgaattaatttttgtataaggtgtaaggaagggatccagtttcagccttctacatatggctagccagttttcccagcaccatttattaaatagggaatcctttccccattgcttgtttttctcaggtttgtcaaagatcagatagttgtagatatgcggcgttatttctgagggctctgttctgttccattgatcgctatctctgttttggtaccagtaccatgctgttttggtgactgtagccttgtagtatagtttgaagtcagatagcgtgatgcctacagctttgttcttttggcttaggattgacttggcgatgcgggctctcttttggttccatatgaactttgaagtagtcttttccaaatctgtgaagaaagtcattggtagcttgatgggaatggcattgaatctataaattaccttgggcagtatggccattttcatgatattgattcttcctagccatgagcatggaatgttcttccatttctttgtatcctctttcatttcattgagcagtggtttgtagttctccttgaagaggtccttcacgttccttgtaagttggattcctaggtattttattctctttgaagcaattgtaaatgagagttcactcatgatttggctctctgtttgyctgttattggtatttaagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataacctttatttccttctcttgcctaattgccctggccagaacttccaacactatgttgaataggagtggtgagagggggcatccctgtcttgtgccagttttcaaagggaatgcttccagtttttgcccattcagtatgatattggctgtgggcttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagcctkgcatcccagggatgaagcccacttgatcatggtggataaggtttttgatgtgctgctggattcggtttgccagtattttattgaggatttttgcatcaatgttcatcaaggatattggtctaaaattgtcttttttggttttgtctctgcccggctttggtatcaggatgatgctggcctcataaaatgagttagggaggattccctctttttctattgattggaatagtttcagaaggaatggtaccagttcctccytgtacctgtggtagaattcggctgtgaatccttctggtcctggactctttttggttgataagctattgattattgccccaatttcagagcctgctattggtctattcagagattcaacttcttcctagtttagtcttgggagggtgtatgtgtcgaggaatttatccatttcttctagattttctagtttatttgcgtagaggtgtttatagtattctctgatggtagtttgtatttctgtgggatcggtggtgatatcccttttatcattttttattgcgtctatttgcttcttctctcttttcttctttattagtcttgctagcagtctatcagttttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgacattagggtgtcaattttggatctttcctgctttctcttgtgggcatttagtgctataaatttccctctacacactgctttgaatgtgtcccagagattctcgtatgttgtgtctttgttcttgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttatgatttcttatcttttacatttgctgaggagagctctccttccaactatgtggtcaattttggaataggtgtggtgtggtgctgaaaagaatgtatattctgttgatttggggtggagagttctgtagatgtctattaggtccacttggtgcagagctaagttcaattcctgggtatccttgttaactttctgtctcgttgatctgtctaatgttgacagtggggtgttaaagtctcccactgttattgtgtgggagtctaagtctctttgtaggtcactcaggacttgctttatgaatctgggtactcctgtattgggtgcatatatatttaggatagttagctcttcttgttgaattgatccctttaccattatgtaatggccgcctttgtctcttttgatatttgctggtttaaagtctgtttatcagagactaggattrcaacccctgcctttttttgttttccatttgcttggtagatcttcctctatccttttattttgagcctatttgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacaatttggcatgattttgcagtggctggtatcggttgttcctttccatgtttagtgcttccttcaggagctctttcagggcaggcctcgtggtgacaaaatctctcagcatttgcttgtctgtaaagtattttatttctccttcacttatgaatcttagtttggctggatatgaaattctgggttgaaaattcttttccttaagagtgttgaatattggcccccactctcttctggcttgtagagtttctgccgagagatccgatgttagtctgatgggcttccctttgtgggtaacccgacctttctctctggctgcccttaacattttttccttcatttcaactttggtgaatctgacaattatgtgtgttggagttgctcttctcgaggagtatctttgtggcgttctctgtatttcctgaatctgaatgttggcctgccttgctaggctggggttctcctggataataccctgcagagtgttttccatcttggttccattctccccgtcactttcaggtacaccaatcagacgtagatttggtcttttcacatagtcycatatttcttggaggctttgttcgtttctttttattcttttttctctaaacttcccttctcacttcatttcattcatttcatcttccatcactgataccctttcttctagttgatcgcatyggctcccgaggcttctgcattcttcacgtagttctcgagccttggctttcagctccatcagttcctttaagcacttctctgtattggttattctagttatacattcgtctaagtttttttcaaagttttcaacttctttgcctttggtttgaatttcctcctgtagctmggagtagtttgatcgtctgaagccttcttctctcaacttgtcaaaggcattctccgtccagctttgttccgttgctcatgaggagctgcattcctttggaggaggagaggtgctctgctttttagtttccagtttttctgctcttttttttccccatctttgtggttttatctacttttcgtctttgatgatggtgatgtatagatgggtttttggtgtggatgtcctttctgtttgttagttttccttctaacagacaggaccctcagctgccagtgtgttggagtttgctagaggtccactccagaccctgtttgcctgggtaccagcagcggtggctgcagaacagcagattttcgtgaaccgcgaatgctgctgtccgatcgttcctctggaagttttgtytcagaggagtacccggccgtgtgaggtgtcagtctgcccctactggggggtgcctctcagttaggctgctcaggggtcaggggttagggtcccacttgaggaggcagtctgcccgttctcagatctccagctgcatgctgggagaaccactgctctcttcaaagctgtcagacagggacatttaagtctgcagaggttactgccgtgtttttgtttgtctgtgccctgcccccagaggtggagcctacagaggcaggcaggcctccttgagctgtggtgggctccacccagttggagcttccctgctgctttgtttacctaagcaagcctgggcaatggcaggcgcccctcccccagcctcactgccgccttgcagtttgatctcagactgctttgttagcaatcagcgagactccgtgggtgtaggaccctccgagccaggtgcaggatataatctcctggtgtgccattttttaagccygttggaaaagcacagtattggggtgggtgtgacccgatttcccaggtgccgtctgttacccctttctttgactcggaaagggaactccctgaccccttgcacttccgagtgaggcaatgcctcgccctgcttcggctcgcacatggtgtgctgcacccactgtcctgcacccactgtctggcactccctagtgagatgaacccggtaccccagatggaaatgcagaaatcacccgtcttctgygtcgctcacgctgggagctgtagaccggagctgttcctattcagccatcttggctccagctccygccatctttatattcatgtgtaccccacatttatctcccacttatgagtgagaacatgcagtatttggtcttctgttctggtattaatttgcttaggataatggcctccagctgcacccatgttgctgcaaaggacatgattttattccctttttatggctgcataatattccatggcctcttcaccatttttcytgcagttattttcatattagttcagaaagaacttcttgattcttttttttacaggtacattactatagtctttttgtttgtttacaagtacaatactttcctttgagtgaatagagcatgatttattttaccaacacccaattgatggacatttaagctatttccaatcttctgaaaagagtattgaataaatgactttgaccatatattaattcacaagtgtgtgagaataactttaagaaaaatacctaaaaatataattactggttacaaggatttgtatatgtgtgtttgtgactttgctaaatattgccaagttgcctccacagatgttgggtcaatttctatatctgtcaacaatgcattggggttccaatttccttatagccttgttactgcagtgctttaccaaactgggatttttgccaacctgttaggtgaaaaatggtaacacagaataattgaaaaatgtatttttctttatcctgtatgaggctgtgtatcttttcaaatgttttagaggcatttgttttccttttctgttaatggctagtcttataatttttccagattaaaaactgaattgttgatctgtgcctttcttgtttatttataggagttttatacatcaaagagattaccctttgcattggacattgccaatattttcatcagaatattgtttgtcttttggattttctttttgttattatcatttttttttttaccacttggaaggttttcacgtagtccaattactattttcttcttttatgctctctacattttaaataatttttcaatgttaccttctagaaattttatagtttcaatttgatgtgtttaaatccttgattttttggaattcatcctggtgtattgtgtgttgtgtgaaaaatggattccacttaatatttttccagatggtcatccagttattccaacaccatttattgaatacttcatattttccacacttccttaggggttggtcatggaaaaaacattctcagctttcatttccttttaatcgattttagctcgggatttcctgggaaggtgagaaaactttccaccaaagtctctggggtttgcatttcctgttctgtttggggattactatgcatctcttaactstgtgattttgctttccaagcttttgtggtttgcatcccttgtcaacaggatttttttctgcaaacagcaatgtaaaggctcaatgtgtctaatgtgcctgtgtagtcactatagctgtggcaccagccatagccttttgtgagcagagagctctcaacaaacatctcatgcttttcaacttctgccaaatgattctgcatcaggacgggatgggtgcagcagccaaaagaaatatcaaaggtggaataggagccacatttgggaagtgtgtgcatgaagtcagaggaaattgccagctgtcaagcatatgaaaagacaaaaagacaactgaagaaatgcccaccgctttcccttgaattcctccttgccccttttccatctccctgacccagtgactcttgcccatggaatgattaacaacaggcccaaaacttcagcaaaatgaaaatgactcagaactttcaggtcgtatttgtctatctattcatttaacaaagttctttttcccatcataaaaataagcatgctgcttgtatattagatatgctatttaaattatttgaatttttaatgaatatgattcagtaaagaacttgagtcagctaacacacccaaaaatggatcagaaaaaaataactggtggaattgcagcctgggtaatggaggacaagaaattaataaagttggggataggattgggggtgatggtgtgggaggaggataggctcatagaagtgtaacttatatgagtttatacaattgctacatttygccaacttggctctacatttcctagcggtcaaagtaaaaagggaaatattagctacaactttcataagacaaatagctgtgcctgagtggcccagcttctcctgatctcgagttctgggaataactctgccaaatgcgctaatgttcattcccaagaaattataaaccttattggaatttgacaatgacagacgtggatttgactacaggaaacaagaggggcatggatatattcttggcatatacagaggaaggctcttcccctctagttacacacaggcagggcagatccaggctttctaagacttgaagtgtatgcagtttcaaaggttttactttaaggaaaagaatatgaaattgtgaatgtaaaatcaggtatgaaagtgaatatttaatgagaaaaaattataataaaatatactaaaaaacatgaaaaacctgacagatacaacaaaatcatacacacacacacacacacacacacacacacacacacacacaatcatctgcctttcacacagttccataataatttctcccctgtcatttttggctactctttgatcctctcctcatatgataatccttttgaatttaatgtcccatagagagaagagcaagattatttcatctttcctctggtatggttgattgaaagttttttattagtagttgtttagaaaagttttgtttggtttcttatcattggtaatgtgttgtaaatttaaaactattgtcatttttttttagacaaatctcgctctgtttcccagagtggagtgcagtggggtgagcacagctcaatgcagcctcaacctcctgggttcaattgatcctcccacttcagcctcctaagtaactgtgacaacaggcacatgccaccccaccaggctaatttttaaattttctatagaaatggggtttcaccacattgcccaagctggtctcgaactcttgggcttatgcagtcctcacgcctcagtctctcaaagtgctgggattataggcgtgagccactgtgcccagtccctattgtcaaatttaaggaaacccttccaagtttcttttgtgaggtggaagatttggaagatttttccatggctggcttcttacttggtttatttcaaaccttgtttctcctctaccaccacatacttgtgatgccagggctgcagcacatgtactgccacgacacaacctcacctgtgcacctctgtggtatgagaccagttgagtcagcatgacagcagttaaaatcgtccccctctggcagccagcaatatgttttctatgcatggaagtgaaactagaccatgggaaagtatcccactaaactcagacccaaaacttagcttcctaaaatttctgacagtggatcctacagcagtagatacaagaaaaagtgtggctaacaggaagttgggtggaacagtggtctgaattgattccagttaagttcagattgagtgttctttatccgaaatgcttgggaccagaagtgttttggatttctgattttttctgatttgggaatatttgcatataaataatgtgatatcttggggatgggacctaagtctaaacatgagattcatttatgtttcacatacaccttatatgcatggcctgaaggtaattttatagaatatcataaataattttctgcatgaaacaaaattttgactgcattttgacagcaatgtgttacatgaggtcaggtatagaattttccatttgtgtcatgtcaatgctcaaaatgtttcacattttggagcattttggattttgcattttcagattagaggtgctcaacttgtatcctactttttcaaatattactaaactggagacacatgggaacacattgctaggaccttccctgataatcagcattgccagagcaacaggagggtcttgaggcctaagccagcccgtgcagctaaatctccctctggatgcagagctttctaagggtaatcatgatcacttacacatggaattcagaagcaaataccatgtcctagttgacccattttcttgctgtgtgaccatggactagttattcaacttctatgagcctcagtttcatctgcttgaaaattgagataatacaacataatacaaaattatggggttgttttgaggattaaatgggatatattcatacatcagttactcttttcagcacctgcaaccatcctaaattctaaataaatatcaggtataaagatgtactggaatcctcaaagaaaccatctaaccacttgctttgtcctctttggggcaaagaaaaatccctgctgcatttctgttatatagtctgatgaccctttctattttcagacaagtggaattttaaattaagtaaccctgagttttgttttcaattttcccattctcttttccttgaattgtgtatgggcctgtactatggctgacatgcatgcaatgttaaacacaatgcaagctatgtgcagagtaaactgtagcttcacaaacagctgttttttgagagtgacatgaaggtactaacttagtggagaggaagataaacttgaagtcatgggtttactaacttagactcagaaataaagcccacatgtgtttgtgaggctttcggataactttagaacatgtgcctgtgtctaaccatcatttcctgggccctgtattgtgctggacccctgcagggcacggggttcacctgcagcagcccaggtggctgactttccccacatcaagatgactggttcttaaagggaccaggggaaccttgtccattctgggcttactctctctgcccactttgggcttcactgaggacttgtgaatgctaccaaaaagtgctatgcggggccatttgaaggctctgaatttatcctgaggccctgtggtgagttcatttgccagatgtgcccctacttaaaattccactcctcggggggattctgtgctgccctttgagaaccatcactttgcagggaagtcagtgcttggcagcctagaatgaaactggatccctctgattattgaacacagttgccccttggcctgggaaggatttactgagcattttggtcacctcctgtcactcttcatggaaagactcaccacttcaggggctcatcatcctgttcctgaacaaactggagttttacaggcagaaaacgcatctctttggcttttattaagaactaatattgaaaaatccagcagtctccagagggctccttctctgtggcctcatctgtaatttatctattatttaatctttaaatggagtctctcagagactttgctggatttttttcatctgcctccccacacagagatgaaattatttcccaagtgccttagatcatgaattggtaccttttggaaaggaaaagataatactgtttatgtgcgagtasaagagaattacttcacttgtctgtagtaacactgattaaactgaaatgtcagagctaatgttacagttaataaatgttatacatactcaaatctgtctactgatgattctaacaaatgcagaggacactgcttaaaaataggagggatacctgcatcaccatgtgagtgccatttgtgctgtccatttccagtgagtaaggtaaaaatgtgcattacaaatgagacccatgttggtgatgtctgcaggtcatgttttgtcacttgaagttttcctaaccagataaattgtcacagttatgagaaatcaacataggatttggaaaacatttcctgagataagttgcattatgtaaatcagaaggtagtgggatagagtatgatgagaaaatggagtgtcagacatcagtgtgccaggggctttggtgagaggaagaacaaaagggtccccctacagcctgccctctcacagcctcacaaaagttgatggtattgcttgctcttcctcgtaagagaaaatgtatctgggacctgttatctcagtgggcatccttgggcagatgggtgtgccttcctttattccaagatgtaaaatacagagagcacaagtaggaaaattaagaaaatgagatgaggactgcaaggtgggcagctgacttggggtcactggcaaaaagaccaagactctagtcctccatgcccattctcccagaaatgaagtctcagtttctggagaaggacgtcactcttgctctgaccacaggaggactttgcctgtttgctgtccacccctccattatccctggatgctgtgstctgctgcagtttcccagttgccagaaatagtgtggggtttgtagtcttatacacatagttgcaaatcctagctgtgactttggactaggttttaaccctgaggctactcaggggcctcctgtctgtctcctaggatgattctgctaaatcagtgagcaaatgtgtatcaggcacctgacaagtcacctggctcacaacaggcactcacttcttcccacgctccaaactgagttgatcacttgtgcattgttaygacttcaagacagggggactttcttctcttccccattgccctctctcttcctggtttctcatgtctgtgaaagcctctgtcgcttttttggtcagcaggtagggatagggagctggcagccttttgccctctctctggcacacgcagcagtctagggcttatctgaaaggagaaagctgattgaggcacagttcccacattggggcagactggggagcaactcacaaattcaaggtccacagtagaatgtctgggacatcccagctggcacccccagacaggaagctctacaccctaggagaattctaattcagttggatttaccatcaaatgactgtaacaaagaaagaatatattaaaatgttcattggggatcttggttattataaattacattatttgaaatctcatttagatccagaaatttccagactgggtttggaagctctgaggattagtccttttggaacaatggagtgtcagtgatcatttggaaaagtaattatgtcaaatttaattatcatgcatatgcatttcatcracatcactgtgcacacccaggagacagtggggaaaggactgctccagcatgagcccttgatagaggaatgcggtgcaaaattgtacatgttgtaattgagtgtcacttaatctgaagcatgatggatacagcgactgtgggtggagcaaatgggaggaagtatttggcccactcagcagatgtttgagatatttgggaaggcttttcaatgttttcaacatattggagaggagcaaactacatttcaagtaggctgataacaatgtttccctgtcttaagcatttcttttgttttctgttcctgtggtagcttcacaattctgaattgcagaatggtttggaataatccagtaaaccgccaaatgagactttgaaagtgtgtgtgtgttttggggggtgtggggggagcatggcatagggactgtctggcagacagaggggccaccatggcaatttgcaccctaaagtgttcagagtgtgttctgttggatgctgaccaactggggacccatagtggttttatctgtctcctggcctctatcccagcttcctcccttaagctggctagcaccgtttagaactccttgtcattgcctcttctttaggggcctcccctgatgatgctgggttaggttggctgccctgcacttacttgcacagcacaacggtgtaattgctaatttgtatgcctgttacctctgcacaccgtgggcactgtgagagcagtgaccttgtccttggcttagcattggctctctagtccccaatgcagcacctgcatagaaagggctcagtaaatacttgtttgaatgggtgatcagaaactggaaagaactccaggagtcaatttctcctctctacacatccctaattgtgctgaagcccaaacaagctgtttctaaagctgctatctttggtttggggacgtgagataaaaccattagtgtttaacacatgacacttgatatatgaccaggagctaactggttagcttctttggagctcattgagaattgtaaaactggaggcaggcactgttgagtggaaaaattgaaatagtgcatggcaagtgcttccttcttcctgggatacccgtaaaaagttactttttaatttgctcagctgagctcagagcctttttgttttttgaagagctggccaagaattcatcaaggactgaaaaaccaaaggctttaacttcaggttagaggtgctgttattgggttctcagtgcatggtgctgaagccacagctcatgggtgtgagtgcagatttgtccactttgacgaaatgccttctgacctgtgttatcatctgagaatcttggtgctttgggtaaagtttgatggccctgctgatgctctggcaacaacattttaccaaagccagggaacctcaaattgctgcagtagagcagaatggctactgaacaggaaatccaggcataattctcactttctggagcccttagggaagataaaacaggaaaattgaggaaattgtgcttgagacactatagaacgtgttgcaaatgtatacttattgttgacattgttgacttctgtctcactagccaatactgtgtgtgtgtgaccagtctcatatgtttttccaagacactgaaaggcttgatgattaaaggatgcagggctctttgtgacttctgttgagttgttatagtttacctggcagaaaatgaatggtggaaacccaaaatgggcaaaaagaaggagctaaattgttttgaaactggcttgtgtgccagggggagtgacagacacattatcttatctactttaatctaattttcccaacaacctagaaagtaggcagtagcactatttccacttacagtgagttgcacaaatcaggccaatgacaataataataacacctaaaatctactgagttcttgccatatgtcaggcatctaataaagctgaacaatataaaattgccatttatataggtcaaaaacaactgatggtcagcacttttcatgtatcttattcgtgcctaaacaaacttaagtcagcagggctgtctgactgcaagtttcctgttatgacaccacctctcactgaggtaaaatagggtgctactaacaaaaatggatgtcagaatgctgtcttatatattcataataacacaactgttaccatcaagagccccactgagaagacttaggcctggagacttgagaatgtaatggtgatatggggcgagagagagcaagtccccaggcaccacactttggggattctctttcttgcatttattctttacctggcatggcaggatgccctcagaggtggaagatacttttgctgtattaggtttaaaatgtcatcactaattagctaggatttcaggttgggtcaatgcagtatcaagcctggggacttaactttatagacatagaattgaagggaaaaatacattttccgaactcattttaaaaatagtttcccttggaaattaaaaccattaaatgtacataattatgcagatcagtattcatgctttaaagaaacatgatttcrccttcacttaatttgtttctccaagacctaattatggattagatataaaaaartattattttccaatcactgtgcaaatcgccttttaccacccaggaggacagttctctctgattagtgagagttgtttccatgcactgatcagtcaaggaaaagtcagagagatatattccaagagggagttggttgttcataaagtcaaaagaagacaacaagtgtgatccttttcagtaagacagagtggtggggatcagcttgagtggggctccaggtcttttcccaagagcagctgcattcagcacctgaccagactctagggttttaagggtgcagctgcccaaggactggtccagaatccaacagtaaatgtctatggtccatyatactgggatgcctggaaaggagcaccagggttgcagggagagggaaaggccctcagtgacctcaaggggcagccaggaacaaggtggaagacaacacctctgtagtcatcactttgcttcatgggaagtgttgatgccagggacttgattcatgaccaagactcagagactggagttggctctgattaggattataataatggcagggatctccatcatgtttactatgtcctaggcatggttttaaacactttacaaacatcagcttatttaatcctcacaacaattctacaaggcaagtgctattattatctctgttttatattaatagatgaagaattcgaaccacacaggggttaagcagcttgtcctctagtgagcagtgagaatggagcagcttgtctggagtctgttccaccagcttatagtgggaggctctccactgtgctgcctttcagtactagcaggtcactcacaacttgacaagtgccatagatgctctagtacatttaatcctatccatagccctatgaggaagataggctgtggtgagctactattctgatggtccccatcaaatcatacctcccagtacccacgcacttttgcagtaccctacccttgaatttgggcagggctatacctgctttaatccacaggatatggtagaactgatggtgagacactatgagacagtgcttatgatccctggcagtctgcactttgccctctggagaaacccagatgccatgtaaaaagtttgaaaaccctgaagctaccaggctcaacaatgaggagaagctatgtggaggaaaactgaggcctcaacaattaccctctgatgagctcctaaaccacagccccaccaacttgccagccatgtgagtgaagtcaacttggaaagaaattgcccacccctagtggttttccctggctgatggcacrtggagcagagatgagctgttgtcaaactctgtccaaactgcaaaagagtgagcaaataaataaaacaagtgaaagtgattgttgttgtaagctactaagttttgcaattatttgataatgcagcaaaagataattaaaatggttatagatttcactttacagatgaaaaatctgaagttcaaagaggccataaaacttkcctcaaatgctatagctagatagtaacagatgcagaaatggaatcaaggagtgggagtgcagaggagcactctaaccaccatgctctactccctctgttggtgtatctgcaaggactgcctcaatgtccaaggaaggtcagcctgtgtgaggctgtgccaggagtgttacgatataaaattcctggcccctgcctacctggcctttctgttctggttggagcttacacttcccttagaatacttgccagtgtagcagcatgctgcaatatttactgaactccaagaatgtaccagaccctttttagttggcttatcattgaatcttatagcaggtaggaatgactgtccccaccttggagttgcaaaagcaggcttggagatttcagtaasatccttaggttcacacagtgtgtttggatggagctagaatttgacctggttcagctcaaccaccatacatagtacatggaccaacttcagctcctgttcctcgtctttagtgtcccccagtaggctctgtcacattattcaggatgctgctgaactctgctcaaagtgagcttcttcccactttcccttarcaacaakgtcagtcacaatcctgtggatgctttgaatgtttgtaagaccacccagatttggtggtctcttattgcctccctgatcagagatcattatgtctgttttcttgtgcatgccaactcccagaatggacagatgggagaattttctgccctcactccacccatgtgcagattgggcatcagatcctctcagcatcctgaagacagttctcacaacagcagcagcagtagccatataagcattcggcttgggttgggccatagggaaaactttccttctcatccacagataatgaccaggaaggtgttcctcagtgagaggcttgttcttccaagcgagattaggtagtagaaccttgaaggggagttgaaggcattgaggctgtgcctgagctcagtagaggagcatctgctgagtgggtgaaccctgccgccccaagtttgccccctgttggcttsgtttgcttaccatgccttagatcctatgcttaactcaggtacattttagaaggtagatccttggaggggctatacaaaagcagctgacagactatgagaacattttsatccaaaaggcggtcattaatccttaagctataaaactacactttgcctcagtctccgcattgtacagggaatcagtaatggtgcctacctcattaggttgtcttgaggattagaggagtttatattggtacagtgctcagagcaatacctggcataacctataaaactgttagctcagtgtaagtgacaaatggacagagggccaaatgcctgtgtctatacagtagtattcccttatttgcggtttcagttttcatggtttcagttacccacagtcaaccaatcaactatggccccaaaatattaaatggtaaattccagaaataaacaatttgtaagttttagactgcagtgctgttttaagtaacgtgatgaagtctcactccatctggctccatccyacctaggacatgaatcatccctttgtccagygtattcacactgtagataatgcctaccagtcggtcactttgtacctgtcttggttatcagattgtctgtcttaggatttcaatgcttgtgttcaagtaacccttatttgacttaataatggtcccaaagtacaagattagtgctgctggcaattcagatatgccacagagaggccataaagtgcttcctttaagtgaaaaggtgaaagctctagacataataaggaaagaaaaaagttgtatgctgaggttgctaagatctacggcgagaacgaatcttctatccatgaaattgtgaagaaggaaaaagaaatttattcttcacagctcaaactgcaaatttacggccacagtgcatgataagtgcttagttaagatgaaaaggggattaaatttatgggagaagaacatgaacagaaacgtgttccagttgatggcaattgggttcggtactatttgtggtttcaggctcccactagggggggtattggaacataatgtatccccctcagataagggaggactattgcatgtgggtgggggttgaaggagaatgggtgctgagggtaggagagagatgaccacagtgagagaaggttcctgagctgttaccagtggcgtccagcgcatggcagggtctcaacatgtctttggcctgtgggaagggctctgataggtatgagtcccacctccttgttttagggatgagatgagggaagttcaggggtcaggggagaggcctgtgtaattcaagtttgttccagaccttttccatctaggtcaccaggaaatggggttcttgggcaagggtgtcagggccccaacacgtgtgcttatggccccagcagagtgcccaggggtgcccgagcggaagtgccacttcaagggctgagaagtgagagtggtaccagctgcctcaggttttctcacgctctcacgccagcagagcatgagcgccctccttggcaatgtgaatttgatgctcttacctttcagaagagtcctttgctttactctgggaatcctggcactcctgcgacttgctttgaccactagcatgtggcagaagtgacrttgcagaagttctggagcctcaagagaccacgcagcttctgttttgttcccttggacgccatcctgaactgggcaggygctgaagaaccaaggacrgaaaccacgtggagagaaaggccaagtcatctcagccggctcagctgaacccaggacctattgatcttccagctgaatgaaatcccaggagcaggctccattagctcattgaactgttagaaataatacattgtggctgcttgaagccattaggtttgggggtggtttgttttgcttcaataggtaactgaaatgcttgcgcaagtttgaccaggcctggagtcctaggaccctttctagcagcccctctactagcctatgaaaaagggccggccaaaacaggcttcataaggaatagtggggggaactagggagaagaaaagactaaaaacccacaggctcatgatcgggctgcttcatattccaagagggccatcctgtaccagaaagactaggctgattcaaaagcatcccaagctctttaagaaaaattgtaacaatgataaaaataaatttagtacctccaatatgccagtcattttatatgcagcctactcttaatcctataaataactttttaaggtaggtaggcattaattccattattttgtgggtgaagaaatagaatcaaagagtttcctgcccaaggtcacacagtctgcaaggggaggaactagaatttgaaccaaagtttgacccccaaacccagcctctatttattatgccttgttgtctttctcttggcccactggatgtaagtcaaggaaatgagaagtttttggggaaaagagtatctctgagcatagtatgctctctttttaccaccattgcttttcatatgctctttctttgatcagtaatgagctttatgtaagtctctgtttggggaaattctattcactctttaactttaatcatatctcactctctttgtcatacctttccctagtctcatatgctcagaggatcactcttttctctgtttctcctcagtgcattctacaaacctttttctcatatgtaactcatgattttaattactttcttttattctatctttctcccttctagaccagacatttctctaggacaggatctatacttcatttctgtgacctgtgcctgtcagtttctggcatgtggcagccttcaataaatgyttgtttaattactgaatatattgatgctttgatagaagaaacaactctgtgaactattgcccacatttgaaaaatgacatttctgatggaagtgagtcccctccccccatctgttgagtgtctgggtagtcatttaggctggtggcatgtgatttctggctttgtatgaagatttcacaagatcagtgctctcatgagtgaaattgtcacatcactgggtgatggaggataaaattagaaatttctttttagtttttttttcttaaaacttaagaaaagaatttaagctttacaatatttgctatgtgcattagcactggtgcttataggggaatggctttgccatgattgcctgatgaccttgtatgtgtccagaagggccatacaagcaaaggcttaaactacagctaatgaaagtcttggtgtatcaccttgcaatccttccggaacacaagaagaagggaggcctctgaggagctgctatgaggccatctcccactccccttcctattccccgtgggaggctgtcctgagacagtttttcattacacttcatgaggtgtgaggctttctgccctacacctatcaggacatagctgtaggctataaaagtgcttaagtgaagtctagaattggcttctcagcaatggagtatyccacaactgaagttatagtaatttagaccagataaagtctagaattggctccccagcaatgggatatctcacagctggagttacagtcaccaagaccctttggttttagtgtcatcttttctggcatgtaggaagacacagggagtgggcatgtttggctattcttcctctctctgtccatataagtaataaactctctgaatccttaagtggcttgtcatctctttaccagccgaatcatttaggccttggtcctggccttgcctgctgtgtgcttgacagtgccctcactgtctacatgtcagtctgcccatgtgccacacatggcagtgcttctcaactatttgcagtaaaggaccacttattttaattttcaatcttccaccaacccatatttttatagagtataataaaatgaatttctaaaacattaaagatacacagaatacaagtccctccctcttctagttaaatcagatgacatagtgtaatctgtgaaattgctagatgtttataaacacttttgatttctctgcttatctcattgaagactaggaagagtttgaaggctggcaccgatctgtggatcacactctcagcagcactgaagtgtgggacatgagatacccgagggaaaagtaggatttcagaacacagatggtttgccagaatgccctaagtttttatttgatttctataagctgtaatgtattataatttatatccacctggtagggaatttatgtataatattgatttttaactaaaataacccttagaggaatttgaaaaaaacttaaaagttaccttttagtaatggacagattgaaaatattaataaaggcaaacatagcttacaatatgaaaatggatgagtggacatttctttaactctcagtctcagctccttgtcagccatattatgaggtagaaaaaataacagtatattctggtattacaggaaattggttaaaaattccaagttagcaatagaatatttaaaatatcaaatcaaatttatagtggttaataatgaaccttgccataagtatatattgggtcttgaaatattcattaattacaatatgatctctcaagtcaggcaagacatttaacaaaatttatctgtatctccacttgtcaaaattccattttatatctattttgtaatatacacaatatgttagtatatatatgtatatcatttgtaaataagcagtcgtatattggtgtgaggcttagcattttttcacaggggtcatgtacaggaaatgttttgaccttggcatgaggtcacctccaaggccttccacatcacaaaggtagtcagtcatgtctcaaattttaccttgtgagtgcaagtcatcatttctggactttctccagtttgagtgtgtctccaagactgtgaactcagggccagctctgggatgtgtttcccaccaattctaactcataaagggccggagagctgagattgtatgtgctttggtcttataccaattacaaggctcataaagatacactcaagagggtcatcgactctttctacagtttgtctattccaagcttcattaaataatgtggattaaagaaaggccattttgggaaggcagatgtggctctaacctgactagtcagagtaggctgactagcagaaatatggggatggttactttcagctagtcattgacttggccatagcaagttcacaaccctgggcttgcataaaattatttaaaatttcactttatttaaaatcatacttaattttgctcattataaaagcacatcaagctcattatggaaagttttttaaatgcattaaattttaaataaatttaacaataatttttttacttaaatcattaatttttggatctgtctattatatatcttcatgccacataccatacatatatgtgtgcacacatgtataatattaaatgtgtatatggttgtaataagaatatatgtttttcttttttaaataatatagttttcattccccaccttttacctatacgggccctcaaaagccactggggagattgagctctactaagttttggtcctgaggcttcctcttccatgtgacgaaagggaccagactgaacaagggaagccatgtggacccattgatgtgatgagggctatctcaatgggattgcagaagacatgattttctcaagctttcagcagcagtcttttcttatcttggatgtgatgctttctttctaatatcacctttgtctcctgtgcaaacccttctcaaactcttcttgaaatctggtcccaaggcaaagcttcttagagccaacctggcgctaccctaatatctgctcatttcatttgcatgtgacttgtgtcatttataataacactaccaagagaagggggcctgtaaccagggcaaccagaagaggtgccttcgaaattctggctcagccagactttctgctccgtttagttagattcttatacattcatggctctcttctctcctgagattgcaagaatgtaaacacctagaatctccctcatctcatgtccttttctcccagagccccctctgggcccacctatccaacacattctatttctatcaacctgaacatttcttcaactgttacaagattcctattcaattactatccaacattgtgggtcataatattttctaatgttaatacaatctctgatcattatttttaatgctgcctactgttatatccaggaggtggaccgtaactactttacaattctcatataattggattttgggtagtttccttttttgtttgttttggccattatgtttagttctctgatgatcatctttgtgcattacttttgtttctgtcattaagctataggagtccttccctaggatagttccctggaatttaaattactgatcaagagatatatttgttaggcttttgatgcatagtgctatgttaccttccacagagtatcagtttaccctgtattgtcattgtgctcatttctagatatcattgctaggtatttcattttaaaaatattttataagcaaaaatcgaagtagaaatagcataacatgacaacttgctttttatgttattagattggacatatttccatgcttgctagctaattacttattctctttgtgaaagtatttgctctggttttctttcctttcaattattcacattttacattgcaagttgttctgcctatgaggttgggcagaagccttgctcttaaaataggagtaatcatatctttcagccaatcacagctgatgatcaggtgaccaaattcttccctggtgatgggtcagaagagttgtgtgcttttgagcacagctgaatcttctctgaatttttgttgagggagagcgctgtatgatcatgtattaagattcttccagatctacaccctagtcacctaagaatagatgctcctgttggaattcagctaactgtaaaaataggtatgcatatctttataatttatggtaatgatagtaataatcattcatttttattgagtgcctgctctgtgccaggcattttaataagtgctgaaggacctgctgaaaataggtcaaacaatactctgtcctcatgcagcttatattccagtgaggggagakagacaagaaatctataaaagtttagaaactaaataataaaataagttggatcattttatatagttatgaatactattgaaaactacaataggaatacaggacagagaaggacttagtaggggagtctacttaggatgataaggaatccctttagggaaaatgataactgactaatgcaagaagtctattaagagtagttctrgggtgaaaatgtttccagaaggagagcatgtacaaaggctctaaactgggaatagttttggactgtctgaggaacagaaagtgggccagtgtggctgttttagattactaggaggaagtgataggatattattagctaggcagtggtcagatcgtatagaatgttgtaggttatgcttgggaatttggatcttattttaaatgggtgccaagggaacattttaaatgaaggagtagtataacatgatttatgtttctggaatgtcactctgtgtcctatgtaggggatgtattatggtcaggataggctagactgttatttttagaggcttaatgcaatagaggtttatttcttgttcacagaaagcctgatgtggccaggtgtttctctagggaatgtcttctccatgcagtgactcagggatccaggcaacatctatcctgttattctaccccatcaacttgtgaactatatggctgccactaaagaagagatggaaggataagcacacaggctcttaagtgctctgagccagaagcaagagaccccattgctaacattcccatttgttagaactcaggcacatggccccaaactcactggaatgaagctgagaaatttagaagaacatattgatatttgatgaatagtaactgcctgtcaccttgaggcccgagtaaaaatagggatatctgttacaaagcagtttcagtgatccaggtgataatggtggctgggatttgggaggtagtaatagatatggtgcagtttctggatagagttctgaagtagagtaaacatggctagcagatggcttttgtgtgcaaggtgaaatcaaggatgactctgaaatctttggcttaagtaatgaggtagataaaggtgtttgtaactgagatgatggaatatttggaaaataaaagattagtgtgtgatgtgtttgaggagttttgggatggaaggttgtatatttgaaatttttgactctgagttgtctattaggtattcaagtggagatgtcaagctggagcctggccatttcagtctggagctcagggaagaaacctgatatagaaatataaatttcaaagcgattagagcattgatgaagattgaaattcacgaggacctgctatcaatgttaatatgtgttctaatttaaggaaacaaaacttgaggctaaaaagggttaattagcttccttaaagccataattagtatgtgattgaggtaggattcaaactgaagtctgcccaaattcattctgccaaagataataattattttaatattgctaatacgatatcaatttttggtcagttttatagctctcaaccctcttttacccatatgatttcactggtgaagaggttagatattaagaacttctgctcctggttttcaggggatgacagtgaaacataggatagtcacatgaattgactaaggtcacatgatgtttctcaggcaatctcacccttgagcctcaggttttttagtggaagcacattacactatactgtactgcttctcaatcagtgtggaattatgtgaatgttctactccattccattccatttctttcagttcagttgcagatgttcttactgaatgtttgaatgtctgagcccagggtctttggaggccacatagaggcagacactcttggctgccgaccttgagatgtacacagtcacggtgggcaggtgcacctcactcctatgactcatttccctgaacacagccttcaagcttatcagaaacagagtcccctctaatyttacaaagtaatgtactgatcattttctcttttaactgttgtagaaagaaaggtgatttatttggttatcttcatatctgagttacatgtataaactaaagaagacttactggtactgaaagcaagtactattcaccttctgattacggactatgaaaggtaaaattagatatgggaagacccatcttttaccccttacactgtcttggtagctagatcatctgggctcaaggcttctgctatcccgtaacagaaaatgctttcaaaatctctgtctcttggttcctattgcctaatatcactcccaggttacatagactaatcactttstggtgtaggctttattattgttatgcttatatccattttctgggtaagaataactctttgactctggtgctgggggtgaatgagagtcattttccttctgtgcagttggagaaacctctatagtatggggctaagaggaaggggcaggaggaaggaggcctgagccctatgaggtttctaggttgtgccagtgcaatgatctggctcccagaatgtcaaataagatgtaaggggaatggaagcttgcaaaatgctgacctcaggattgtgtcaaagttctgggcttcatcagcagtcccagtccagatgagatttcatcactgtggaagttaaccacctttggaacatttttctcttttattccttcttctctcctgcttgcctttcctttatttcttcctccattaaataacgaaatgcctatacagtcactgctatgtgcataggaagcattttgtgaggaaaaccccatgggctttgattcagaagttctgagtttacaggctctctggattatttaattgacacaaatcacctaaccgttctgagcctcaagtctctccaccagcaaaattgaggataaaaatttctgttctgtttaactcacaaagtgttggtgacactcaaatgagatattatgtgtgacaatactttgttgaatgtaaacaagttcacctactgtatgggaggcagcattttagatgmtgtgggaatacagagaggaataaaccagcccaggcttttaagatgagcataaaggcaaatgcatgagaaactgttattattgatgcattaacaaatgaccccaacatttaacagcttaagagagcaataattttattatattattttatataatattcatcatgttttattttattatatatcatagattctgcaggattggatgggtgactttaactgaggtcacttagctgtactcaggagggttcaagagggcttcacttgcatgcctggtaccttggtgggagttactgaaagactgagatcatctggaactatcttccaggacatctacatgtagcctcttcagcatgctgatctcaagctgttgaatctcttatatggtggctggcttgccccagtgcaacggtcataagtggaaattgaaggccatttagaatgtagactcagaagtcacaaaatgtcacctccacaacaattagaaattacaaataaaaccaatcaatattgaagggagaggggtgaggttaggctttgtatgtaaatgtggaagcgacaaggtcactttctagaagagcataggatgatgttattgctagacttggaacatgcaacctgctatcctgcttctgatggctataatggttcacacccctctcgaatggaaaaaatactctcaactccctctctaaaggaccccaaagactcgtaccatttaggccattgacccaaagtctaggatcttatcatctaagtcaggttgaggtacagatgaagctctttgagtacagattcttggatacatctccccaagtatggttttcaacctgaatacctaaatccaaagagacaaatgatataactcccttgcaatcaatatatgaaggtaaggcagtgataggataactgcaataaggattaccatttgtaaggaggagtagttggaaagcacatagtgatcactggtcaataccaattttcatatccagctattcatgtctcatgtcgttaactcctcaattaaaacttgttactgcttctttgtttcttcactctactctttgagctcttgattcttcccaaatcatccttacttttygagagaaaaaaatgtagattctttttgcagctgatttccttcccatacttcagggatctaaatgtctctcttattctgcattgtctctaacccattttgtctaacctggtcatgtttgtgacactacaattacttttttttttttttttaattatactttaagttttagggtacatgtgcacattgtgcaggttagttacatatgtatacatgtgccatgctggtgcgctgcacccactaacgtgtcatctagcattaggtatatctcccaatgctatccctcccccctccttcgaccccaccaccgtccccagagtgtgatattccccttcctgtgtccatgtgatctcattgttcaattcccacctatgagtgagaatatgcggtgtttggtttttcgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgtcttttggctgcataaatgtcttcttttgagaagtgtctgttcatataccttcgcccactttttgatgggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccgtgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattttaaaaattgtgtgggttttaaaattaagcttatcagttgttgaccacattagataaaagccacacttgcaaatatttctgacagtctcttctttagcttgaattcccaaacaggctcctagggatttttagaatttctgttgtctaacagagaaggtctgtgaggtacatctttaagactatagaaggtcttttgtctttctgagaagtcttcaaggcagcattttaaatatgtatgaagtcttaagaaagggtttacaggtatacccttcatttcatgggtccacattttctggctagtctgcaggagttgatctttgcattgagaacctctcttattttggaattttctgctagaaaacactgagaataaaaaatattttatttttgaatccaacaaatcttggcttctatcttctatatactttatttaaattctgcttgaaaacagaatcccttctttacttaatctatgaactatctatgcacctatgcatgcattatgacatgcaattaagagaaaccaaaggatcattcaaatttctgcctggacacttcagtagttagattcaccagtttattaaatagattttctactttccatattactgcatgtgaaaaatttctaaaattttctgccactagatattaggttcgtgcaaaattaattgtggcttttaccatgactttaatggcagaaaccacaattactttctcatcaacctaataacaaaagtagcttctttttcagcttccaatattttcccctaaactcctacagtagttttcttgagttttggttccactaaaagtctccttaaggttctcctatcttccttcctagacacagtctcaaagccaattccacatattttatatttttttattgtaacactgtatttccaggaccaacttcttttcaagttactattactgcatgacaaccccaaattttgtaaaataataatttataaatgtctaatggattctgtatgtcagaaatttggtcagggcttgtctttgggattcttctaatgttaactaaagtcactcaatgacactcagctagtttatgcacctgtcttaagggtctaagatggattcactcacatgtctaktgctttggcagaggtgattggaaggctggacacatatgggatccatgtgggacccacaggtggtctctccagcatggtggtctcagggttactgtactttttgcgggcagctggattctcctagataattggttctcaatgggtggtgggggggggggctgcataattctatcctccaagggtttttggcaatgtctggagatatttttggttatcacactggtggggggccggggagtcgggggagaggcactactggcatctagttggcagaggtcaaggatgccactaaacatcctgcaatgcacagaatagcccccacacccaacccacaaataattatctggccccaaatgccaatagtgtcaggttgaaaagctttgtcctagagcaagtatctcaagagaactaagcagacactgtatggccctttctgacctagtcccaaagacatacagcatcagattcagcccagatttaaaggaagagtaattagacttctcttcctgataggaggtggagaagtcacattacagaagagcatgtgggatggggaatattgtcacaaccatctttagaaaatacaatctgctgcaggaactgtcagggaaatatgaatgtgatcagtgccgtgaaaatgggtaagcataatgcgttaaagatgcaggaggatctgtcacttctagttggagagataaaatggggtttcctgaaaacagggcaattaaacaatttttttaaagtgacaattgaaccttgaaagaaaggtagtgcttttaaatatgtaattgaagcaagaacattctaggcagtgggaacaatataataaaggtatcaacattcaggaattaacgaactatggcccttgggcccaatgcagcctgccgcttaatttctaagtaaagtctactagaacccaactccactactcaatgtgtggagtagttgaccacagagaccatatggcccagacaacttaaaatatttactgtatggtaaacatggtcctttatggaatagttaaagaactatccatcaactagttctttaatttatttcctgattcaacaaataatttgttaagtgcatgccacgtgccagaaagtgtgtcagatgtttagtgkatgctggtgagcaaaatagacatcctccctatcgtggaaggtgcttttcacagtttcaatatttgagaagtatgaagaaaatagcaaggtcttgtgtttaaaaatattaaaatacttaggaagattgaacctgagaaggcctttatcaagattaaacctcatcaggcaagacccaccagatgagaaagagccaaccatgagatgtgaatgtcagagataagatttattgggaacgtgaaggatatacacaaagttcctaatcaggaaggaccttggcttgaaagagaaagtgaaaggtggccagtgtcggtggggtgtagtgagcgaggtagaaagtgtgatggttggggttaaaggcagacatggatcaggtcttrgtgagtcttacaggccatgaaaaggaggacccaactgtagttgaaaaccacttgagaattttgagaagaatgaaataaagcaattttcttaaagaaaaagagaaacctggcagctggattgagggaggcttagatagggagtgcataaaaaagaaactgaaggatagttaaggcagctcataaaggtcccaagcaaaaaatgatggtaccctgatatagaaactgttcttctccgactttactgtgcctatgttcttctgggactcttgtcaaaatgcagaaactaattcagtagatgtgggatggagacatgctgcaatgctcctggcccactgaccacacactaacaggggcctagtggtaaagacatatcaagcgagtttaaaaaaatatatatttattattcaaatactttaccatgactagaagtcttaaagtaartttccaacacaaaatcatgcaaaagacaaaatccaacccaggaactttcaaccactctaagtaaatcagcactgagtgagaaaaccttttgcagagcttcaaatatgaggcataatctgggaccctgagtctaagaaaagaatgaaattccagccatttaatgaggaagcacccagaagatgatcaatattattagtttttcaaacaagattttattgagcaaatcaaaatgaagaagagatggtctctgccttaacaaaaagttatgtgggctgggcgcagtggctcacctgtaatcccagcactttggaaggctgaggtgggtggatcacctggggtcaggagttcgagaacagcctggttaacatggtgaaacgcagtcactactaaaaatatacaaaaattagccaggtgtggtggcacacacctgtaatcccagctactcgggaggctgaggcaggagaattgcttgaactggggaggcaaagtttgcagtgagctaagatcgtgccactgcactccagcctgggtgacagagcgagactccattgcaaaaaaaaaaaaagtacagtgtatttgtgaacagatagatgtaaaattttaatatattatgaaaggcatttccacaggggtatggtcaggatatcatgggctcacccaagggagacagctacttataactaccttgtacttcctggaggtacaaggaaaaatctctagaatgatattgaaaggatgagtaggaggcagaggacaaaggaagggaacgatgttccagagagaggagccagtccagagtttgagagagtgtaatgggagacacctgccacttttttctatgtaagaactcatagaattgactgtcagaagtgtcttgtcagacttcagactgaggtatagtgtacatagggtcattaattcgggtcaattaaaaccaacaagaatctcttaatctgctagtatgagcctgagcataatagagacttaagaggagagatcatattattaataacaataactaatatctgatggaacttgcaacacatgaagacacttgagcccagagaacaaatatgaccagttcacaatttgccgaaggtccccaagctcatctgtggaagaaacagaattccagcctggcttgtcccactatagagaatgcctttgctggaacttgcagtttatttagagagaaaaaaaccaatacacctgaaacaattaaagagaggtacgaaatcaacattacagtcataagctagattgcactgcagtttcaaaatgaaaattgctttatcatttttcttctgattataaaaacaatgcttcctctaggtaaaacagttcaaaccttatagtacagtgtagtgcaagagatgaacattccttataatcccattgctctacccaatgccagaaacagctacttataactacctttgagcttaagcttatatgtgcaccatctcacaaaaagaaataagcttttaaaaagttggatcatactatatataatgttatgtaatctatttttccccccacayaccatggagctatttgcagttaaaactgtrcttatattcttcctaaacccttacaatgatgcatctagttctttgagatcgataattttttggccacttgataccatctagctccatgtaattaaagcacagtcacctgagagtactaaaattgatcataatgttatttttgttttgttttgttttgttttgagttgagttgaagtcttactctgtcacccaggcttgagtacagtggctcaatcatggctcactgcagactggaactcctgggctcaagtgatcctcccacctcaacttcctgagtatctgggactacaggtgcatgacacaatgcctggctgttttttttatttgtttatttttagagatggagtcttgccatgttgcctgggttggtctcaatctcctgggctcaagtgattctcttgccttagcctcacaagttgttaggattacaggcatgagccactgtgcccggccataatgttattttggcaatcattttctcttatcatccttgccaataggtcatcgtttagtcatgtgacaggttagtgccactacctacctcctcagcacatggcccatcatttaacaaatcattgtatgtgtgtgtgtgtttgtgtgtatggcacatatttgtatctaaataaaccttaactatatttaaatacaagtatgtgccatatatatatataatgattttatacataatgatttcagatggctggatttattgcacatacttgtatctaaataaaccatatggtttatttagtatgtgcaataaatctatccatttgaggtatatggtgtttgatcagctctgacaaatgtatatggtaatgtaagcaccaggccattcaaaatatagaacacttccattagccccaaatgtcccaccttcctctttgcatttgatacccttctcccatccccacctccagacaaacattgatctattttcagtacctataatattgcctttgcgagaatgccatattaacagcatcgtaaagcacgcagtctcctatgtctggcttcattcacttggcgtaatgcttttgagctttatccatgttgttgtgtgtgtcagttgcttgttgctttttattgctgagtagtactctgttgtgtaaatatctcacactttgtttatctattcaccagctgatccacatttggagagtttcaattttttggctattatgaataaagcttcaatgaacattcacatatggacctttgtatggacacggtttacatctcccttatgtaatgtctaggagtggaattgctgggcttaacatcatatgtttaactttataggaaattgccgaagtgtcttccaatgtggctgcagattttgcctgccagattctcagtgacacttggtaacatcagtctttgattttagccattctagtgaggtttagtgtactgccttgtgaccttactttgcagttccctgatgactcatgatatggagcatgtatgttttcatgtgcatattggcctatcacatgtcttcctctttggaaaaataagtcctttctgtatttttaaaaatgagttgtttgtaagttttctttatgtatacctgatacatatcctttattgggtacacacatctttgatattttcctataacttttggatggtagcttatatttttctttttcctgctccatccagtggaggtttggtggagaagagctgatgagtagatgtggcctcccttgagtctagggcccggggatcctgactgtcctgctggcccacatctgacctttaagattgttaaaattccagggttttttcttcttacccactttaataactaccacctgcttttgatccatgctctgccatagagcagaaacacttcttgcatcctgtctctccttggagtggttttgtaccatttgaaattcagttcaaagggtggttttgcaattgcaagtttcttataggctaactttatatatatgtatatatgtatggttatacatatatatatggttgtatatatatgaatataatacatggttwtatatatataaacatgtatgttatatatatatatatawaaccatatatgtttatawatatatatatatatatatatatatctggctttactgttgttgttgttcaaaaatcctctcgctcctttctatatcttaagcagaagtggaactgcctgcctccatccttgctcttaatatgacaaaagtctccactgatggcattattggagttggtcagtccttttatcctgtgtgagcccactgagaccattgtggcctgggctttaaggtagtagaagctagagcttgagcatttccattgccttcattatgactgatctcttgccagtgcagaaggtatttctgctggttttcattgcctttctctccagcaccactgggaagtatcttttccccatccttgctaaaggtttttcaaaagcccctgtatatgatagctctcctttccatttcactcttcttttagtttcttacagctctgtcctctggacacttaacacacatccttctaggacttgtttttaagaaagkatgtctttcaccaaaggctcaattccttgtgcaaaggtcctaactgagatggatactctcaattctctccatctcagacagcgataatcactccttcctatacacatgcctgagatgttcaagagtggtcctagcctcttcctcagtgggtgtattaactaggttctgactgccaactcctgtgactcataccctccaaggcccaggttcattggctctgatatgctgggattcccaaaatgacctctcaagttataccttacttcaggaatcctggctaccaatattaatattctaccctcagatgttcacactctccttccaaggtgctgtgtttgtatctaaacatgttgttcctgcatttagctgaaggttaaggcttgcaatggattatctgatatcagtgctggccgaatgtccaaatcaagctgattcaagatagtgagttccctttcaccttacccctatttaaggctgtgatcctttgaaacatactctgagcccatttgctttccaatagaagtaaacaaagaaaaaaaaccctartagatgacttattgttttagaaaagcccatgcactgacataatgacagacccactatggccatcatcattgaggctggggccatctgcactcagatcatggcagtcactggttgatgagaacatagctcttatgggatttcagatgaggtctgatagacatggccataaaatcttcaccttttgccttccaatactaccttgagacaagcttaccaactgagctgtaaaattgtgacagtgtagcttattgatccattgtcttgttggatattattaagcatgagatttggggttatttccttcattccttccttttttccttccttcctctttcttccttctctccctctctttctccctctctcccctcctccctccttctctccttccttccttctctccttccttccctccttctctccttccttccctccttctttgcttccttccttccttccctccttccttcctttcttcctgtgtccctccctccctccttccttccttctctccttcctttctccctccctccttcgttccttccttctctccttccttccttccttctctccttccttccctctctccttccttctttcctttctccctccctacttccctccttccctccctccctccttccttcccttgctccctccctccctttctccctctctcccttcttcactttctccctccttctctccctcctgccttctctccttccttccttctcttgcttcctccctttccctccttccctccctccatccttctctccttccttccttccttccttcctcccttccttctttccttccctgcatccctccatccctccttccttcctcccttcctctctccttcccttcgcaggaatttacaatgctctctatatgaaattggttatattttgtctctgggctgtaaaacagtaagattgccacccgtttctattcttcctccccatgaaaagagaatgacactttaagacacctttataactagtctacagaacacaaagcccaatcttccaaaggatgcctgtcccatttagggttaataaccctgcatttattaaggacagggccacagagtcccaaatccccacatcttacaactcagaaacactaacttgaagaacatcctggttgacttgggaaatatattttcctgagaccagtggtttgtgaaatatattctccaattggctgatctcttgcacagttgtttgtcataatcagattttgaggccatatatctcctttcaagtgatgattgtgctataacctctggctccatccacatttctggtttgggtagagcagatctcagcaatgaatgaaaaccgtagctgtcttatcaaatagcagcagtacttgttttgtttaatagtgctggaaattagtttttcaggcactgatcttgacaggtcagctgtcaaaagtgggtgtgtgcggccataaattcatcgatcctgtaaacaaaattctgtctgcaaaatacaaggggaagtcagagtagactcactcatgtacaaatgaaatggtctggagctgtatgactaagtgttgggacttctttggatgaaagctttttctggcttcccacttatcaagcccatcggcctcgtttggcttttattgactgaaacattttcctgagcattcagagtggcgagcgccagaccccctcaggatgggggagggatgcatgtctctcctaatcttgggtgactacaaggctggtgatccatttaaagccttcatttacataaaaaaaattccactggattatttcttgtgaaccgtgcttttctatgttctggccttatattttggattgcagacggatggccttgaccagtaatgatggaggtttaccactcttgtcttaagatttgggcaagatcacacagttttgtggaaatggggagattcactcagcctggggcacttggcttctgtctgatgtgagggaataataaastttcctacccaatatgaaggatcctgaatcctggaacatagttgaactttgatgtgtttgaaaggcagaattttgattttttgctttgaagtattttttttcttgctttatcagggtacaggatgcctaaaggccagggagacagaagtctgtattaaagcaaaacaaaacaaaaatacttttaattcctaaccacttttagataaagagagaagcatgataataggcttggaagaattttttttccttcatgaaattccattttaatttacatggccttctcgtattaaggttgtctgaatattaactaaaatgatttgaagctgctcctctttctcagcagagaaagattacttggattgcttatcttcatggatctgggcctcagctgtggccacttcctatctcccaactcaacagtttacagagctcccaccatcttggagagatcctagaatatgagatgctgtgctggccaaactagccatatgccccctctaggagataaagcacccctagaccaaaattccttacagccaaagcactgatttattgggttctgactctcagattggccttgacatactgacaggtaatttgactccaattgctcccctatcatgcagttttgagtcgtacaagtgcatgtgataggatattgcttaatcatctatgctagttatttttatcaaaagcttattttacttcctattagtgaaaatcctgttaaaatcaggaagaggataaagaaggtaataatgattacttataattccatcacctatatgtaacacatatatccacgtatcacattttaacgtgtcttctcccgtttttaccactgcttttaaaaaaacataattgaggtcatattgtatacagttttatatcctggttctttactttgtgattcttaattaagctattttataatagactgtttcaaagttattttcttctttgaacagcccctcaatttgtaggcaaggaagatttttatttcccatttcatagataagaaaatagaatcagctgggcacagtggctcacgcctgtaatctcaacacatttttctgtatttttttgtatacaaaaatatttgttgactctttctatgtttcaagcattgtgctgtcaagtgctatctgaggtcactcaggtaagtggtgacaacaattagaacataggtctactgactcatgaacatctgctaagttcacacctccaagttcccatcttcttctccagttacagaagttaatgttggagaggagagcctggaattcgaggcaaggttggagatcctgagatgggaatgagcaaggccaggtctagcccaagagcctgaggctctagacagcttatgaagacagagttttgaccccagagaacatggcaagaaaccccaatgccacagctgactcactgacttatgccaagagtagaaggaactggaggtccttctatttcatttctattgcagatttgcataaatcatggatattgggctgaacattcattagttgtgataaatgtgtcattctaatgttatgtcttaatgggaaaaactggcttatggatctattgacattctgtgtacaatatctacaacttttctgtaaatctaaaactattctaaagtgaaatcttatttcaacaaacaagtaagagtttaccagacccagaagaggagaaagggcattccaggcagagaaaaactagatacaaatatcaggagggaatgtggtgtgcctgagaaagaaggagggattttggggattttagtgtactgtaactacataaactaaagtgaggttgagagtcaggattggctctggatgaggaaggcttttcttttaggccaagctgaaaagtcttaggatttattctgtaagaaaaaggaattcattagaatattttaattaatatagttcatatttgagtttatttgttgtaagggtacccacttgcctgttgaaggatgtgctataagagaggctgagagcagcgaaaccaatgagaaagctgttgcaaaggtctagggggactgaggtggtgcatcctggagccaagcagtgagccagaagcagagaatgatgttcagggcttcatcccaactgtttcttcctgcctccatcctccattctaatttctgattataatcccagtagaaagacaggtaaagccttgttgatcaagatgcacagagctccattccaaacactcatccaagccaagacagtagagaattaagatgccccttcaccgtaccaggaaggtttggcagcagatgttacgaatctgggtcctggtgcaggataagagtattgagtgcctggaatggtcacatcatcattaggacaagatgtcttctgttatgactctgtgagccattgggatggtcaagaagacctctataactccacctacacccaggagaagtagcaggacacacatcagggctaagcagctccagcacctgggctaagcagttatgggagtgcagatgcaggcaccccaaataaatatccactcctgccccagtgagtccatagtagaacatccaaagaatagaggcaatcaaccccttgaccccatttgtctgaatttgtcctcttccctctgacaagcattttaatccagctgtaggaaccaattctgtatcttaatgcaatttcttcctttcctttcctttttcctttttcctttcccttcccttcycttctctctctctctttctttctttctctttctttctccctccctccctacctccctttctttmtcccttcctccctccctttcttcctccctccctccctcccttccttccttccttcttcttcttttttttttttttgkcagggtctcactctgttgcccaggctggagtgcagtggcacaattgtggctccctgcagtcttgacctcctggtctcaattgatcctcctacctcagcctcccaaatagctgggactacaggwgtatgccaccacactggctaatttatttttattttttatagaggcagtatttcaccacattgcccaggctggttttgaactcctggactcaagcgatccacccaccttggcctcccgaaatgctgggattgcaggcataagccacagctcycagcctattttttaaggtccaatggagaaatagccatgatttttgctttttttttttttaactgtatcattacccaaagtgtggtattttggtatcttcgaggtctttaagcagaattttgggtagatcttcacttgttctttatctcaatgcccccaaattaattagtggtggtggcggtgggtggttctttggggtacatggccatgttttttactaatttatttattcatcacaccaagrcaccctattattcaggatggagtgggtcttggtgggtatcatgtccaaggtgacaacaggaaattccaggtttctttaaaactgactctagaactccatctcttattctgatggttttacatctcagagttgttgtctcttccaggaggaatgactcctcaggttctatggccttatagtcagggcttagtgtgcagaccctgctgcagatgtcaggaccatgggaaatgctgacagagtagaagcattctttactttagggcccccagtagcacttttccactggagttcttcttctcttcaggttaactagggggtcttatggattttccctgacaacagtatatactgcctgtggcagtttgaccctttagccccctgctatttaaattgtggtccatggattagcagcagcagcagcagcatcacctgggagcttgttagacatgaataatctcaggccccagaatcagaaagtgcatacaaaatccctgggtgatttgtgtggatatcatagtttgagcatcatggctttaatctacagcagtggttcacaattctggctgtgcattagaatcacctggggagctaaaatatccatctctagtccactacagaccaattaaataagaggctctgggggtaaggcccaactttcagtacacttcattataaagcccccttaaaagatactaatatgcagccaagttggaggcccagtgacctagaagagcaggggttctcracattggctgcagtatcaggagcactcaggaggcattaacacttcctatgctcaggccctgagatcctgatttagttgacttgagatggggctgggtatctgcattttgttatgtcttccccattaatagtcgagaatcgtttcccagacaaaagttttgtcgttgtatagaccctgcaaggatgcagggaggggaagcagtctcatgaacaactgtgtctcctcattgtttctgagccaaggtaggttctccttgaccaccttagggtgactatcagagatgcctctggctattggatatactctgcaggcttaagagaatgtagcagattcagagcacatttactctgccattagcctctacctgcctgtcaaggaaaatgagggagctggcaccacagtgaaaacaggcaggaagctcttgaccctgcttgccataggcaccggggtgcaagacaagctgtacacttgagtgtttgctacttgctttactgctgagcttcatcctacccatggagggagcaatggctgaactcaagggccttgtggcctgggcaagtcaaaggagtaattaaagaaagagggtattttgcaggcatcacagtgacatggcctctgtgggtgaacagaataaaactggacataaacatttgttctagagacaagttctcaccagttggtttcattttagggctgtgctgagctctatagagatccaggcgagctgaaggaggacatgtaactctgtctaccatatatctattctctttagggttttaaaatggctctgggtctctgggaactccaggggactactgttcacctacctgcctaattcaggatcccagtgtaggagccgaggtcctatggtgtgcacrggtgccagttccatccctcacaatctttatttttccttcacagttggcgacatgggactcagagaagggcttgaatggcagcttgcaagagaggcccatgggcagccgcctccaaggattgactctyaaagtggtgactgtcttggtaggatcatggggacattytgggagckagcyacaccatccaggctgttgaatcagaggctgctttctgtttaatgctgggtttggggagaagagaatcttgaggagtattgtgagctttcataaggcctttcattcaaataattgtatgaataatgaaaggaagagtgagattgaagtttctgccccaggacctctgtgccttccaaaggaagtccctgagctgctctagaaaaggacttctcattcacagcttcctctgaggaccagagggggccaagctgctccatttgttcttggatgtaaaatggatcttgacccactactggtccttaggagagttgttctggtagccagaaccccaagatagatgctggaggaggacattctcttagcacccaacaccagtgatgggctcatgtgacagtgacacaagttcagaatgaagaccattcggtagttgcaacttttctgcatggatgtcctggaatcatagacttttgcatttgtaagagactttaaaagcatcttcctttcaattgcttttttcacatttttataaaaactgcaggagacattatagacttgcctcttattggctgagtcacacgtgcccaaacgtcccctctctcccagcagacactagcattcccttggcttagaaacctttggcaacagtatttctgcattctctgtttgcacaccacagataagctttacaccctatttcccaacacaactaaattaatgagctatactccctggagctgtttgccaaaggccccttgttcagtttcacacaagaaggaaggggaatggtagggagtgccaagacatttttcagatgaccacctcgctcacatgtggcatagcacaacatgtgcaggtgtgagcatggcatggctttgaactaggaactctgggtttgaattctgtcctaccctttggcttctggtctggccttggtcagttaatccatatccatatccactttctagtatagcctgtagatataatgctttttctctcaacctaatgtcacagagctttatcgccacttactatcctggatgagaagttgcatgtttcttatgtgggcctcatataattttggcatattctaaggatacagtcctagctctgcatggatgttacaaacggaggaaggaaaacaaaccatgttattcagggaactaggggttggggcagagcctgggatgacacgggacaaatgaatctccactcctctgtatggacctactgattggagtgatcatcctgtgcactgttccttgagtgtccataaactgcttttagaaaaaggcagagaagttgagcctgaagtcctaaattggggaactgcaaatgttctaatcagatctttctctctaacattacactggaaatatgtgttgatgaacctgttatttaattggagaaccttcattctgttgtcctcaggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaaggtaggtccccatagcagatccagggggaggggcaccctagtcttcctctggggtaatatctaaacttgaccaattgcacagtggaaaccttgggaccagctaaacagaccacagttaccattctccccacacaaaggctcttttgtcttcaaatcccctgctacatccatttctgctcttgtatctcctcgtctctgacactctatgttacctccctgcccattgctgtcattcctttgaagtctatcatccactgtgcctactctgtagcacacccttcaaggaacctaccctacgtttagggtgaagcagaaacctagttcccaccaggggtactgatgagtgctcattctcctatcccttatagaccacaggttagatattcatacatatgtgtgtatgtctacattgctatgtgttgatggtgtggcatcccccaggtcctcatacttatttaaattgtactcttcttccctcccgtagaaactgcatcttcattgaaactcgtggcatgaggccaacttaccatgtccccattcttgtcatctcatgacactgggtcatttccccatgattatttatcatggtggcatctgactcaaatcctccatctccattatttctcctgccaccattctgacaatttctgacatccctgtggacaaccctggactcccaatactttgacctcctcgcctccagggacctttgctgtactccactccagtgttcacccccatgcatcttgttagcatcttacatgtcaccatcactagcccactgcatgaccacaacaagttgtccttctgactcttttgaacttttactctcacagcacaggccctttgctttttaaatctgtaaaggcagacactaggcttgtcattcgtccgatttctattaatctttttcagaaacacctttactgtgataaattcacatactataaaatttatccattttagatatacaattcaatgatttttartaaagataccgggttgtgcaaccttcattataatctggttttagaatacttccgtcacgccattgatatctttcatacctacttatagttaatgccattcccacccccagccctaggcaaccattaatctactttctatcttatatagagttgcttcagtgaacattttgtgtaaatggagtcacacaagatgtggtcttttgtgtctggttctttccacgtagtgtgtgtatttgaggcccatccttctctgcagcttctgtgcctttctgatactgcgtcctctatgggtggccagacaaacccctcctcccttcatcccttgtgactccctctgttcttaatttttttgttgcatcctaagcctgaatggattctattatctatcctcttcactctgaaatccaggttgctacactaaattagagaaggaaattgtgaatctgtccagattgctttagaaaccctgtgtggtctccaaaatcagctgggcccttcagtactgccagaatcttttaacttgtcctttgttgggctccttggctatgtctctcagagaccgtttaaaaagtttacctttcttcttgagctacctaagaatcttctatccttcccaactaaaaaaaaaaaaatgattgtacttctatattggggaaataaactgagattttggggcataaaattgtacctctaattcctatgaaatttacatctgcaggcacctgccatctcccacagaagggagtgtcccctgtcccctgtcagtctgtcccacygtcacaggacaacccctccacctgtgtcatgagttgattcctttgtgcctcctttgaaccttgcttcataaattagtttcccttcattttgtcttgtaagcctatcctgctccattaaatctctttttaagcccttaaatatgctccaaactttcctaatcctaaaaattgtccctggatgctagagtttttagaagagaggcaagaaccagagatgccagtgtgacaagtgtaagaggagagtgttgatagggtcacttcctatttgctgcctttactcaaggtatagtattagatttctgtttaggacatgagtatatctgtccctagcctacatattaaaccttgaaaaaatccttccacgtgtgtttcctcagtttgagcttggaggttgaatcagttgtcactattggtcattctaaaagaaactagttctgctgatgcctcccactttgagggtcaagaggccagatcattatgatgactgcctttcagtgctcttgtgactaaaggaggaccctaagccccattgtcacctggcatccacccatccggacatgaaacccgtaatcgccccaaacttggcagttttctcctcacagtctggatccatcttaatggggtttctgtctgtttttaaaatgaagcccattttggaaagcaaacatcttgggaggtaattttaaggtcatagtagggcacatccagagagattcttcacaccatggctttaccatggaagaataaacctgtgggtttgcaagccatgaattaagggtggtggaagatagaaataaatatatgacccctttattctttcagtattttactctctggcatgaagtctacatatgaaacactcactggctaatatgttaatgaggtctaacatagttgtagaactcaccatataacttctgaagtgttttagaaaagagaaagatcaatgtgggataatagagtctgagaggtgtgatgaagaaatggagtgtgcctctggtcttaacatgtagggaggatgcacacaggcctagaagatagaagggccttcttggtggagggtagagggaaacatagggaaaataaaaagaagatagctaaagtttggtaggaaaacaacaaagtgaagataaactataattcgtagagaaatgaagatactttactcggctcttttctgtagaagcagtttcctgaagtttttagaagagagagacttgtaaggtgaaggaaatagtaacagacaacttagtgttggattttccttataatattcagactctcagggtgccagctctcaaatccattcctctgaacagagcaactcaaaggacagagggtggaccttgacccagggcagaacccagcagtaagctgaggactgccgtctaaatgagatggctttgcctttcagagagcagacttggccatctctgccatcaccatcaccccagagagggagagcrttgtggacttcagcaagcggtacatggactattcagtggggattctaattaagaagcccgaggagaaaatcagcatcttctccctctttgctccatttgatttcgctgtgtgggcytgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtacctttctggtttcctgatcattgaatagctctaggggcctggaagaacttatccattggcaaagttctcaggtgcattttaccaaagtcattccaaatgcaattttacttaatctctaggacagtacaaatgtcatgctgcacccaatttctctgaataatatcagagagaaattaaatgaaacaacaataaggagctcaacttcaattcctgattctccactttagataaaattaactttggagtcctgctttgcacttttctctcctcctacattaaagtgattgctatgcacatgaggttgtcaatgaaactgtgaatcttgcttaaatttgatgacttaatggggaaaaaaaatcccaattgtattgcaatcatttaagcagtacttcagccattcttgaggtacaaattctcctacctctgaggggtctggatggtacttctatccactagtgagttataggattgtgccattttgactggagcaacaaattgcaaagtttctaatgtgagtcttcatcctgtttgcaccatggcaaatgctttgtgaggttatgtaaggagaataagcagtgagaagctctcttctcctaacactttagagaccaaggagaaataattggcctcaaagaggctaaacttctaactaaaagtctcatgccctgatttctgagaattctgggggaagaaaagccatctaatgagggctgaatactaataaaagtgatatgggacatctcatttctcaggtttaaaagaaagccagggatccctccatgtagtaggagttatttctatatttacagaattcccgagtctgctatatatgaatttgaaattggaaagggatcttacataaggctgcagccctagaagttcttaccactgtgaggtagaatcttctaactgaaagattttgatattcagaccccaacccttggtgttttgacaaccttcgcaccactagaagcccagtcctaactttttcatattttgtggtcctctgcccttgtccaagatccatggttttaggatcctatcccagaattggcacagatgcccagacccagctgacagtcacctccctggttccagcccatcacgagtgatggcctgtgtgcctggctgcagggcagaacacctccctggggataggagggagagcagaagccactggccaatccactttgtctgcctcccgcaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggtaagcctattcctccttgatctggagccagcagctcagagaggctttaaagaggatgtaaacctttccagggcagtgtggtatgatggagagagccctgatctgcaaactgatggtctcctggaatctttagtgcatggagaagagcttcactcctgttgtattttatctcaggcacaattacataaatgtataaattcattaaataatatttcctgaaaatttaatgctggctacaaagctaagaaatcaattaacaaattacattttctcagacatttaaacattgattacaaacttatttaatcaaaattttataaatatttagttaaaattaatttaaaccagaagtctaatatatgcttttttcaatcttcgaacaccttaaaataatttttttcaaaaatgccaattgccacaataagtagaaaacatatttcatgcacatttatatgattataaaattattgaaaccaagactaaaaatgtgtcttcatgtttacaaaatgttaagattatggcataaaagaatgagctcaatatagcgaaataactcttggaagtgactgtattttatgatcagattcccaaaaatagtgtaaattacaaaaaaaagaacttggacagagtgaatttggttggatgtgtggttgttgaagtggtcataggcatggatctgttgtacacttcattgggtacaatattggcttcaatattgcctctaacttgatcgctgattatggttttttgactcactgcctttagtaacatccctttaaytcatcacactcactgtcatcatattggttcttttgatccatagctcttaatcaagtcgtccatactcaaccagcctctatgggtctcaactagctattgaaaagagtttaaactccttgcctaggattcaagattcagtatgatattgtctaatatctttattaaattgacatttttattgagataattatagattcatatgtagttgtaagaaataatgcagagaggtctcctgggatcctttacccacttttctcaatggtaacattttgcaaaagtctaatattatatcaaaaccagggtattgacactgatacagttgactgattttattcactgttcccctcttgtactcatctctctgtgtgtctgtgtatatgtatgtgtgcattcgggtctatactattttatcacttataaacttgtgtatctgcaccacagtaaaaatactgaacagatctatcaccacaaggatcctttgtgttgtccttttataaccacccaaatatttttcacatttcttcccctgacactctgtccccaactctggcaaccattaattgtactccatctctaaaattttgtcatttcagtatgtgatataaatggaataatgccttttggctttggtttttttactcaacataattccttagagattcgtccacgttttcatgtgtattagtagttcactgctttgattatatcacatataccacatatgagtaatatcacatataccacagtttgtctaactattcccccattggaggacatctgggttgcttccaattcttggcaattatgaaaaaagctgccatgaacatttgcgtgcaggtttttgcatgaacatgagttttcatttacatgtgataaacacccaagagtgcaattgctggatcatatggcaagttcatgttgggtattgtaagaaagtatcaaactgctttccagcgtgtctgtatcattttatatttctgccagtgatgtaagaataatccagtttctctgcatctttcctgacatttggtgttgccattatttttcattttaccattctgataggtgtggagtcatacttcattgtggttttattttgcaattcctgaatgactaatgatgttgcacacctttttttgtgcttatttgctatgtatatatccccttcaataaaatatctgtttttatcttttctaaatggattgcttattacttttgagttttgaaagttcttcatatattttagacactagttctttgtcagatatgcrgtcagcaaatatttgctgccactctatagcttgtcttttcaaactcttgtcttttcaccrtgaaaaggttttaattttgatgaggttcaatttagagaattatttatttcacgaatcacgcttttgatgtcaagtcttttcctagcctgagaccccgaagattttctacttttattttttactgaaaacgtttgcattttacaattcagtccacaatcaattttgagataattttataaagtttgaggtttaggttgagagttttggggkttttttttctcttcttttcttttctttctttctttcttttttttttttgtctgtttgttttggtctatggatgcccaatagctttaatactatttgttgaaaaggctatccgtcctccatggaattgcttttgtattttgtgagaaaacagttggacatatttgtatgtatctaaattgtctattctgttccattgttatatgtgattgtccctttgccaacaccatactatcatgattacagtagctatagcgtaagccttactatagggtagagtgattcctcccattttaatcttctttgttagcattattttagctattctaggacgtgcatctatatatataaattttttctcatttgtattttttgttattttcaaaattatcacctaaaggatttcagaattgtattcagagcaaatcgactaactgaaaaattaacagaacacaattaattaaaattttcccatttaataattaataaataacaaagtatcagtgactctaatagtggactgagtttgaacccagctcaataattagttggctaaatattttcctcaaaaacattgataaagcaagtaaccatttactattatcctgatcttttgctaagtttatttatttattttttctttttgaggtattattgacaaataaaaatttacagtatacaacatgatattttgatgtaaacagggtctttcactgagaaaatgttttaattttgatgaggtcaaatttagaaatttgttctttcacggatcattcttttgatgttaagtctttgtctatccagagatccttaagattttctcttgttttaaaattcctaacatttttatatttttacattttacatttcattccacaatcaattttgagtgaatttctgtatgaagtttgaggcataggctgagggcttttttttcagtctatggatactgatatggtttggctgtgcccccacccgaatctcaacctgaattatatttcccagaattcccacgtgttgtgggagggacccagggagaggtaattgaatcataggggcctgtctttcctgtgctattctcatgacagtgcataagtctcacgagatctgatgtgggtttatcaggggtttctgcttttgcttcttcctcattttctcttgccaccaccatgtaagaagagcctttcacctcccaccatgattctgaggcttccccatccatgtgaaactgtaagtccaattaaaactttttttttgttcccagttttgggtatgtctttatcagcagtgtgaaaacaaactaatacagtaaattggtactgaatgaggggcattgctgaaaagatacccaaaaatgtagaagcgactttggaattgggtaacaggcagaggttggaacagtttggacggctcagaagaagacagaaaaatgtgggaaagtttggaacctcctagagacttgttgaatggctttgacaaaaatgctgatagtgaaacaaacaataaggtccaggctgaggtggtctcaagtggagatgaggaacttatcgggaactggagcaaaggtgactcttgttatgttttagcaaagagactagcggcatttcgcccctgccctagagatttgtgaaactttgaacttgagagagatgatttagggcatctggtggaggaaatttctaagcagcaaagcattcaagaggtgacttgggtgctgttaaaagcattccattttaaaaggaaaacagcataaaaattcagaaaatttgctgcctgacaaagcagtagaaaagaaacacccatgttttgaggagaaattcaagccagctgcagaaatttgcacaagtagcaaggagcctactgttaatccccaagaccgtggggaaaatgtctccaggccatgtcagagaccttcatggcagcccctcccatcacaggcccagaggcccaggagcaaaatgtggtgtcatgggctgggccctaggtccctgtgctgtgtgcaacctagggactttgtgccctgtgtcccaaatgctcccaccatggctgaaaggggccaacacagagcttgggctgtggcttcagagggtggaagccccaagccttggcagctttcacgtggtgttgagcctgcaggtgcacagaagtgaagaattgaggttcaggaacctctgcctagatttcagaagatgtatagaaacgcctggatgcccaggcagaagtttgctgcgggggcaaggccctcatggagaacctctgctagggcagtgtggaagggaaatgtggggttggagtccctactggggtgtggactccatatgtggaaatcaaggagtcaggagttgaggtttgagaacctttgcctagatttcagaagatgtgtagaaatgcctggatgcccaggcaaaagtttgcttcagaagcgaggccctcatggagaacctctgctagggcaatgcggaagggaaatgtgtcatgtggagtccctacacagagtccctactggggcactgcctagcggagctgtgagaagagggccaccatcctcctgaccacagaatggtaaatccactaacagcttgcaccgtgtgcctggaaaagccacagacactcaatgccagcccatgaaagcagccatgagggaggctgtaccctgcaaagccacaggggcggagttgcccaagaccatggaaaccaaccttttgcatcagtgtgtcttggatgtgagacctggagtcaaaratcattttggagctttaaaatctgactgcccactggatttcggacttgcatgggccctgtaacccctttgttgtggccaatttctcccatttagaatggctgtatttacccaatacctgtatctccattgtatctaggaagtaactagcttgcttttgattttacaggctcatgagtggaagggacttgccttgtctcagatgagactttggactgtgaacttttggattaatgctgaaatgagttaagactttggaggattgttgggaaggcatgattccttttgaaatgtgaggacatgacatttggaggggccaggaatggaataatatggtttggctctgcctccatccaaatctcagcttgaattgtatctcccagaattcccaggagggatccagggagaggtaattgaatcatgggggccggcctttcccatgctattcttgtgatagcgaatagtctcacgagatctgatgggtttatcagggctttctgcttttgcttctccctcattttctcttgcctacgccatgtaagaagagccttttgcctcccatcatgattctgaggcctccccagccatttggaactttaagtccaattaaaccttttttttttttgttcccagtttcaggtatgtctttatcagcagcatgaaaacaaactaatacagacacttaattcctccagcactatttgttgaaaagactgttcttcttccattgaatataccgtttgcatgtgcactacgaaatgattactaaaatgaagctaagtaacatatctgttacctcacacagttatcagttttttgcatgtgatgagaatatttaagatctgctgttttagccaatctcaaatgtataacacaattttattaactatagcaccatgctgtacattatatctccagatcttattcatcatacctaactgaaattctgtactctttgacaaaaagctcataattcccccacactccagtccctggcaaccaccattctctggcaaccaataaactctccgcttctatgagtttgactctttagattccaaatataagtgagagcattcagtatgtgtctttctgtgcctagcttatttgagttaacataatataatatttgagttaacgtaacataatatcctctaggttcacccatgttgtcacaatggaaatatattttatttatatattgtatatattaattatatataatgtatcacatttatatattatatatgtatatataatatatacaaataattacattatgtacattgtatatgtgtatatataatatataatcacatttatatacgttatatatgtacatatataatatatcacattttcttttttattttattttattattattatactttaagttttagggtacatgtgcacaacgtgcaggtttgttacatatgtatacatgtgccatgttggtgtgctgcacccattaactcgtcatttagcattaggtatatctcccaatgctatccctcccgcctccgcccaccccacaacagtccccggtgtgtgatgttgcccttcctgtgtccatgtgttctcattgttcaattcccacctatgagtgagaacatgcggtgtttgttttttttgtccttgcgatagtttgctcagaatgatggtttccagcttcatccatgtccctacaaagggacaataatgtccaattatttgcagataaaaagttaggttgattctggctgggtgcagtgtctcacgcctgtaatcgagcactttgggaggctgagactggtgaatcacctgaggtcaggagttcaagaccagcctggcaaacatggtgaaacccagtctctagtaaaaatacaaaaagcagccaggcatggtggcggccacctgtgatcccagctactcaggaggctgaggcaggagaatcacttgaacctgagaggtggaggttgcagtgagccgagatcatgccactgcactccagcctgggcaatagagttagactccgtctcaaaagaaaaaaaaaaaaaggttagttctatatcttgccaatttctaataatgctgcaatgaacatggtagtgcagacaaatatctcttcaagatactgatttcatcttctttggctctgtattaagaagtaggatcactggatcatacggtacttctatatttaagtttttgagaaattgccatactgttttccatattctcatcatcacttgttatcttttgtcttttttttatcatagccattctaacaggtgtaaggtgatacctcattgtagttttcatttgtatttccctgatgattagttatgttgaatattttttcgtatatcttttggtcatttatatgtcttcttttgagaaatgtctattcaggtccttgcccatttttaaattaaactatttgttttgtggttagtgagtttttgatttccttatatattttggatattagcacattatttgattttctgtcattttgcaagttgtctcttcactttgtagattgtttactttgctatgtataggattttaaaatttgattcagtcccatttatctattgttgcttttgttgcctgtgcttttgggtcacatccaaaaaatcacgccccagaccaatgtcaaaaagctttttttcttctggaagttttacagcttcagctcttacatttaagtttttaatttattttgagttgatttttgtgtatggtgtgaaataagagtctattttcattcttttgtgtgcagatattcagtttctccaacatcatttactaaagagactgtcttccccattgtgtgttctttgcaactttgtcaaagatcaattgactgtaaatgtgtgaatttatttctaggctgtattctctttcattcgtctatatatctgtttttatgccaatactatattgttttaattactatactctatactgtatttcgaaatcaggtagtgtgatgtcttcagatttgcttctcttgtttaagattgcattggtattcagaggacttttgtggtcacaggaattttacgattttttttccatttctgtgaagaatgtcattggtattttggtaggggttataccaaatctatagatcactttgggtggtattaacatattaatagtattaatttttccaatccatgaatataggacatctttccatttatttgtgtcttcttcagttttttcaccaatgttttatagtttacagcatggcatacagatttttcacctccttggtgtaatttatacaccagaattttatttttatgctattttaaatagaattgttttttgatttgtttgcaaatacgttgttgttagtttatagaaatattcctgatttttgtatgtttattttgtatcctgcaaatttactgcactattattagttcctgcatttgtttggtgaggtcaaggattttctttatagatcacgtcatctgcaaatatatgcagttttacttctttctctctgatttgaatgtcttttatttctttttttaaaaaaaaacttttaggttcggggtacatgtacaggtttgtttatagataaactgtatgtcatgggggtttgatgtacagataatttcatcactcagataaacatagtacttgatagccatttttttctgatacgctccttcctcctaacctccaccctcaaataggtcccagttctgttgttcctctcgtatctatccatgtgttcttgttgtttaacttccatttataagtaaaaacatgtggtatttagttttctgttcctctgttagtttgcttcgaataatggcctttagctctatccatgttgctgcaaagaatattatcttcttcttttttatggctgcatagtattccgtggtgtatatgtatcacattttctttatcttttatttctttgtattgcctaattgttctgaccatgccttccagttctatgttgaatagatatggtgagagtgggcacccttgttttgttcctgatcttgcaggaaatgcttttagctttttactgctgagtatgatgttagccataggcttcatatatagcctttatgatgttaaggtacatgacatttagtcttaatttgctgaaaatttttatcatgaaagatgttaaattttctctaatgatttttctacatcttttgagatgaatatataatttgtttccctcattttgttaatgtagtgtatctcatatcttgatttttgtatgttaagccattcttgcatcctgggggtaagttccacttgatcatgggatatgtttttttttttttttaatgtgctattgaattaggtttgttagcattttgttgaagatttgcacatctatgctcatctgggatattagcctgtagttttcttttcttgaagattccttgtcaggctttgatataaaggtgtaatggtggtcttgtaaaatgagtttgaaagtgttcccttcaatttttttggaagtgtttgagaaggattggcatttttctttcttgggaggtttctgattactgtttcaatcttattacccactattagtatgctcagattttctatttcttcagcaatcagtctcagtaggttgtacgtttctagaaatttatccatttcttcgaaattattcagtttgctgttgaaaaattgtttatagtgttctcttatgaccctttctatttctgtggtattggttgcttctttttcatttataattttttttctttgaaacttcccacctttttcttagtctagctaaaggttttccaattttgtttatctttccaaaaaagccaatcttagtttcattgacctttggtagtgtctttctagtctctattttatttatttctgccccgatctttattattttcctctttctgctaactttgggcttcgtttgttcttctttttgtagttccttgagatataaagttagaatatttaaaaggtttcttttttaatgtagttttaatcaacattaacttccttcttagaggggctcttgctgcatcctattatttttggtatgtttgtgtttccatttttatttgcctcaagaattttttttagtatcccttttgattttttctatgatctacttgttgtttcagggatgtgtttaatttccacattttataaattttcttattttcctccggttattgatttctagtttcatagcattgtggctggtgaagatacttgatatgatttcagtcttcttaaatttgttaaacttgttttgtggtctaacaggtaatatatcctggagaatgttccatgaaagttgaaaaagaatgtgtattctgtggttattggatggaatgttctgtatatgtttgttaggtccatctggtctatattgttgtgcaagtctgcttttacttattgactttctgcctggatgatctttccattgttgaaagtggggcattgatgtccccaagtattcttgtatcgctatttctcccttcagttttktcaaaatttacataacatatttatgtgttgtaatgttgagtgcatatgtgtatatgtacacatgtgtctattttgttggatataagtatagtcaacctattctatcaccacttgcatggaatatctttttccatcttttttctttcagtgtgcttgtctgaatccacagtgaggcacctgtacagagcatatagttggatcatgttttttaaatcattatgctaatctctacttttaagtaaatgtttaatccacttatatttaatataatttctaagaaaggacttagctctaccattttgctatttgatttctatatgacttacatcatttgtgttcctcatgttttctgttactgccttcttttgtgttaaatggatattttttctttaccattttaactcccttgatatatatatgtatatgtacacacatcatatgtattattattattatattcttagtagttgcacaggacactacaattaacatcttaataacaatttgtgttggattaataccaactttagttcaataatatacaaaagttatgctcttatatagttctgttccacctacaccctgaccttaattcttttataaaactgtttgatgtgctcttttttaggagttaattttaatacttttaattgattcagtagataatcttctatatttagttttaaatttgttatttttttacttgttgaataaacttcacaagttttaagaacaactttaggtattagaagatattactaaattatgtgtttattctgatttaaatttttattggtaaaatatacataacataaaacctattattttaagaatttctaaatgtatagtttagtggcactaagtatattcacattgtcacaatcaacattaccatctatctccagaaaacttcatcttgcataactaataatctgtacctatgaaagaactaatttcccattttctctggatgctggaaaccaccattctattttctgtctgtataaatttgactactctaggtacctcatattaatagcattatatggcaattgttttttatgaatggcttatttccatttcactttcttggtttcaagattcatccatgttgtagcttgtgtaagaatatccttcctttttaaggctgaataatatcacattgaatgtatatatcatattttatttatccattcatctatcagtggaatcttggattgctttcacattttagctgttgtaaatactrccgttataaacatgggtgtacaaatacctgttcaatgcctgcttttaattcttcggtgtatatacccagaagtaaaattgctggatcatatggtaatcctatgtttaatttttttgaagaataaccatacagttttctacagcagctgcatcattttacattcccaccagcaatgcacaagaaatccaatttctccaaattgttgccgacacttgttgttatctgctttttgtttgtttgtctgtttttttaaatagccatttcaatggatgtgaagtagcatctcattgtggttatggtttgcatttccacaatttaaaattttgtgcatttgtatgtgtttattgtcaaatttgcatatctcctttggagaaatgttattcaagttctttgtctatttttaattgaatcatttatgggttttctttgttattaagttgaaggggttctttatacattccagatattaatccattatcatatatatgatttacaaatatttttctattagcaggttgccttttcactctgctgatagtgtcttttgatgcagaaaagtttttaattttgwtgaagtccagattatccctttgtctcttgttgcctgtactttaggtataatattcattgccaaatctaacgtcataaagctttcctctatgttttcttctgggagttttatgattttagtgttaaatttaaatctttgagccagtttgagttaatttttgtgtatggtgtaaggcaagggtacagctgcatttttctgcatgtggatatccagttttcccattacgatttgttgaaagactatcctttcttctttgaattgtcttggcaccctcatcgaaaatcatttgaccatacccaagagggtttatttcagggatcactagtctattccactggtctatatatctgtcttcctaccaatactacattgttttttattatcatagctttgaattacatttggaaatcataaaatgtgagaccttcaattgtgtttttttccaagacgttttggctatttgggggtcccttgaaatcttgtaccaattttagttttttttatttctacaaaaaatgtcattggaattttgttagagattgcattgaattagtagatcattctgaacagtattgccatcttaaaatattaagtcttccaatccattagcataagatgtctatttatttgtgcctttaatttctttttagcaatgttttgtggtattttttttcaacttttaaattgttttttatcacctaagtaaatttgtatttgacatttgggttacatgtggatgtaaatatagacatatcactcaacagacatatagaacagcaaagaggaatacttctattctggtttagctatggtctatattcctcctcatgaaataacctagacaaaaattaagaggtatgaaaagtgccaaatattgatttaatacattttcctctctttcttatcttttaaatatacaattgtgcactatcggtgtgagtgaattaaaataattctaatccagactatgagctccatgggctaaaagagagagacagcgtaggtgagtggagggcacttgtccttcatcaagctattcacacaaattaattgaagaggtagactaaattctctaagtcttgatgggcttagatgttacataggtcttcaagtgatgttttactttattttgctttaatttattgccctatatgttgtatgttccactagtcttgtaattgggccaaagtgaaaggttcaactagtccaagaatgcttaatataccccataaactgtctgaatcaaatatttttatttattgttcagccaaacacaactgatttccatctacaattattttttaagataagaaacagtaagtcaactgaaggaagagctggggtatcaagctgtagaacattattgcactttagcacactgactgagaaatgcagaacctcaggtggggtcttgtcactgttggctgcagcagggcataagcccagcctcggtgggccttttccaagaatgctctgcagcacctgacacattgctggtataccatctcaaagtcagggtcattcccttaacaggggttttcaataacaagttgttttggtgaatcatagcacccaagtagttcaattttagctttgcagtttttaacttgaggaaattttctattcaaatctctcaagttgctttcattgatatatggtatataatcaaatgtggtaaagtcttctttgataatctgctgagccatgtgattcatgggcataccatgcttcttcatgcaattttcctccctgtaatctggagggtttcctatttcatatgtggaggtcactgcacagtctatcctccaaaatatctgaaacattttgttcattacaacctttctgaaaattgcttctgcaaacaagtgactgactgcaatgggtgtatgtgttacccagacacatacacaacactgaattgggcacatgcttggccatcttctcttaagttttgctttatgcacttatgtaagccacaacttcattagggctcaatattttgccaatatgaaatgatcattttccaatttaacattgtataccttaaatctactttattgaatattggtgtgacactttttgattactattcttatgagtttacctgaaaagtatttgtcatatttgaatcattgtgctttaggtatttctcttggaatcagcatgtattgtatttctgatcccattttattaatcttgtattttttttttttttgagacagagtcttgctttgtgccccaggctggagtgcagtggcacaatctcggctcactgcaagctccgcctcctgggctcacgccattctcctgcctcagcctcccgagtagctaggactacaggcgcccaccaccacgcctggctaatttttcatatttttagttgagatggggtttcactgtgttagccaggttggtctcgatctcctgacctcgtgatccgcccacctcggcctcccaaagtgctgggattataggctaatcttgtgttttttktttttttttttattatactttaagttttagggtacacgtgcacaacgtgcaggtttgttatatatatacacatgtgccatgttggtgtgctgcactcattaactcgtcatttaacattaggtatatctcctaatgctatccctccccacacccccgaccccacaacaggccccagtgtgtgatgttccccttcctgtgtccatgtgttctcattgttcaattcccacctatgagtgagaacatgtgatgtttggttttttgtccttgcaacagtttgctgagaatgatggtttccagcttcattcatgtccctacaaaggacatgaactcatcattttttatggctgcagagtattccatggtgtatatgtgccacatttccttaatccagtctatcattgttggacatttgggttggttccaagtctttgctattgtgaatagtgccgcaataaaattacgtgtgcatgtgtctttgtagcagcatgatttataatcctttgggtatatacccagtaatgggataggtgggtcaaatggtacttctagttctagatccctgaagaatggccacactgacttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgagcattttttcatgtgtctgttggctgcataaatgtcttcttttgagaagtgtctgttcatatcctttagcccactttttgatgggattgtttgtttttttttcttgtaaatttgtttgagttcatagtagattctggatgttagccctttgtcagatgagtagattgcaaaagttttctcccattttgtaggttgcctgttcactctgatggtagtttcttttgctgtgcagaagctatttagtttaattagatcccatttgtcaattttggcttttgttgtcattgcttttggtgttttagacatgaagtccttgtccatgcctatgtcctgattggtattgcctaggttttcttctagggtttttatggttttaggtctaacatttaagtctttaatccatcttgaattaattttagtataaggtgtaaggaagggatccaatttcagctttctacatatggctagccagttttcccagcaccatttattaaatagggaatcctttccccattacttgtttttgtcaggtttgtcaaagatcagacagttgtagatatgtggcattatttctgagggctctgttctgttccattgatctatatctctgttttggtaccagtaccatgctgttttggtgactgtagccttgtagtattgtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattsattcttcctacccatgagcatggcatgttcttccatttgtttgtatcctcttttattcactgagcagtggtttgtagttcttcctgaagaggtccttcacatcccttgtaagttggattcctaggtattttattctctttgaagcaattgtgaatgggagttcactcatgatttggctctctgtttgtctgttattggtgtgtaagaatgcttatgatttttgcacattgattttgtatcctgagactttgctgaagttgcttatcagcttaaggagattttgggctgagacgatgcggttttctagatacacaatcatgtcatctgcaaacagggacaatttgacttcctcttttcctgatttaataccctttatttctttctcctgcctgattgccctggccagaacttccaacactatgttaaataggagtggtgagagagggcatccctgtcttgtgccagttttcaaagggaatgcttccagtttttgcccattcagtatgatattgactgtgggtttgtcataaatagctcttattattttgagatacgtcccatcaatacctaatttattgagagtttttagcatgaaatgctgttgaagtttattgaaggccttttctgcatctattgggataatcatgtggtttttgtctttggttctgyttatatgctggattacatttatttatttgcatatgtttaaccagccttgcatcccagggatgaagcccaagtggtggctcatggtgggtaagctttttgatgtgctgctggattcggtttgccaatattttattgaggatttttgcatcgatgttcatcagggatattggtctaaaattctctgtttttgttgtttctctaccaggcttggtatcaggatgatgctggcctcataaaacgagttagggaagattccctccttttctattggttggaatagtttcagaaggaatggtaccagctcctccttgtacctgtggtagaattcggctgtgaatccatctggtcctggrctttttttggttggtaagctattaattattgcctcaatttcagaggctgttattggtctattcagagattcaacttcttcctggtttagtcttgggagagtgtatgtttcgaggaattyatccatttcttccagattttctagtttatttgtgtagaggtgtttatagtattctctgatggtagtttgtatttctgtgatatcccctttatcatttttcattgcatctatttgattcttctctcttttcttctttattagtcttgctaggagtctatcaattttgttgatcttttcaaacaaccagctcctggattcattaattttttgaagggttttttgtgtctctatttccttcagttctgctctgatcttagttatttcttgccttctgttagcttttgaatgtgtttgctctcgcttctctagttcttttaattgtgatgttaggttgtcaattttagatctttcctgctttctcttgtgggtatttagtgctataaatttccctctacacactgctttgaatgtgtcccagagattctggtatgttgtgtctttgttctcactggtttcaaagaacatctttatttctgccttcctttcgttatgtacccagtagtcattcaggagcaggtttttcagtttccatgtagttgagcggttttgagtaagtttcttaatcctgagttctagtttgattgcactgtggtctgaaagatagtttgttataatttctgttcttttacatttgctgaggcgtgccttacttccaactatgtggtcaatttttgaataggtgtgatgtgttgctgaaaagaatgtatattctgttaatttggggtggagagttctgtagatgtctattaggtccacttggtgcagagctgagttcaattcctggatatccttgttaactttctgtcttgttgatctgtctaatgttgacagtgggatgttaaagtatcccattattattgtgtgggagtctaagtctctttctaggtctctaaggacttgctttatgaatctgggtactcctgtattgggtgcatatatatttaggatagttagctcttcttgttgaattgatccctttaccatyatgtaatggccttctttgtctcttttgatctttgttggtttaaagtctgttttatcagagactaggattgcaacccctgcccttttttgttttccacttgcttggtagatccttctccatccttttattttgagcctgtgtgtgtctttgcacgtgagatgggtttcctgaatacagcacactgatgggtcttgactctttatccaatttgccagtctgtgtcttttaattggagcatttagcccatttcatttaaggttaatattgttatgtgtgaatttgatcctgtcattatgatgttagctggttattttgctcattagtttatgcaatattcaacattcttaaagaaaataattttcaacccagaatttcatatccagccaaactaagcttcataagtgaaggagaaataaaatactttacagacaagcaaatgctgagagattttgtcaccaccagccctgccctaaagagttcctgaaagaagcactaaacatggaaaggaacaaccagtaccagccactgcaaaaacatgccaaattgtaatcttgtattttaaaggagaatttttaactatcgatagttattataatataaatatatgattttatttttctcatgtccacttgtgcatttcaaattttttatggtgtttagcrttctgttaccattattattactatagttacctcctacctgaagttaagcattttcttttaatctccagtggttttctttaggcttaaaaatacatgcaactccatttctctttcagaattaacagtgaaactatatattcatatctctccttatgtaaggtaatactaaaataccttttttcctcctctccttcttcctcctacttaatctttgtttacakaatcttcgacccagtttactatgtttccttttttcttcttaacatcctatatggcgtctctaagatatatatttgcctttcacattcttttattttttcccatccatatctatagttacaattaagactgaattctatgctccaattgttttaatgattgttgaatgtttctttatactatgatttagccgctgttcatttctttattttgatggattttttatcagctggagtagctttttgagcaatataataagtagtatgatttctgagacagcatatctgagaacattttctgttgmctttatacattaattaaaacatatctgtatataatattcttgtgtcacagctttcctctctaatattgtttagaatttgctcgattgccttcttcctgtgtgtcatacaatggagaaactttcacctattgattttcctctcctcttttactttctctcttaccccctcacaactttctctcttctcccctcttttcttcatctccttatttcctcctcctttctccttctgtctggttcattttttcatcttctttttccttatgctccccttcttcctctttctttccttttcaccgtcttcctcctcttttccttctccttctcctccccttttttcttctcacttaccacatgcctgtttttctctttcttccttcttttcctccccttccttttccacttttttctcatctctcctctctgcctccgtttatcctcatactgctctttttcttcttctctttttgttctccttttcctttttctgttgtccgtcttcctcttccacttttttctcctctcttgtgctttctcctttgtagttatccttactaatgtctttcaacttaaaaacttccggagttggttgatatgccattaatttttctcaggattcagtgaggtctttgtatatgcaaacagaaacttgcactttagttcaataattttgtcatctattaaatatttccttattatttatatcccatttatttgcatgttgtttacaggaacattgatttttcatatgttggtattatgattactccacatctgtcacattctctgatcattttcaattcatttccttttcctgctcattctggggagttccttggtttgtctttcatatttcagattagattttctttagttttcacatgccttttagcaatattaatgactatataagttctacttatatatttttatttccccttcattctttcttgctttgactctgctagtacttctttcatttctcagccaatgttttatggatttcattttatagttttgttataaagagtccttgctgtagtaaattatagtatttttaaaattttggctttgttttccttagcatatgcttttctaacaatatattctttagtatctttaacacaatattatgtaaatatatttatgtattatttctttcataatgatatcttcctttatgtctccatattgttgttgttttctaatttggaaatatcttcatgtacttttccccattggttgttggggaacaggtggtgtttggttacataagtaagttctttagtggtgattagtgagattttggtgtacctgtctcccgagcggtatacactgcactttactatcccttgaccccttcccacccttgcccccaagtcccctggtccattgtatcattcttatgtttttcctcctcatagcttagctctcacatatcagtgagaacatatgatgtttggtttttcattcctgagttacttcctttagaataatcagtttttgtttagtttactcttccttgaatgtggagagctctttccataaacaggtgggttgattctctttggatttcctaatagtacatctggatgcagttagaatcaccctttcaagtcttaacctgggcttgtgagtacaggtggagactgtgatataaatttaaatccccattatcaaaactgtgccttagtggaattttttcttttgagttttttgccccagtgacaaagtttcattttctagcattcggattgatacagcctcaacaacagtaagagaaaccactgtgtaactttttgtaaccttttttttttcttggcgtccatattctctgctatttactgacaaattactattgttcagagaaaaatgctggtaaatgaggrtttctgcatactgtacccagcagagctgtgaggaacctaggcattttccgttgttactgctctgaattactttgtctctgtaratataagaagaartccacggagatgatgcattttcaaagtgagaagaatttgaatctcccattgctgtatcccattaattttttccttctcccctagaaacctcccaaagagtttaaataagtaggtagcagccttccctggttcatgatacatgatgccccagattttaaaaaatggcctgttcatttcagtaggtatctgaaaagagtaaggatgaatatctgttctctctttataaacatattttcttagttatcttcaacttataaattttcaacctaatataaaaccattcaataatgattgcaatccaccctgtccatataaatgttcatcattactgtcttagtcttaggaatctatacattccttaaaagacatggacaatgccagcatccaagagaactgaaatctaaatctctgcttctaaagagcagagattcacttatcaattacattaagcaatttttacctttttctttggggttgagtatgaggtatgttcattgaggagggaatatctcatttttgttcactaagcagtctcaagctgctgtaattactttcatttcctttacaattactaatagatgtttacctgctataatgatgacagcagagtcatttgaaaaaggcagcattggcatgaggttgaacactacaggcaccttttaatagtgcctttaggaaatgcatcattaaacccattaatgtttgcatttaggaaatactttgtttaaaaatcctatgtgagtagcatcctacattcagaaagatcatatttggcccagaggctcaggttggaaggcaggaggacagtggcatgactaagaaagacaacaaggcatagttgtcatgagcatagacacaggagattgactgactggtttcaaatcctttctctctcacttactacctgtgtaatcttggaaaatcacttaacctgtctgtttttctcttttattatctatatgtagggataagaatagcaactatctcacaggcttattgggaagattatctatgttagagtttataaagttacctggcacatagaaagggccatacatctgctagatattatcattacggttgttgaaaaagtccttcatagtcaaaggaacagctctgagatttggagtcctgggctgaagaacgccagcatgcctgggtgatgtgggagagaagattgtagtctaggaagtaggcagctccattttgaaattgtcaccacatagctggatggcattagaaactattctgatgtttagtttccatatatgtaaaataggcatgttggtataaactgcaatttaagatgtttgctcatattttcactggaaacatcacatttgtaaactaaaataagcgaatactttgaacagataaattattgcgttaaactaaggaaagataggcaatctataattagagatttgtcttgtgtccacaaatctgcacagattcagaggagaaaataaaaagactgaattcaccagaagcctaatttatcctgaggtagaattccttccaattatctcaatgtaaagaaataaactttattaatagaaaatttactataagcctctgatttttaattttgtattattatttttaaaagtcttttaataaactgaaaatttagatgaccgtgggtttggtggtgacttctttaatacaagatcgaaagcatgatccataaaataaaacattgttaagttggaatttattaaaatttaacacttctgtgaaagacattgttaagggaacaagaagacaggtcacagactgggggaaaatctttgcaaaacacatgtaagataaatgactgttatccaacatatacaaagaactcttaaaactcaacaattaggctgggcacagtggctcatgcctatagtcccaacactttaggaggccgaggcgggaggatcacctaaggtcaggagctcgagaccagccctggccaacattgcaaaaccccatagttactaaaaatacaaaaattagccaggtgtggtggtgcatgcttgtgattccagctactgggaaagctgaggcaggagaattgcttgaacctgggaggcggaggttgcagtgagctgagatcacrgcactgcactccagcctgggccacagagtgagactctatctcaaaaaaacaaaacaaaaaacaaaacaaaacaaaaccccaaaacaaacaaacaaaaaaattcaacwatgaaaaaaataccaaccacctgtttaaaaattgggcaaaaattctgaacagacaccttatcaaagatttacagatggcaaacaaacatgagaagatgctcaacatcacgtcattagggaatgcaaattaaaacaacagtggaataccactacacacctattaacatggccacaatccaagacgccaatagcaccaaatgctggtgaggacatgaagcaacaaaaggtcttattcattgctgttatggccactttggcagacagttcgcagtttcttacaaaacacagcatacagttaccatataatacagcagttactcttctggtatttagcccaaagaattaagaatatatgcccacacaaaaatctttacataaatgtttatagctgctttatttataattttcaaaacttggaagcaactaaggtatcttctaacaggtgaatggatacatcaactctggtacatccagacaatggaatatgattcagtgctaaaaagaaaaaaaatgagctatcaggttgaaaaaacatggtggatacttgaatgcccattgataagtgaacattttatgataaacagaaatatgtatggatttttaataacacctgtgtcaaggtcttaaaagatgtatttgtggataaagtgtggaaaatatgaattgggcagggctactgtggataaatcagtctttggagactgaacttaaattctgtttatacatggatcattgccgttttgcatgtgagcctttcattcttttaattgatatgtgggtagtgacattgaacaggaatcataaacagttggatatgatctgaatttatctgacatccttggttttttgacagcacaatgttttaaatttgtaaatttgatattttcggtggtacctgcactctccagattacccttggtattattcgtttttttattttttgtcacctgctgactttataccctcacatactcaccgtacaccatcaagccattcaagttagtaacttcggacatagacaatctgaatgactctttgcaagttagtgggtactgtaaatccttgctattcaaagtggaccatatagaccagcatcgctggcataagtgaagtctcagacctcacctcagatatcctggatcagaatccgtatatgactagatctctaagtgtttttaatccacattaatttttggaaagcagtgcctctggttagaaaaaaaatgatctataaaatttcaatagcctgaagtgattggctgcatctaacaaaatacattttaacggagctacatatcagttcttgccttcaggccaccataaacttgtaaaggaaggtggttcatattaatgggactcatgaaaaagaaattgtgtaaatttctctacatgttataataaaggaacaggtcttccctgttatgataaaggaacaggaccagtcttctcattattaataactataaaatgggaaaaatatgctgtatgtaagcattttaaacacaaagagacacagatacattgagagagaaggtaaagatataccatgtaaacagtaagcataagaaagctggtgaggctatatcaatatcagacagaatggactttatgccatagagtattacagaggatagagggtcattgcataataataaaaggaacaaattcaccagagagaaaacatgtctaaatatttatgcacaaaatggagcaacaaagtttatgaggtaaaatctgacaaatctagtggaataagtagaaaaatctaatatagtcaaaatttaacttaattctcttaaaaactcatacagcaagtaaacaaaaaactattaaggctttataaatctgtacaataccctcagctaacttgacataattgacatttatggaacgctataccccaaaattgcagaatatgcagttttttagtgtgcatgaaacattcaccaagaataaccagtttttgagccatagaattaaatctcagtaaatttaaagagtaaaatcatacataacatgttctatccctacaattaattactttaaaaatcaataaaaataaacaatctagaaacttcacaggaaatataactaacataatgtagctaaaatattactgaagtattagctaaatattatcaataataaatatttagctaaagtattagctaaatgtttatctaatacagctaaaatagtgcttaaaggaaagtttatagctttaaatgcctatattagaaacaaaaaaagagttttgcttaaattcaggattcttagtttccttcctaagaggagagaaaaataaagacaagtttagttcaatgtaatctgaaagaaaaaattagaatatatataataacatcgaaaattagcaaagcttaaagttggttatttggtaattttaataaaggtattaaaccccaagcaagactaaccaagaaaaataagagaaaatggaaattcggcatgcgctgtctctgtctaggtgtatttaatttcatctcccagtagcttctgtatgctccttgaacatcatgaatagttttctgctcttcttcatgtaagttagtccatatttttagagcacctttctctctgcttttttacctagccaatttcactcatccttctcaaaggtcacctcctcagaatggccttcctagatacaccttaatttaaatcacctttctctattttttttaatgtcatagaccctatacttttatttcatagcaattattacactgtgcaattatgtacttatgtgcttacttttgtttaacatgcactcatatctataggcaataaaatccatggatctaaggactgaatttgtatttcccctattgtagaaccaatgcttagcacagtgcctgacagtatatataccctatacatatgttaattggattacttaattactaaaggcagacttgtgctttatggtccatatataaagaattaggaacactgggtagaatagttcaagataaagcttagctcagtggataaaataaagtcccttcttggtgtcagacatgtctgaagatgaataaacacccttgggaggtgacaaattatgcatccctgagctgtgtccataatagctaggaagccacgaatgtctcttataaattctgaattcatgtattttgtgctccctattccttgggttacatgctctttacagctctgccatgcaaagagcagctggcttgttttttttgtttgtttggttggttggttttggtttttcttatttatttttagattgaggacaattgtttatgtccatcatacacatcagtatcctactgggcaaagcgttgacaggacatctttttcttaaggtcaaattggagatattccacatcttttgattttttacttctttttattcttctattcctcctgtatccagagatccattagaattgtgtgaaatgcagtctgcagtttatgtactgtttcactttgaacagtgagattcatgaattgatagcatccacattttatagctgtgataagtcatccatatgcacaacctggctgtaaaatttgtattcctgttcaggcttatgcatacacaatatagtagtgagaattatataattcaggaaagctaggttccaaaggggcaagcaagttgtataactcccatgatgggtgcatacccacttctctcatgtcacatccagaactacagcatctggttgtcaaagaaacatcaagggcattgagtccagccttctgcagtagacgctgagttcttaaggaaggcaagagacagcatttccacaggcttactctatagactgttgaaaagatgactctcattgaggactaacctaaagttgacatattcaaggtgctggaaagtcccaaattagtatttctcttatcttctatgtttttaaaaatttagtagactttatttttttaaacagttttaggtttacagaaaaattgactggaaagtagtagagttctcatatattcatcttctcttccctccactttcctctattgttattattttttatttgtattaatttaaggggtacaagtgcagctttgttacatggctatcttgtgtagtggtgaagtctgggcttttagtcttaccatcactcaaataatgtacattgtacccattaagtaatttctcattgtcacctccctcccaccctcccacttttccaagtctctctctagtgtctattatttcactctctttgtccatgtgtacctatcatttacttcccacttataactaaaatgaatatgaggaatttgactttgtgtttctgagttatttcacttacggtaatatcctctgtttccatcagtgttaccgcaaaatatatgattttattcttttttatggctgaataatattccattatatatatatatatatatatatatatatatatatatatatatatatatatacacaccacattttctttatctagttaccagttgatggacatttaagttgatttcatatttttgctattgtgaacagtgctgcagtgaacagttatctttctgatatagtgatttgttttccgttggttagatattcagtagtgggatcaaatggtagttctatccttagttctttgagaaatctccatacagttttccatagatgttgtactaattaatttacattccttccaacagtgtataagtgttcccttttctccacatgctccccaacatgttacatttgtcattttagtaatagccattctgattggtgtaagatggtaactcactgtaggtttaatttacatttctctgataatcggtgatgttgagcattttttcaggtttgttgatcgttggtatgtttccttttgaaaagtgtttgttcatttcctttacccactttttaatgaggttctttgctttgttgttgagtaatttgagttctttgtaaattctggatatcagtctcctattgaatgcatgttttgcaaatatttattttctcccattttgcatgttgtctgttcacaatgttgactacttctttagctttgcagaaactttttagttaattcccatttgtctacttttgattttgttgcttacgcatttgcggtcttagacataaattatttgcctagatcaatgtctggtttgcccttggttttcttctagtatttctgtagtttcagtcttacatgtaagtctttgattcatcttgagttgatttttgtatatggtgaaagataagggtccaacttcattcttttgcatatggcaatccaattttccccacactatttattgaaaagtgtcccctttccccagtgcatgtttttgttgactttgctaaagatcagttggatgtagatatgtggctttatttccatgttctctattctgtttcattgacctgtgtatttatttttataccagtaccctgctgtttttttttactatagccttgtagtatattattaacatctttgtgtagcacatttgttacagttgatgagccaatactgataccttattattaacttaaggtcttagtttacttaagactcactttttgtgctgtatgttctattgcttttgataaatatataatgacatatatccatctttatggtattatacataatagtttcactgtacaaaaagtctctatgttctacctatgtatctcactctccgtctccccaaatattttattgactaagcagaaactgggataattctaaatatccacttgctccatacaccccagaactactctgttaatagagtctatccattctaccccctaaatctctcaaatacatgtgatttctatgtcttgatgactacttagtttattatcttgatgactacttagtttattataccaacctcctgacttacctttttctctcctcttttcactccctcaaatctttctccatattgtaagtacaaaattctttgtaaaataaattctgataaggtcagtcatcgcttattcatctctagtagttctagtgttcagattaaaattcagctttcttagcaaagcatcttcacttgatcatagccacctttacagccttacctttacagctacatgcatgttctgtgatgtctcaaatgctaggccttggggaatatctcaaagtacagttacttcctgtagcttgttagtcaagtgtttgaatttttcaggattcagttttgtttattttgtaggttttttcttatgattttctatgacagctcctatataacttctttaattggaaatttgactatttatttgtcctccttgtgtttctttcttcttcttcttcttttttttttttttttaacagggtctcactctgtcgcacaggctggagtgcagtggcacaatcttggctcactgcaacctctgcctcccgggctcaagttattctcccacctcagcctccctcctgtgtagctgggaccacaggcacacgccatcacaactggctaatttttgcatttttttatagagatgagattttgccatgtttcccagactggcctcaaactcctggggtcacgcaatccacccacctcagcctcccaaagtgctgggactgtagctatgagccactgcacccatcctctccttttgtttctatcactgaacttatttaattgaatttttactcttcatttataagttctgtctttcattaaactgtgccttcactgagtgtaaaaactgtgttccattcattttatagttctccatgctaaacaaatggcttggcactcagcttagcacatagtagggttgggtaaattcataaatgaacggacagtggagcttgagagactcagatctcctagagccagtaggtgaataaataataatgaaaacatactgtgaaagctgtgagaagaaaagaatagatgtagagagaaagctgcataaatggagctactgacgaaaccaccaagaaggataactgctgctgagaacaagctgccccattggcagctcattgcacagtgtgatgtagaactatcgagagggctacagtgacagtctcccagtgtgcagtgggaccccgactgcagaaacctctgaggtggaaacaaggtagtttagatgagctggtcattgcttttggtgttcagtgactgtggacccatcaatcttctgacaagcccagggcaagtgtcttggaaaacagccagaatatgtatggcacatttggggccatgcagagctgttcacattttaaaaatgagggaaagaaaataatttgttgataatgcaagtagtgggaaatttgggagaaagagaaactgtcttattgaaattgattgtaatagatgcgaactagaaggcagagttaggcacaacttggtagttagttaattcttcaggtaagcagaattccaaatttttcagaaaaaggaacattttgaggtccacagctatgattgaagaggggaaagtctttaaatcatgcagtgtgagtggtctaatcacaaattatctcagtgaggagggacagcaggcagatgccaggggctcactacgaggatctggggaatcagaggggtaagagacaagcaaggaaattgagaggtaatgcacagaataataaaacaaaacatggatattcactcaaaagtgtgtgtaaatagggccaagtgaaagaatgaacttcaattggtgaaaaatgctaaagaaaacaaaagttatggcagaattgctttctaaactctcgttggcagaggaggtcagtgtttaaggaatactgggtggcattaacagacaataatgtgaagcagaatcactgctgtcatgtaaaaaccattggttcatttttttgtgtgttagcacagtggcttgctggctgtgtgattttagatggtcactttatggatctsagtcttagctttctcacctccaaaatagaattaactagttcagtggtggattatgtcaattaattaaattagacatcatatgattcagcattgtgttggcattcacttggtcctcaataaatgaataaatctatctttcccttaatgccttgtaaaagcctgcttccagattcaattagaaaactattccaagactctggaacaatgtgtgtgtgtgtgtgtgtgtctgcactgctgataatatttgaaaatcagaatggcttattagagtatcagagatggttttatatctaactttttgagaaaccattgaattattgaatttttttatttgatatgccagtgaatttgatgtgcaactgtgccaacatttacaaatgatttatttggaagaagatctgtgaacacttagaaaggaaaaagtgatccctagaaggtggtaccaattcccgaagaacagatcatcttgagttaggctaacctctttcaatttgtttttgtttgtttttgatagactttttagactggcaaatcagaataattcatagacctggtatgtcttgatttcagcagtacattgtttggtggtcttagatagtgatcctgtggataaaaaggaaaatgtggcacatgaataaatagatttgtaattggttaaaaactgccctagtgcattaataaaatatatttgggttaacttggcagattattgcttagttgaatgtcataaagtgctgaccttagaaccattgtattcaacagtaatcaggcttagattaagagagcaaagacatactaatcaatttcacagataatatacaattttaaggatgtatatattttatgtaaattttattgctataaaagtacatattctttaaagacaattaaatctaagcaaaagaaaaatgcacaaatcaaagtacaaaaatataagactatattttaacatattattttattgcagatttaattcatagccagttcaaatagatgtggtgtattaaaacctttctccataagataatgttgataagttgggtgttattccttctgatatcttttttggaaaatctgagaatcattttacatacagcttttctgcatttaggttcttactgtcagtttaactcttgattggttgaattgtgctttcactagatatttcaacaaaaggacatagatattttattttctaaactcctacatttctgaagatttgtttcatttctggttctctacatatgaagaataacttgactggtagaattcaagtttatattctctagcatgtaagacttcacaagagagaaatgacctgagttatttttcttcctttgaatgtgtccttcctcctccttttaaaaataatattcctacaggattttttgacaggtttttgttagcatgggtaccagtaatatttgtttctttccattggttttccttggaatgtggtggcttctttcaattgccatgctatcttttggtttttgttgtatttgaggatttttttccaattatagctttgtttaataatatttactatagttgtttgcatgtatatcagcaacttctgaatgtttttgagggtggtgctgtgttctctagcctctataactatagaccttttattattgctttttttttttccatttctttgttattttattctggattcagagctagtttttgaaatgtgtccttcttacaatttatcctgttttctctactttccatgtggattcatttgagcaatttcaatttttcccttgcaattcattctattaaccattcccatttacatcttatcttgttgactttttgttcctggctctttccttattagcctatctgtaccagttccaaaatgcttataaagaaatggcacatttgctattctacaaagttgtaattttttgaatgatggtgtgatattttatcatttttatgattattgtattaggaagttgggagagttgtgcgtgctcgacggagacattttaaactgaaaagcctgggatggttaatatgttgactgatagaatcaaaattctaaatgatatcaacggggtggaacaaagtgctaaaaccaagaggataaatgaaacctgacaagctgcctgaaaataatcagccacttaagtacaggacaggggatgtgtatttccaggcttacacatcctgctccctgcttagcccattctctgtggttcctgagcagtgtcacccactccgaaggcttcaattaccaccaaatgctgaaggtgtgacatgtggggtcctggtccaggccagatacataggctcaacttgttcaacactgagctcattagcgcgaccctaaaccattctaccaacattattcattagtggaagagcaccaccatccacctggccactcattcacccttaaccccagcctgtccttgtttcccacaggacatcgtttgccatctagagatgcagaatgcctcataaatatgcctcaaagtctcctctttgtttcatttttgaagcaggtgttcacacacctagatagcttccttcctgctttgkggggtgtttaaatctatccatttctaggtcatgtgtgatggcccgtgcctgtaattcaagcactttgggaggctggggcatgtgggtcacttgaggccaagagtccaaggctgcagtgagctgtgattgtgccactgcactccagccgtgtctctttttaaaaaattcacccaataccttctgagtatctttttaatgactaatcaagttatttcccagcagccccttttctccccaagagaaagtctgttgtgatctcctgtgagaagtccaagctgctgcagtagacaccaaaggcaatgatgtgacagccttgcctgccttcacggcttcccccttcccagtccttctcactcacctgatgtttcaatcacaagttgtctcctttctgtgcttttgcatttgttgttttacttttctatcctggaatactttactcacttcatcttcctggaaaacttgaattttccattcaataacctgtgctccctcctctgtgaatctgttttgacttaatagactgaacaatcctattttcctgggatttcccagcactattctcataccagcaatcacagccaactccctcatttgaaatcatatactgtattccccacacttttaaacacagtcatttcactctcagtgaaccagttattttcaggttagcccctctcccccaaaacacacattcagttcctcaatttgtttgtttgttttttgaaatttcatatttcctccaggtgaaagcctgctcttccttaaattgttcttgaacttttcccacttcgtttgtgttctttttaaaatccctcgtctcatactctctgtttctgccatgttgtactttattgccttaaatattttgtaatataattattgtactattttttctttttttttggtatttgagacagagtcttgctctgtcacccaggctggagtacagtgacgccatcttagctcattgcagcctcaatctcctgggctccagcaaccctcctgcctcagcctcccaaagtgctgtgatgacaggcatgatccaccgtgcctggtcctggttacattatttttttgcaaatatttttattcttaccatacaaattcaaaytttaaaaaataacaattactaacatgtttccctctctccaagtaattaatattttcagtttggagaaaaccatttcaggtgtctggctctgcctatttttggatggatagagagaggtaatctagagaataaaatagtgtcatcttataaacctgttcttaataaaatcattacttttttttttacttgactttgaggaacaatgaatagaagtaaaactaaagatattgctgaagtttgaatattttttattacaagaaatattggttcctaaattatcctaagttattctgtacttataaagtcacatctgaaaaactgaagaagttgcagtactttcaactatcgggttcaagtattttaatctccactgtggaagataagattattatacacataaacaagtagcttcctatttccctaagtattactttccattttttgtttggtgttatatttatgttacaaaaattatgaatgtatatttcttctttgtaaccataatcatccagagttgataaatattaggtcctatgtgtaaacagattcagtgcttgttcaatacctgtattttttatcatagttcacatctcattaactatctttgtatgttttgtagaaaacactttaatgtgaaaaaaattaaaagtaatataacaaacaaaaatatatataatatgcatctgtaaataaaatataggattattttaaatattttatctcttaatttcttaatatctttgatattttagatcagaaatatatttaatatatgtatcatcttacttttaatatcttcagaatgtgtataagtagtattgaactgtatctaatttacaaatagtaggaaatcttctatgtattgccttttaaaatcaacatttggtacatataggactagtccatttatttagataccatatagtaaagtttattttaactatacaaccatatcatgtttatctattcaccactggcatttggattgtttcaatattttgccagtatgccaatattgacagtgctacagtgtgcattcctatacatgtcttgtgaacaacacatggatgtgttctttgtaatgcataccttgaaatagaatcactggctcaagtatgcattcaagtttactttttgtgctgtaaagtccatggactttgacaatctccactgatttccagtatctcttcaatcacataagcaggctgtgtatgtaactgagactccttctgggcattcttttctcctccagtgatctatttgtttttccctgtgcactataatacttttgtgcttgtcacacttatcttttttattttttccagaacttccttgaagcattattcttttatatgtattgaaaatcagcttcttatatttcacataaacaagatcaaaatagacttggggataattggcacctttatgcgatgggtttttctattcatgaacatagtatatctatctttccatttagtttttttttctttagttacttttatattgtttttcaataaaggtcttgcacatttttattaaatacatcactatgtatcataacatctgtattgttaatatgaatagtatatttatttctgctacattttctatacactatattgctatcctatcagaaaattactgctttccttcagcacagtgtcatctttgtcataaataaagtatgtaggcatgtttctagaattactatttctctccctttggtctgtctatctctgtaaaataccaaactgttttaatttatttaacttcctagtaaatctatgtaactattatatccacgtctccaacctagtttgtctctaagagtattttggttactcttggatcttttcatttccatatatgtttttggatcagtgttttaagttttaccaaaaattaccatagatagtttcattatattgaatttacagattgacttggaaataaattacatcattataatactgagttttctgacccatgtaattggtagtctatttattgaagcattctttttctcaatttaacttatctcatgtttttactgtaaagatatagacaccttgtgttagatttattacaaggcatttgacattttcatgatatcttgtaaattttactttatgttttacatttatatagctggtgtatggaaaaacaattgattttgtgtattgattttaaatccagttacttttctgaataggcttattaattttaataacttaactataaattctcctggaatttctgtgtgcacagtcatatcatttgcgaaaatcatgatcttgttacaatctttagcattttatcccccttttaatgaaagaaataatacctccagtacaatgttgaataaaagctatcatgggtgctgtagactgaattacatctctccccaaaactcatctgatgaagccctaacccctagtgtggtaaatatctggagacagagtctttaggaagtaattgagattaaatgaggtcatatggctggagccctaatgcaaaatgactgtggccttgtaagaagagaaagagatttctctcatgtgggatacagtgaagatatggcagtctgcaagccaaaagtgaaccttcaccagaaccccaccaggctagcaccctgatcttggacttccagcctccagaactgtgagaaaataaattgcagttatttaagccacccagtctatgatattgtattatggcagcctgagctaaatagtatggtggacttatgcattttgtttcttctctcaaaggaaaagcttttagtattttgccatttaggatgatgtttaatatgttttacagatatccattactaagttaagaaattctttcatttctatgaagctaagaggattttctttcccttaagatgaatattacattttataaaatgctttttctatatctgtgaagatgattatagttttttctactttaatatatgaatataacaaattacatagatagttctaattttaaaccaactttgcatttctgaaagaaactcaggttacaattgctatattaattttcttaatattttgtttagggtttttatctctatatttacaagcaagtttggctggtagtttttcattcttttatcacctttatcagattttgttatgaaagttatgatagtggtatacattgttttaggggcatgtatatttgtcaagttagtctaagctattttgtggtaacaattaaatgccaaaatatcttaacacaattaattctgacttgcttcatagtccattatagtttaggttgcccccttggcataaaaatgactaagatattcagaatctgcacatattgtgaggctcccatattaaatggatggtttctgaagtttccacgtaaagggaaataacactttatggcctgttctggaatttttatacataatttttgcccatattttattaatttgcatctagtcacatggctgtaatctaactgccagaaaggttgtggaatgtagtgttcctttgtgcccagcgagagaaaatagatgagcagttagacactctttatcacagggaaaaccttcattgtctattattatctgtaagagtgtgttgaagactggaaatatttcattcttaaataattggtagaacactacagtgaagctatctgggccaaaagttttcaatgtagaaaggtttcaaaatatggatttagtttttcttaatrgttataggaatatttaagttttctattttattctcaggtcagattttaccagagttcttcaatgcagttcatggccagtgagcatgaaaagctaaagttacaaggatttcatggcaattttctttacaactgctgcttttaatgaggaaaggagaaaaacagtttgcttcaaagttgacttcatgacctttgtatgtcccacagtgccatgtttcagctcaccagtcctcaaggcattgcctatgtcccatgccaaatctaagagctctaaaacagtattgtgaagattcatttctattttctttttcagagcactattttaaaaatttccactcttaaggcmtagagatctcgtcaattgttttggcatattgtcactgagagagacatggagttctccctattcactttgacactcacacattcctcaaaccacctgtaagagataatcatcttcatttttgtccagtgaaattttatgtttctattttttttctctgcatgcctataacaagcctctagaacttgctagaaagtgaggtctctcttggtgagtaagtttcagacagacagagaaggaagctctgttataatttctgtgtatctgagagtgatggtaagctgagtgcgagggctactggcccaggctgtcaccatgggaattgggtatcacttaagtactgattgaaaaacaaaaacaacaacaacaaaagtagaaatgtaggatgttcttcacatccttggaaagtgaaaactgaccacaaatgaaaggcttcctagccatgtgccatcttccctggggagggatgccagaaggcgaatcttcttgcacatctaaagaggattctcacaacaggcaggcttgtgattctttccaagcagctacattccaggagcttggctgcacatcagatacagggactcaatctgcccaaggctgtgttgctgaggccacacaggcaggcctgtggaaggccttggcctccattggagaagggtgtctgaggcctccatctcctctccacaccctagttggaaattacagctgttagcttatttttccacctaccaaagatgtttgtctgtgtttatagggaggtggagagagtggcaaagtgagttggcaattttttgtgatctgcaagcagtgatgtgctgctggctggtgacaattcagtgacatcacattgctagggtaaagttgtctatggtgggagtaatgacaccacagaaatcagggctttttattcatttatgtatttacctatttttggagggcctgttgttgaacaggcatatggtctatgaccaggtctatggtctactaatcatagaccataattgctgcacactgcactagactctatagtaagtgtcttacaaacaaatctcatatcatcttcccaactctctggaatgtggggattgcatttttttccatttcactgaaggaaacagaggatctaggaaatgaagagacttctcactgttatatgacagctcttggaagatctggtcttgggacttatctctatacccttctcatatcagcgtgttgccttttccttccatctgcaaggccttccctgggacccttgtcccttgctgcagagaagccagctggttctgagaaggcatgtctgtctttcttgttcttattatccaggatctgttgctgtctgctgcttgccccacccagtgaacactccaagacatgaggggtgggacaggtgctctctcagtgtttgctggtgcatgtgctgtgccggggaagaaactgagtgcacatgttgggtgaattgcctgaggtaccccagcattggttcaactctggttgagcatccactctgcacagacactgcgctgagcatgtctggggagggcaggccatatactgtggtccttgcaaaagaccctccatcgggcagcttgctgtttaatatgggaagtgagagagatgcggaaatgccagcagaacaacctggagtgatgtgtcaggtgcgtgggctgaaggtggtgtggagggaataattaccctcagctgcggtggcagaaaggggctgggctgtgaagaaggtgcaagatttagaaagtgacagtgcatggagcattccaggttaagaggcagtgcatgtggggtaaacctgggtggggacccacagtgaactctggggaagcctcgggtcgtgggaaagaagagaagatgtggagactgtcagacaaaggtctgagctccagccttgagaattaataaactttgggcaacctaacttttccaaacctatttcttttctttgttatttttctagaaacaaatgaagaatactaatatctgcttcataggtgttgtttgaattagaaaaaaatagataatacattttaaaatgttggtgcaatgttggacatgaaaaaggtgccagagaacccgattcagagttcctttgctcttttcctgggtttagattaggtggagaacagggctcatggggggagccaacttgaacatgagattgggccacatcatggagggcctgcaatacgagattagggatttctttcttttttaaattttacttttatagattgagagagtacaagtgcagttttgatgcatggatatattgcgtagtgacgaagtctgggtttttagtgtagtcatcacccaaatagaatacatagtacccataaggtaatttctcctccctcagccccgtgccacccttctgagtctccagtgtctggtattctactttctatgcccatgtgtacacactatttagctctcacttgtaagtgagagcatgtggtatttggctttctatttctgagttattccgcttaggataatgacctccagttccatccacattgctgcaaaagtgattttattattttttatggctgagtagtagttcctggtgtatatgtaccacattttctttatctggtcaaagataatgcccgtgttgatgggcatttagattggttccgtatctttgctattgtgagtagtactgtgataaacatgagcatgagtgcacatatctttttgatataatgacttcttttcctttggtagatacccagtagtgggattgctagatcaagtggtagtcttatttttagttctttgagaaatctccattctgttttccatagggcttgtgctaatttacatcccaccaatgatgtatacgcgttcccttttctctgcatccttaccagcatctgctattttttaggtcagggatttctatgctgaatggcagatggatgagagtttccatcaggagttggccatgatcatgtggcactttgggaagatgagctgcgtgaataggctggagaaggaagctgtagactcctgggctagggaaggagtgagggtgtagtcgccaggggcagctggaatggaggaaggaaatacagcagagggttactggtggagttggacactggtgggaggtgacctggaaagaggaggagggcaaagggtgttaagctgggcccttctgggtctgcctgcagcctcattctgcacctcctgccactgcacacacacttattctgtactcatgtttacccttcagtattttgcaggaactccagggcttccttggaatggctggaggaagccttgggcatcaaaagcaggagcaggttgttagtataggcctgacgtgggactgtgctgcatgcataggagcctgagatgccctgcccacggcctcaggactctttccgtgactgcctgcactcactggccaccacctctccctaggcccatcatggtcactgcctgcataattctrtcatgctgcatcttgcagggggtggggctgcctcagggcaggcgctggagtgtgttaatatccccccactgactgttacagatggtttgtcatgggtcctgatgttggtttttaaatactttctgccttggttttatcactagcttcttgttgcttcttctcagctagcaggatggtattttctctggaaacattcttgcctcatccacttccattctcctgccagtaagacatttagtctaacagaccagggctccctacctccatatcctatattctgcatccttgttccttctgcctggaaaaccctagtcctctgcttctccagggcattgatatctgtatctgtcctgcaagtgtcaattcaattgttccctcctccagcaggcctccccagatccatttaggttgggttgaggaacagctggaaatgtgctcctgttggtcggggaaaagtcagggctgctaaactcagagccttcaaagtctgctgcaaaaatatgcattcttcattgtgggagttagtgaattcctactggatatactgtagactgagaaatcaggagggctcagacaaagccttcgacaggagtcatattttaggtatggcagaggaagatgagagagatccatggtttgggagcttggtcagaagcctgggagctgagatgctgtgctattccaatgagtaggtatttcaaggatgtgtctgtctggggttgataagcagaattccctggaggcttctgaaactctgcctcccaccaccactgagaattactgccatggtagttatggcagaagaatgttctatccctagatgtgatggggcatgtgaagctagaaagagtactggattaaatgacaaattaaatcatcagtgttgtttgagagtctgttttatgtcaggtgtagattacctataataatgcatgttaagcagcagcgtgggacttggctgagtttagttccctctcctttatccattgagagaaaaatttagttgcatgctcagggtgcaatttaaattacaaggagtacaaaccaaagttgcagaagtgagggcatattattattgagaactttaatggtgagaggaaggggagagaagaggattgtagaggcggtggtggcagagctaagggaggtgtccagggagatctggatgttacagtaattattttaggatgaggtggaccttatcatgtctttagacagagggtagccagaggcaaggtaaagaagggctgatgtatggggcaaagtctctaaggagactagagaaaatgaaaataatgttgagactcaagtagagaagagatatggtgcagagaccacatgaggggatgggacctctccctgggccaccaactacagcagccaagttttagacctcatctttgggtattggaccttggggaagtccactcttcccagttaacaatttctgctcctagggcatgagaaagggctgaagagaaccacagcccagagctagaattctctttgaatgtgtctttgaaagaggccggtggaggagagattagggaattatgtccagcctttggtcttttccttcaggatatcaacaacaacaaaaaatcactcctctgctgaagcatcccagttgaggttttctcctggggcaccttgtcgagcaggaaggtgatcattcccctttcctcccagcagaaccctgaccttcctgctcaactgaggcctcaattgaaatgcttcttagggagccaggaaggccaccccatgtcttgccttagctttggccaacttagagtctgagggttgttgggggcagaatgctggtggtgaagaaatgagattcctgcctttttagtgccaagtcactaaagaatgagatacagcatcctgcctgtacatgtgccagttaaatcccttcttctgtagacacaggtgctttcttggtgtctggggcgtttctggcaccatgtctgtccctagtgtctcaagatacactctatgaactcacttccctttaatctcaccaggctacaaaatggagcgtgtctctcttcacctccccccattgtgcatgcttttctcacttccgtgaatattcttagaggttattttccttcaacactcctcttttcactcactgctcagctcataaacactacttcgtaggggagactccggtcaaacttacgactccattctctccagggaaggtcccatctaactacaattccagaaaagtattgagagtacaaccttggtgggctgaaaatcatgtagacttgggtattcatctgatgtaggtttgtatcttctcagctttgtttcccctggcttttagatagaaatatcaatcccttcttcacaacgctgttgaaaaggttaatagagacaactatatgaatgtatctagcacatgataggtgctccattgaagttactgtttctctttcctttctctcttctcaattccccatattgatgcatccaggaactaagtgagctctgatccctactccccctcaactgaatcacaaggatgcctcatgcctgtcccttttcccactgcttgctggccactgtgtgccaggcatgctggctgggtgtgcattattggcctgccagcagccctcatacccagaccctggtcttaattaaaacttacctacctgagtcccactttatctcttatcctgttgaatagtttggcccttgagattttgttttagaaatagattccaggcttaacactaaggaggctctggctgttttggggatcagtttgccccattttgagtttatcagaggagctctgtcacacattcccaaatcatcaagagagtttagaatcttcagtccaaatacaggggctgaaaaattaatttctcagctcatctgcaaacagcagccactgtagggtcaggttttctcttaaggccttatttattttattactaccccaaacataaaaatgatggttctgctagctctgcctgccattaactaatggcaaacccagtgactaattgtgcttaaatctggtaagcaagtgaaattaattgtccttgcagagactggtccctgaggacttagaggagaacagaaatgttgacgtgcaaataaccaagcatgtgaaaatatggagctttatcaatcaagtcagacctccaggatttattgggtgcttccaaggtgctcagtgctgtgcctcattgctttctgcaacttgaaagtccatggcttcccagcttccctttgctgttctagggctagggcaggctcattggaagctgcgtctccattgtggtgtgtttgactgcgaagctttcttgcctgtagttgggattcctacaaacagaacttaagctgaggactctagcacaaatggtttcttgggtggagggggaacctcaggagaagcagaatgagggaaatagagtgaggcagggaaaacgtgctaagcaagaatatggtatcaggtggaaactagctccagcctgatcccgcaagaactctggattccaagtggccccacagatttgatcccaccctgaggcaaagaggctgcctttgacattcccatgtgagtcagttgctggctgtgggctgcggaagagataagatgggggtcatctccaggggaggcaggtccctccatggagggcagtgtccttgccccattagctgctggcactcacagaaggaacaggctcaaccttccaaaaaagattcgaggtgaaacactaaaagtatccactacaggtctggttgacctcccttccataagaagaaactcaagatatatccatgttctttgctgccatgaaaatctccttgctggaggtgatccctgtggcattgcacagcctttttagcgaaaaccacttggtcacacaggcaggacaggaggcagaatttgccaaaggccttggggattctgaccccagggcctgactgaatcttcagtttccaattacatcttcacatgcaggtcccagccctcacaaaatgcatggaacacccaaagcaacatggacaccacccctgccctatgactttgcctaatctgtcaaaaagcaaacctgtccttctcatgaacacctgaagctgatgcctccaatttagtctatgtgggttaatgtcacaccaggctgcatggcaattttataccaggggtcctgctggacattgaaagaacattattcttctctctgaagtttgaatgttgaattcattgtgtttatgatctccctctgtttgagagagataaagatgggaagaaaggtacgagctcattttccaccacatgaacacattttaagtagcttgctttgtcattttctcagatacctcccttaaggaacttgaggcatagtctgaaggactgaatcaatgaattccccaagtgatacacgtaagatgtctgtcattcctgaaagcagcctttctcaccaggagtcatcctggatccctgtggtaggttcaagctcctcctgcattattttgccccaggctgagatcttcattgtcctttagcctaggaggatctggaatagctggtgggtggagggaaaagaaaggagaggagaagggcactgccattctagacttatcatgcagagttcattgctagccctaatgtgcctcatcaatccctcctggctgcatagctcacgtgtgtgcagctccagagcagacagcatcactaggtatcttctagaccctccaagagtatgaataatttcttaaaactttccctgggaataggtttctttttttctgggcaattttcctaagaggaaatgttttcctaagaggaaatgacacaaaccagcagcattgaacctgatggacggtctcttatcttctccaaaacagctgtgaagctattgatagtgcactgaacgtgaacccagaaatgagccctaaaaaataatttccaataaactccaatggaatatatgagcagtttaagcagaacgatactctaaatttctgagcttcatgcccagagtttgtcctacatatgtctcctcctgagataaaggacatagtgagtctttggttataatttgcattaataatgattgagcttctcattagcatacactgggcatgtcagtgtcaggtaatccatttgactctgctatggatggatttatgctgcacaccaaaaaaaaaaamaacctgcaattttcactcttaacttctcttgtactaagttgtgtgacagaaagaacaggtgatatggcaccacaaaatattaactatgtgatcttgaataacccttaacctctcagagcctccagatcctcatctttcaaatgaggatagttaattgcagttgatttcataggatagtcatcttgatcaatcaatgtaatctatatgatgatccctggaatattctaaaatgtcacaaaagatataatataagcttttctaatccattaatctctcaaataagactgttgtaatttttctgtcttgaactttgagatgtgcagtggggtatgttgaagctgttcttattcatcggatttcttcttaacacacatttcttgggcacccgttctgaggggggctttctatgggacatctagaaccaaatggagaaagaggcaggctttgttccctaggcgaacacagggggagaacatatgagcccacagctttgtaactcttgggcaagtcacagcacacaagccaaagaagaagcccagagagaaaagcaagcttacccatcccgttggaaatatggatagaaggaaacacaaaggacattgcatctgaactggccacatctaaacctactatgtcaagtagagaaaggtggaaaaagtgaaagaccagcaaactcattttaacctaaggttaaaaaaatggatccattaattaagaagagtgatctgagaggaatttgctcaagtccagatcatcttaataaagtgaatattgcaataaactggtcccatctaaacctgctatgtcaggtagagaaaggtggaaaaagtgaaagatgagcaaactcattttaacctaaggttaaamaaatggatctattaatcgagaagagtgatctgagaggaatttgttcaagtccagatcatctcaataaagtgaatattgcaataaataaagtcgcaggaattttttggttttccagtgcatataaaagttatgtttatattatactgtagtctattaagtattcaatagcattatgtctaaaaaatatacatactttaattttaaagtaccttatgctcaaaagtactaacccccacctgagccttcagtgagttgtaatctttttgctggtggagggtttgcctcaaagttgatgtctcctgactgatcagagtggtattgctaaaggtaggagtgrctgtggcagtttcttaaaatgagacaacagtgaaacttgccacatcaattgactcttcttttcatgaaagaattctctgtagcatgtgatgttgtttggtaccattttactcacagtagaacttctgtgaacgttggagtcacacttctcaaaccttgccacttcttcatcaactatatgtatggaatattctaaaccttttgttgtcatttcaacaatgttcatagtattttcaccaggagtatattctatctcaagaagccactttctttgctcatctgtaagaaacaaatgttcacccatttaagttcgatcatgacattgcagcaattcagtctcatcttcaggctccctttctaattctagttctcttgctatttctaccacatatgcagttacttcctccactgaagtcttgaacctctcaaagtcatccatcagggttggaatcaatttcttgccaactcctgtttatgttgatattttgacctcctctcatgaattacaagtattctgaatggcacctagaatggtgaatccttttcagaaggtttcaatttactttgcccagatccatcagaagaatcactatctatggcagctacagccttatgaagtgtatttcttaaatgataaaacttgaaagtcaaaattataccttgatccatgggctgcagaatggatgttgtaataacaggcatgaagacaacattaatccccttgtacgtcttcatcagagttcttgggtagccaggtgcttgtcaatgagcaataatattttgaaaggaatctttttttttttcctgagcagtaggtctcaacagtgggcttaaaatattcagtaagccatgctgtaaacagatgtgctatcacacaggccttgttgttccatttacagagcacagaggccgggcgtgggggctcatgcctgttatcccagcactttgggaggctgaggtgggcagatcatgaggtcaagagatcaagaccatcctgaccaacatggtgaaacccaatctcaactgaaaatacaaaacttagctgggcatggtggtgggcacctgtagtcccagctactcaggaggcagagacaggagaatcgcttgaacccgggaggtggaggttgcagtgagccaagattgcaccactgcactccggcctggccacagaggaagactccatccaaaaacaaagcacagaaatagtagattgaacataattcttaagggtcctaggcttttcagaatggttgctgagcattagtttcaacataaagtcatgagctgcactagtttctaacaagaaatcaacctgctcttcaaagctttgaaggtgttttcttccaatagaaggccattgcatctacactgaaaattggttatttggtatagccacttatatcaatgatcttagctagatcttctggatgacttgctgctccatcagcacttgctgcttcaccttgcactgttatgttatggagacagcttcattccttaaacctcatgaaccaacctctgctagcttccaactttttttcctacagtttcctcacctctctcagccttcgttaaaattgaagagagttggggcattgatctggattaggctttagcttaagggaatgtcctgttgatcttctattcagaccactaaaactttctccatatcagtaataaggctcttttgctttcttataattcatatgttcactggagtttcacttttagttttcttcaagaacttttcctttgcattcacaacttggctgactggctaagaggcctctcttggctttcaacatcccttcctcactaagtgtaatcatttctagattttcatcaagaatgagagatgtacaactcttcctttcactcaatcaggccattttaagattattaatcacctaatttcaatattgttgtgtgttggggaatagggaggcctgaggagagagagagagagatgagggaacggctggtcagtggagcagtcagaacatacacaacatttactgatgaacttcaccatcttataagggcagtttgtggcccccaaagaatcacaatagtaacatcaaaaatcactgatcatagatcactgtaacagatataataataataatagtaataattttaaaagtttgaaatattgtgagaattaccaaaatgtgatggagacatgaagtgagcacatgctattggaaaatggcactgatagacttgcttgacacaggtttgccacaggtcttcaatttgtaagaaacacaataactgcaaagtgcagtaaaaggtggcaagcctgtgctaccatagtcagatgacagggaaagaaactgagctgagagtgtcagtagaaatgaaaagaaaggagggtgttggcagtagagttctgttgacttaacaaggcaaaggtaggaaaagaaaggattaaagagtactaagactttatatttgggggattgagggtggcagtgtcctcataggacatagggaagtcaggaggtgagctggttttagaaaaagaggattgcctgatggcattctcagagcaggagatttctgttttggcatcctggaggcgcttatctcagccctatgcaagtaagaaggccagaggttaagggaggagtggcaaaccatctatgactggatgcacataggcaaagcagagggaagagaatttgcaataagcaatgaaaatgaagaggtgaaccatggtcaagcattgtcaagttgggcatgtaggtcagggcagtttccagaggtggtggtctgtgtagtctagtgacccacccagcaagatggaggaccctgtgggctgaagggtgggaacagaagccagttggccacgagcaggagatgaagatggagggcctgagatgagggggcttcaagcaactcgcagtttcttctcccccttgcagtcatcctcaattttgtctttatagacaaaagagactgtgccttcatgtttgtttgggtctaggtgccattttaaacttctgatatcatttctgaccctttttctgaggtatctttcttccctggtctccttttcttgaaaagcagtgttccttcagctaattattcaagatagaaatacagtgggcttgtttaaaaagcccattgaaatcccattcagggggcaggcagaatcctcactgctctgtttctaatgcaagtctcagcattggtgcccatttcagagcattttggtctttgaatcgtctacacaacatcattttccaagtggattcctagtagctctgttttctgaagatggaaaaagatgggtgaaagaaagttgaaagttttctttaaagggcttttcagtctttcctgtgttattatgaaccataagtctccaagaagggctgtcgtgtccagcatttcccagatgtatttattaatgaactatttttgaaaaatcataaatatgtatttctgaataaaaaagtcaagaaagacaattcaataaactaactagaaaaacatatttgtaccacatttttaaagaaaacaaaataccttgttatgatgcaggtgtgtcagtgttcctcactgtaagccaaaacacagcagaatatgatgctgcatgaaaagcagaatcaagccagagcagtctactttccctaagctccattcactgattgctgatacttcaggctcagatgttaaacagtaaacttggttgaaagagcttccattttagtaatctaagttactgcatggaattaaaatattaaaggtggcttccagttggagcaggacacagaagggggcctcaggataagatccgtctggggatgggagctagcagtccttccctagacagcctgatctaaggatgggccaaatcaggacctacagagcagggcaagtcatgagaagcggggctgggagtcaaacgagattcaagaggaagtcatggatgaaaaatgggtccggagccagggtgagggtgtgggtatggaggaggaagccaggggcttcagaaagtgtgaactccactctctgtagacgtattttgcttctaattttcccagccaacttgtccacatttgaaatcatctgccttttatgcccatcctcatgaccccaaaggggcccttggagccctctcagattcccagttcactcctctgtgatataatattgacttccccataggtggtgattatgaagagatgctctctgtaaagtgctctacacattgcctggctcatgggggcccctcaataaataggaaactcccatcatcctccacccctacttacttaacccactgcccatttggagtgggcttggtggaatcaacagagaagacggtgccctgcatttgggtaatggttatgaaatagccgttggacatggaagacaagtcaggcctggtttgggccacatgcttactcaggcctagaatggggaaccctgtgattagcccatgtgtcatcctctggtggaaccaaggggatttctaacttggataatgtttttcaaacacctggctttgccagtgcaagtccacagtggttgccaatgtgtcctgcaggtcactttttttctctctgtcttcctgtgatctggaccccttgagcacactccattgtcctgacttagaggactcacaggaaggatcatgagctgttgagaacacagcaaccaatgtgactttttgatgtgcagcgtagagcctgaatattggtgacctgcctttagaagcagtgtcttactgccattgctgaactgtgagataaattcttcctttaagcaatggcaggttttctagcagtccctcaggcattgtgcaaagtccactgagtgtgggcagagtcctggcagactcattagctgtgtgtccttggaaagtgactgctttctgggtctcattttttaggtctataaaatgaagggattttataagaagatttctaaacttgcctcccactctgacagtttgtgagcttattgacaacttagttcaaactctcaccttaaacagtagcgtctaaagaacatctcagaagtggcttctcttggctccacacamtaagaaaagcaggacaaatttgatttggagtcaagaataggcacattttcctgcttccacttcagagctccacacagagaggacacacatcagcccacagatgcccacaagggtagccaaccacacatatacacacaaacacacacagagtcagaggcacatgctccgttgctcacatatggaatgaatctgactgttgtctatgtgcatttctttcttttactctggtttttgtttttggccaggaagggccaggttgagactgcatttccttccctgggatccctctccgagcctccctgtggaagcatccccagtctcctgtgtctgacaggctgtggaatgcacgtgccaatgccctcacatggctaatgcaccttatctcataataacaacagccacagtacacagcaggttagccggggattttcctctgacaaaggggagaactcagcaggtgagatggtatgtgattctgcatggctggcctttgcctagggcttagggatggggaatggtgggtgccctccagggagagcactggctcagcatgaatccatagaaatggagggcaaggggagctgtcatttcctgcagagcggggaagcctagtcagacagctgggaacagaatactactagaccagttatcagggtttaaagcaatgatatacacgaacaggctggactcatccactcattcactcacaaagtttttcttgaccacctaccatgtgctaggggctgtgctcagttctgggggcacactggggaagaagccagacctgttgcatgtcttcatgaacttaaagtgcaggagcacggttaggagtccatgtgcaggagccagacagcctgtgctcacatgctggatccgatattgaatggacatgtgactttgggcaagctaattaaccttctgggctccagattcctcctctgtagactgagaataataatagggacaacctaaaagggtttttctgtaaatactgataacactgccctacacagagtaagaactcactaataatcttctattgtttgtgtttattctttttttttaaaacagcctactaggggagtaggctaacaaataaaagacattgttcgyctctctctctctctctctctctctctctskgtgtgtgtgtgattttagaaagagttgctacatatcagaatgcctgcctctacctgaaagtcccagaggatgcgggggaaatttttcccaggaagaagagcagataaagaatagacgggcttcccatgtgctagatgtgggtgcagatttacactggagacagtcacgtcaatcacataaccgcagagagcgaggtcttcactactttgctgttatcagtgatcctgggttctcttctgtgtgtctgctcctctctgcctctgcttagttccctctctttacagcctaatgaatgttctctgcatttcctaaactagggcagtagcactgatgttggaggagtagggagatctgcgaaatattgtggggctcaactcggtcaggcctgttggaatatgacaggtgggagaaaggccagagtgaggggcaaggcagcccaggtgttagtgcgagacctgggtggatggggacacctgcacctgatgtgagctgtatgggggaggagccagcttgggtaggcagaacaaggtccagttgagactacgtaagtgttagatgcccatagatgtccaggtggagatgcccaacaggtaatgatgacagtggggaagctcgggatgagttgaagtcacgtcccctgtagtaaccgaaatcagtcacaaagtacagttggctcttgaaactggtttattgactacagtgaagttcacctaaataaaagtgtaaaatgagcacctctaaaatcatcccccatcccctcatgccttacaagccaacctcaactaaatctcttacttctccacccaaggttgcaggtacctgcccccgctggggagaggcatcaaagtcccagtgcaccctctgccagtgggagggatggcagcaagaaatggccctttcaaaggacatgctgaccctggagggaggtccctatccacaccctccaggagaactgttctagagctggcccctgagaaacatctgttcatttcaccctgttctttcatgctttctgtttcagcagatcagtgtaggggtgtggttttagtcaaacctggttttcaatactggctgagacattgactaaccatgctgggcctcagtgtccttgcctataaaatgrcaccactctatctctgtcagtatagtctggaaatttagtgcataataaatattcatttcatattagctccctccagaccatatcagaggacgtttacaaaagtggtggtgtagttctttacaaaccaggtagaaaaatcacatatttgctctttgtctagtttctttctttgggtttaggagacatttgccagaataagtgccttgacctccaggggtgagctgtgcaagctgtgcacactcctctccaccctcgccttggtggaattatgctgatcttgcctggcaacgtgcctcccttcccgagacagcttggagatgcatatttatgtatttccagtcatcaccccaagagctcagattttcctgtccttggtgtcactttaattaatacactcccgtgtgctgggtgacaaaattaggttgcaggggtggcaggcgtttatatcacgaagggagagaaaaaaggtgttttgcaccattttccttcttaagctctgttattaatctttgcaatcaatactcctttatttttggctccagaagatggtggggtggaattagactgtcaagcaatttaagaccacatctgcataagtaatagagatggtatgttccttttgctctaggtgaaaacatgtgtccctggccagatgtggcagggccagactctgtgagtctcatgccagctttatgatatgtttgatttaggtaaagtgcctggaacctgctgggactaagttgttattaaacaccatctgcagttttcagtttaattaatataataagaattaggatcccatgctttaattatcatgttaaccctttaggatcatgggaagaaggagggaaacatgggagggtggaccagggtagctctttagaggactttggatctgtaggttgacgcccttcatcctgaaccccacagctgtaaacatgtgtggtgggctagtcactgcccaggtgtgaccctggggctgttggggtttgcttgtgtggaaaggaaactggaatatatttgtccaatagagaaggagtctacttaaatatcagtcacacctggttccccaaccctgtaagggaaattaccttaacaacaacagtagcactaataataatagttctaataatgacgtatcatttattgaggaattacttgcattttaatatacagtgtatactgtataatctgtgtgtgaatatatactgtgttatacaatatattctgtactagaaactgcctaagtgctttccacaaattacatcatttaatttttaccacattaagttctgattgcttatgaggaaactgaggcagaaaacagttaacatacctagtgtgaagcaaaacttggattcaaatgtaagcttatttgaatcaaatccaatgcttgtcattaacatacatcactcaataaaacattcctgttgaaaagttgaaaggaaagacttcaagtagagaggggacctattgcgccctcctggatttcatttcctttgtgcgaaatgaaacctcagattctaatattgctgccactgccacttccaaggtacccatgcctgtggcttcaagctcggctgtcagtgaagagactgagctcattgcttgtgttctccaagcacagctaattttggctggtacgttgacaatgcttcctcaaaccatgcaggataataagacataaatacattcagacattacaaaagataaaaaactggaaacagagatggaaaagtctgagatgtaaggttagtcttaaagtaattctctgattctaagggaagagcattttgaggtaggcactgctaggcagaaatctttgctgccccttactggctacaggaccacagacaagtcacctatctcatatgcctgggttcctcattggacaatagagatgctcatacttgcccttcatgggtttcatgaggattctacccagagcttggcacatagtaggcattcttttaaagcatgactcttcttactggaggctctcacatgttgactctcagactaattgcccaaggaggttatgatcctctgactcccagtcaaaagctccctcccgggcctctcagtgccttcatgtcatgctctgctgcacatcaacattgagtgactattccatatggcaaggttcccctcaagaagcatggcgccaggaatgaaatcatgctggaaaggacactgtgccttttatactctgggaggtgtctctttacaggttaattgactcatctattcatttattcatccagcagggagtatagagcacattcaatacctggattgggctgggcattggtggagtaacagtgctacagtaacattaccttgtaaccaacataatgaccatgttgcaacagttgtctatgaccagaaatcatcctattcatttattcactcatttattcttacatttctataataaagagatcatttgctcctgtcatgcacctaacattgtgtcaggctctggagataaaaagtgggtgagaaagcatggtctccaccttcatggagtggcagttggcaattcagaggagcaggcagagaagtgactcagtacagcacagcaagacgagtaccatgattagggaagtttctgtgattgtcagggcacatgggggctgtattagtttcttaggggtactgtgaacaaagtgtcacaaactgagtggtttagacaacatttattgtctcacagttctggaggctgaaagtctaagatcaaaatgtgggcagagctgatttcttctgagggctgtgagggagaatctgttctcacctctcccccagcgtttgacagtggctggcaattttggtgttctttggcttgtagatgcattaccctgctctctgccttcattttacacatggcattctgcctgtgtaggtatctgtgtagaaatttctcctttttataaggacactcgtggtactggagtagggccactctaatgacctcatttaacttgatgacctctgataaggactccccaagtgagatcaaatttataggtactaggggttaggatgccacatatttactttggggggatgcattccaacccatcacaggggaaatgtcttgaacagaattttgaaggtagtgatgtgttccccaagatgtggaatgtgaggagttgtccgcatgtttaggaaggagaactgttccatgtggcatacgagagggaccagaggcaggagagagcactgtgggcttgggaaacaaaatcttgcacaggacagaacataaagtatcggagcggctgctggaggactaagtgggacaagtccttcgaggcctaaagagtcagatctggaggggtcccttcatcctgaggagagtggggacccatgaacggcttgtccagacagcttcatggtcagaattcatcccaacctcacacagagaaccttttcatggcggcatggtggatatggtgcttcctacgacacagtgcagccctcttctggtaggccacattacccattaggccctggcatcaggaaaaatgtcatacaaggctcagttcaggcatgggggaacatggcttcttccctgggagaggagccctatggtttggaaggagaagggagcctctctccggttggcattggccttgtgggtggggaggagtattacggagggagctggggatccagtgtgcagggcggagggaggcagggttcggctgagatggctccacccacagccgcgttgctggcccagcggctcctttcactgcagtcatgtggtccctgaagccccctatcctggcgttggagccctctcctacctgggggtctcctcaagccaagcaccctctggtccttttgcttttacttttccagcctgtttagccaaacccatgaaggaacatcagaaatacctgtacagagacctgtaggtatccctgtttgttgacctgactactgtctctggaataggagaaaggagagtaaaacacagatgaggcagtgagatgtgtgtcttatacatcattcatccactcaaacaaatcaggatgcaacatctgctgagtgactcttgggatttcagtgcaaagattcaggtacagcctggtcctgatgtgcccggctctgaatccaggaaacacaggtggctgtgttcctcctacctggcctggatgccctgtgaacatggcagaaggaaaccattccagggagaaccttgtttttggcagacctagtagtctagagagacagcaggcaaagagagcaccatcttggaataatacagtcctttgagggttcccttggaatgctcatttctcttgaagaatggcaagcagcttccacctaaaattaatcattggcttttcctgctggaagtctctcttctcccacggaggaagacattggctttgctttgggtttgtggctaaattttgtgcattrcctttcatcccgaggcactgtggggacattattatgttgttaagagtcagaaaagcccatagtgacctgagctagtgcctttgaaggtggttgttttgctttgccccactgggtgcattgtggctgtagccttggtgtgacttggggacaagctccctgggtccctgcttctgaggaggtggctgccagcactctgcagaggcaaagctcctggtgtctgagcacactacattttaatcattagaggtctgttctctgtgagatcctccctgtggtagctctgagtctcaacagacactgcaaaatgagattctagttttcagagaaaacagctgtgtttcagagaaaaaagtgcatgatgctgcttttctggaagagagaatcctaaacaaagtaagtcttatagttccagcccaggccatagaatcatgaaatatcacagcaggaaaaggcctgacggatcatcttgtccagcgggtttctgtcacagtgtttacagggctaagcagagaatgtaaatgtcggtctaagaccagagtgctgagactgtgatgacccagaaatcacaggcccgggctaaaaaaaaaaaaaaatgcagattcaaagcaggcaaacaggaggctagccaaaccagccacttcttgactggccatgcaggttggcagtttacaagcactgacgtagcatcattctctcatttaatcaytggagaaactgaagctcataacgatagctaacacttaatggatgcttcccacagactggcattatgcttagtgctctgcttgaattcactcaatccatgaatattcctgttgtgtagatgagaacactgaagcacagagaggttaggtagcttatccacggccacagagctagcaagacgtagagtgatatttgaaagcacactctgactccattgcctaggttctgaactccttccctgccctgccactccagcatgagttctcctaaaagcaaggaagtgccatgttccctgggcagggtccagaatccaggccctggactcctggtgtgatagcatctgaactgcactgtgttgcttcccttgtttcctctgcttaagaggtttgatgtttagaaccagacttcagccagaacagcctggcatacgtgatcagctctgctcatgatccactgtagggtcctgcataaattggtatgagtctctaattctctggggaattcaccttacctcccagagtcctaagaattaggactgttctcccagggctgtcacaaggatcccatgaaagagggactggcaccaggtctggatatgtttggatatccccagatgtttgtgtccatctgtgtactttccaacaacctttccatggtggtgtatctggtgttctgtagcgggatgttttgctcccattggacaaacactgttgaatactggcagagttatcctgagtgtcttgcctgaaccctaaaaagtcaatgggatgaataattacctcaaagaacaaaaaacaggaccatgctctatcctgccagtatcctggtcctaactggggcataggtgggctcccattgatgccccccaggcattgcaggcacctgcagcagatagtctctgtcactggccagagagcatgccaggtgaaagttatgtggcatgtggagctcttggggtggtgtggctggcacctggcattgctaatggtgccacaagcgaaatggtgtccaagataaaaacagctgtaaccaaacattccatggcatggacatcatccctaattggagctggtttgggaagatagctcaggcatcttggagatccaggcctggaacagcttagcatcaacagctcaacaagctcaacttggctctggcatggaccagcttcaaaaacttcataatttccttatccataaggtgggaagaatagcttatcacagagggtggttctgaggatgaaatgcgctagcccatgtaacagcacatggcacagagtaggaatcctcccattctctgaactcagacaagactcatcaatgatagagcacaccttctcctcccaattccctttcctaaacttcccatcagagtctatatccttgctaatgtgatttttctgcaaactgattcagaacggctagcatcttatagcttcacatttaattacagctggttttgcattgttcaatcactggcccatgtgtgctagtattttccctccagctgtcccacaagggaagagcctcagtctgttttcttgcaccatgagtgctgactgctcagatccacaaacaaactcaggcaggcagatgtcttgtgtgctgtgattccttcaccagctgctttggttgggttctcagccacatgagtccacctcctttggggtccccatccaaccactgaggaactcacaaccactcctctattttaaagttagtcatagcaaatggcataccctcatccaattgtcctggccctccagcagcactctcctccatctttcctctcttcttcctgccctggggcccttgagtatacactcttacatgaacacacccaggccggaacaggtgtgcacatttatgcatgcacacacatgtgcaagcacatggattcatagctgcttctcagctctgcattctaaaatatgtgtgacatactttctgcagtggcttccttaactgtccacagtatagaatgtctccacccactcagctcacacattctccagccccataattgtctagggaacatcgatagcttatcatttttccattatctttgcacttccacaaaaactcagttataacaatcctctaagtattttatggacaattgtcctgcaatcctattcttagtgcttagtaatataccatttctgctgtctcctagtaaactgttattagctaccagaagatttctctttctcacacacatccgtgatttaaacaatgcaatgttatctttgcccagaacatttttttatttctctcttctatatgtccatttcctgtttctccttaagcctcagcctcagcctcacccttcccatgaaccctccctctttgcccacagtcccagttccttgtctgctaagctgggacaggttcaacttcatgttcccatgactctgtgcttcattctagcaccgtgttttgcatgatgtttctaatgatccatgtgcctgttcgccctcctcacttagctatgagctacttaatatcaccataggatgatactaatatggacaggtttttgtatcaagcagtcctgagtatgaagacagctcttgtacttgctgcttctgtgaccttccataaattccttaatctcctgaagccttgattttttaatctgtaaaatgaggggggtagaaataataactttatgaaggggctattgccagggttcaatgaagcagtataaagcaagtgttagcagagggtctggaagttagtctcattgtatctttcttctggtatatcaagtgactgctggagaagctgacacactagagggttcagacagacatttgaaaggaaggagaagagggaaggaaagatggtgaaaactaatattagcagggagagaagagactcaggctgtttgtctggagcacaggatgacacaggctgtgccagaaggggaagaaggcaccttcacagcctcccgaagggctgctgccctgatttgcatttcagacacatttgtgacagcctcataattgattaagagccccagcactgatatattaaaggttaatggtgcatcctgcttttgtcttgatttgtggcagcaaatatttgcgggtgttgagagctgagagctagccatgttcttggcatgcaggtcctgctggctggcaggactcccatggaatggcaggcacacaggagccaggggagcagaaaacggctgtatcccaggagaattctcccaattggtggatgctgatttccactgcacccacaaagaacctggatcatgaagtttcagcaccctgaggatggagcccaaagaactagatctgattcccagactccttggcaatctgttcctgggcagcctggacccacgtagctttgtgctgtgcctcctggctcagggccacagttctttggttcaagcacctcaaactattactaggcctgcttctctgcagatgattgactcacagttgtcctgaagggagactagtcaacccaagatgaagacttttccaacagaatatcaaatctagatatttttaaaggccaactcattcatatatgattcatacatataacctatgttcattagagtgtctaccatgagctggtcactattgtaggtaggggtcatattatcacaatttggctagaacttatctggagtactgaaagtcctgcatccaggaaatctctagttcccaagcaaactggggtgattggtcactcaagttgtaggcactggtgatacagcaaaaaaacaaacagccaagtcctattctgggaggggaactaacattaagcagccatatatgtcaagttgtgatttttttttgtatttttatcatataatgtaaggggtgctgtgttttgtaaaagattgtcagcaaaggcgtcctggagaaggtaacatttgattcgacctagacactgaaagagtgagccaattacaaatctgagggaagagtaaaccaggataaggttaagaaacaaccacagaaaccccaaggtgggagggcagggaggctggtacggcgagagcagatgtattggggtccagataacataggacctttcaggccatgtgaggactttggatgcacactttgactttggagtcaagaagtcattggagggctttgaatgatgaggtgacatgatctggcacagatttttaaaggatcactctgcttggccttcctagggaatagctgtaggggttaaaggtggaagcaaggagattcttagagagactatctcaatgtccagataagatgcagagtgaaggtcatgataagtgatctgattctagatgtatcttgatagaagagataggaaatgctgaaatttgtatgtgcgatacataagaaagagaagggtcagtagtgatttcaaggctcttggctacagcatctcaaagaatagagcagtgtttgattgacatgggagaactagaggaagagcaggcatggtttaggggttagtgatttaagagctcaagtttgagcatgtttagtgtgaagatctattagccatccaaatgaagtggtcagacgggtgattgccaggagtggatgaggtaggtcagggctggtgtgtcccactacagtcatcaatgtatagatgcatctacagacaactgacatgatgagattgtggcaaaagtcctgcaacccagggatcagtggtctgacccctggaagattccaaaattcagagtctgagaacagaaagaagaattaggaaatggataaggaggtcctccaaggtgggaggaggactgagcaagagtgatttctggaagccaaatgaaggaagggcatctaggagagtgctacctgtcaaatgctactggttggagggatgtgaagactgagaattggccactgtatttgggagatcattaatgaccttgatgaaagttgtttcagatcagcagagggatgaaaactggagtaagccaggttcctgagaaacgggaagagggtaatggaggcagtaatcatagataactctccggaagaagagctggaagggtggttggaggaggatgtcatctcataggactttttttttttttgagagagagaagatgtatgtatgtattttcaagccaatggaaatgatctgcagagagaaataatttcatggtgaggaaggtagaggtgacaactggaagagcaatgtactttgagaaggcaagaatgtctgggatctaggagacaaacagagttagacatgcataggagtaaaaacaaagctgtcattttaaaaggatggaaggcaactattcactagttttcgagaagggagttctctagaaaagcaaagttctccactgatggcttctcccttcttaggaaaaaagaagcagcctcattgtctgagagtcatctgagagcgtgggaggaggaagtgcacagggagatttagaagatctcaagcagctttaagggtctcctggaggctagtggtcatgattctaaagttagaatcaccatgctggtgtttagcttggatcttctcccagccatattcagccattcagttctaaacacaaaattgttttgaaacagagttcattcttccagaaaacatgaactcagctcctaatgtctgtcagactgtatgtggggtgatagaaattcagagatggacacagagtccattccctgggggagctcaaggttgaggtgggcagacagcacaggaagcttaaaagggaaaacattaggataggaccaagcccagaacacacagggacttggatccagtgggcatggatccactctttcaatacgacatgacagctgagctgattccttcagggtgggtaggttttagtcagggcacagcagagaaggcaggcaatgaacctgagtgaagacttggaggcctgagtgtgcaagaggtcttccaggctggcacaccaaaagcagggtagccaagaagagctggaggaggcagcactgaagcactgaaggctctacactaagcctcctttgctgggggaaatagaagccccagaactaacctagtgaatagtgtggacattgagctcctgacttggcttagcacctggcccacagttatttgacctcatcaggatgattttcacagctcctattactgagctctacttacatacaggatctaggctgagtttggcaaatcagaaacacatataacatatgcctatgtttaggaattcacagtctgatttgggaccagggcaccaggcctgggttgaatccaggcagaaggtgcrgaagtgaggaaactccagcctgccttggtgtgggagcctcagtactgatgggccctgagtgcctgggatggcctcggaccactttgaattagtctcacatgtttgtcttgctgtagggactgaagatacaactatcacagcctcctcatggctggtggacagggtgtttgatagggctggtagagagacctcctgcctctcaatggatcttggctgatgggaggctaacccaggaggaagggtggacatagaggatagaagagagcacagagctcagttcccaaggcccagaactgatgcttgggcagcagcaggatatttaaaatcgttcagatcacattttttatttataacgtaataaaaatgcaaattttacaaaaatgtgtttgtaagaagtggaagtcttgcaggcattcactgcttatcccttttacttttgtttttatatttatttacatttattaattgttactttttacaagtatgtaaatatatacmaatgctttgagtttttagcagtttattttgggtgtcttttaatttcaatagcaattgaagaagtgggatttggagagaaaaygccatggagggaaggaaggtgaggagggaggacacctcagctggccctccgaggctggctttcaggcataggtttgaagaagggctctgtgacctatggaagcgtgcattttcctgctgtgggctctgcaaccctcaccctgtgggtcactaagtgtcctcatacagtgtttggatctgcagtccctctgctcactactcagaatcacaccgactaggctttggatacaaaggagaactgttttcttagtcttttttttcttgcttataacagaataccttaaactgggtagtttattttttttaaaaagggcatttatttcttacagttctggaggctgagaagtccaaggtctagcagctgcatttggtgtgcaccttctcccttcagtgtcatgtggtggtgcagcgcatcacacggacgggggcccaagcctactcgcatcccagctaaagcctctcttcttctccttataaaaataccatctcccctcccatgatgactgattagtccatgattgggttaatccattcatcaagacagagtcttcatgatccaatcaccttttaaaggtcccacctctcaatactgccacattgggtattaagtttcaatatgagttttggcggagacagtattctaaccacagctcctgtgtacaccccagcatcccctttcccaggcttcctggaaggtccccaggtaaatgttgcaaggtaggagaggctcataagctggctccttggccaccctgtctcagctccttggcaggacagccccagcaggcctcagccccatcctctgcgagttcattcctctctgctcctcttagtccagtgcgaggacatactagagaaacacatgccctagatgtcaactccaatggctcaaaatccaccctggctactttatgtaatcaatgcctccatcattttggctcacccttgctctgctttattaatcttcatagcatttttcatcacttgttacatagcagcaggggtcagctgacgatgccccacaggccttcagagggcctgcagcctgctttgtcacagcctgcaagtcaagactgcttttcctttttaaaaacattttaaagcgttggaaaacaaaacaaaaacaaaagcaaagaatatgtgactgagtcttgtgtggccctcagagaccacataggcactatctgtccctttccagaaagtttgctgaccctggcattacctagttattgtattgttgctgttgtcattgatgtttgtttctttgtctcatctcaactatgtaaaatccacaaaagtaggaactttgtgccattcttgccctatccccagacatagagcactgtctaatgcagacagatgcacaggaaatagggttttttgaatgacgagtgaatgaaagaaggaagacacctaggaagccttcccctgcatgggtgacagattagagaggctggggggcgctggggaagaaacccaggagaggcttatcagtgtgcagcagggtgggtcatggtgccctctggaagccagttgtggagccctatccaggcactccagattgctttgatgattgcagcatcatctcttgtagagccaaacatgagatagaaaatcaagactgctggaatgatagtaaaggcatctgtaggctgtagctwtgaaagtttcaagtcaccaggatggatatccccaccctcccgtgtcttttgagccactccaccacattctcttctccttaaggaagaataataggacttccagatccacatgtatcaggcccatgcttatgacatccccaccgttgttgaaatccgttttacgtatactgaatattgattctgctcttgttrcaagtgtttatctccattgccaatgtaaatatttttgtaacatgcaaagatgtatttataaattctgtattattgatttttctcatactgcaaacacatttatctctttgttaatgaacatatatctaggaaatagtaagattgatttacggagaaaggtgtggggaggacaggaggtggtaccaagctggggagaatatcctcggccacagctgaaggatgcatggtgggtcttccctagaggtgcatgtttaattagaggacagtgttctcagaggcaagggatgcttacaaagtccttttgcaagacaatctgatgtgctcaaaggtatcagctatgctttcagcatgtggaaatttcaaaaatcggtaatccaggtcaggagatacagagaaacagcttgcattggtcccaaatccacttttggtaggacacacttgagtagaagatattggtttaaacgtaagattggaggagagggtaggctttgtcaggggaggattccaacacaaaatattatcaaaagttgaagtaagaagataggyagcaaacagaagtgaggctcaagtgatacacatgcttgcaccatgacatttcatgagccagtgcagactctggcaggcagcctggggctgatgcttttgaggccgttcttcctgagcagttccttgcctaggagttcattactttcccagggtagcctctgctaggctgttactatgacgacccacaaagcaaaagtccagattgcctgccagaggagttttggtgtctctatgctcatcctgggttcagacttctgcaagtcatccttttaggtatcctgagtgcctaaagtgtgttgttgacaaggcagtagactgggggctgatgggggagcatttgcatgtaccttggcagcaagatggaaacaagatgggccataggcttctcactggggagacagatgggcagttgaggagataggctccaatcacatgagcctggaagcttagacatgcggcttgcccatgcttgcttccatctgggtgtgactactctggcctgttacccatgactccttcacatgagcacagtgttccaaccatttgaactactgataagcagtctactagaagggctagcatttattaaacattaactgtgtaccaggtatatgtctgtgatcattaatcttcaacaaccctgtgagttgggtatgagttatgaaatctaaggcttcagagattatagaacttgccccagtccatggttctggagcttgcatgcatcagaatcacctggagggttgtggaaacatagactgctgagcaccaccttcagagtttctgactcagtatgtctggagtggggcccaaggatttgcatttctcataaggccccaggtgctactgacactgcagctctgaggatcacactttgagagctactggtctatgtcaaacagtgaaggcattcaaagcagcatccacacccaggactgtcaaattccatcacctacatatttttggctgatgtgaattgctccctggtatgtgtccagaataagccatgtgttttcattacccaaatgccttctcaggtaatatcttctcttccaggaacattctaccccttggttctccatctcgctgcctctactcaccctttctgactcagcttaatgttccctcttctaggaagcatttctttagctcctacccatgggttagctacttctctgtgcttctgggatcccccatacagacctgtattttaatatatctcatattgtttggtcactgttgctttacttctctgatcactcgccccttgatgatgcctgccatgtattccttgcttggtgtgcactgtgccttacctagtagacattcaggaactgttggtgaaataactggttgaatgacatcagcaagttgcatcgtgcatgtgaggttaatagagaccacacctgtgataggcacgtctccttcatctctctgtggtgggggtacctggacactttgtagcagttgttgctgaagagactgacttcagaaaagttctaaattgagtgtgctgataacacagcctcctcctggtgaagcctccctcacttgctagaatgggcgtcctatctgacttcaacatctgtcttccactgactaccactgttggcttggcagtctggatgcctggctgtccccattctcctttattcctccctgtgtgtcccctccaaaactgggtgctgtgacaagaggatgacttcctcagggagatgatggctttggtggatgaatagttgggcccttgtgttcaacaccccagatagccttccataagtttattcaccctggaataagatggtagtgccccctgtgctgggcattagtgagcctggaaacctttgttgaaagatcgagtgcatgtctgagatgggagagattcctctgcacaaatttgtggctattagaggtgatggatggatgaaagctgtggccgtgggtctgagcagtaagattcaaagaagatgggggtggcattttggggtgggaacagtgaggtctactaaaacagaaatgaacatgaagccataaacatttgggctgcctgcttgttaaccagagacgttccctgagcctctggccgtgggcgccttaatgaataataccaagtggagagagaaaatctccatttcaaatgtggggatgaaacagtgtttggagatccctggcagttacccattcattccacactcatgaaaactgcagcaatttagagcagctcagtatttagactcaactgtataatttatcctgatgtttctcattcatcaaagcctcgtgtttgtttgtattaccatgagaaaaaattttaaaaatgtggaaaaaaaaaaagatccccctcctttcattacaggcaaattacggcagagttacaacccttggggcccttcaggcaaaggaacatcttgcttcaattagatataaataatgaacaataattagaaagatttcttcatcgaatttgttattttatgtttcctttcatctgtaatgtattgaaacraatactgagctctgtttctgggccacatagcagggacctaaggagtgctgtggcatgtgtctccgaagcaaggggaggcatccacagctgggccttctgtgtgctggccggggaggctgctgtcagcgttggtccagggcagtggatgcaaaaatggggctccttcagctccattcctccaaattcttatagtctactggggacccagaataatcactactggttaccatcaggaactgctctgagagctgaacacaaatcccatttaatcctcatagcaatcctctgctacaggctctgcttctatctccattattaaaatatttggaaactgaggcacggataagttaactaacttttctggaccacagtgttggttgtgggggacagacaggcaaggtaggcaattggactccagagcccttgcttgtctctgctctggcacatggccctctgaagtcccggtgagctcatgctgccatagaagcccacaaggtgtggagagggcacagggaggctggggtgcggatggctccccaaggaaagaggcagctgttggctgttggattttcaacgggcttgtagaggtgttgttagaggagggagataaagggattccaggcagagggagcactgtggcctggtgccatggatggggagtgtgtgggatttctcatttcaaggttggctatggttctgtgtgcaggtggggagaacagccagagatgagaccggaagatggagggttgtgtagatccagttgagaagactggctcttcctgtggaaatggtgactcagagagagggagggatgatgatgtgggttgttaaagaggagagactgagatttctagaagagaaataagtaaagagtgatcaagttggaacctggagagagaggctggctccccactgggctttttttattttgcaattctgtttggtacatgacgttctgtcaacacgctgagccaagtacgctcttctgaggcaagtaaaatcttcatagcgactggtccttcctgctgtgactatttgtccttccccagaggagtctcctcctctgcccctagctcagaagtctgctcttgggctgctgatggccgttccttgtgaaatcccccctcaaatgtgcacctggctggagccacctgccactcctctaaggagagcaaacccaaggccctcagaagtgctttgtttttttcatcatcttttaaataattatcaacattttaaaatcaggagagatataaaaatccaatttttttattttttcaaagaccaaattggttgaggaggtcatggggaggggagcattcgaagtcaatacttggctagaccccagcacagctgcaagctttggaggggatgcctcttaatttaccctgagtcagttggtctctgagtgcgtttcttcctcatgctgtctctgagtgtcacaggccagccatcattatcgttcatcttgccaacataggcctctttcctgcccagcctctgcaggcgtctgagttggagatccgcagcatacagcctcccatgttgccctgactctttgatactatgattctctgtctatatgtttgcttctatagctggactataaactccttgaaggcaggaatcatgtcttactcatccttttatccctccagttcagtaaagaacctggttttaggtgcccagtcatcttattgaattaatctgcactgagaaaacacacctgtaattgaatgaggcgctgcaagtcccactctgggctgaaggacttgaactttgggggatggggaatgaagaatgtggatagtgggccatgccgggcttggagttcagaagggccttgcagcccatttgtatccttgcagtgtgcaatgcacagcatgtactcatgcctcgctgcctttctscatttcaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggtaggcaggagctggcgcttgggcacgtgcactgtaacagggccacggggtggtcagcccccaggtgggagacacctccaggggcatctgcctctgagcagccctgttacctgcaaggcgatccatcgcacacgttctttaggtggatgccctttcagaagcagctgctctgcttcttatggaccttccaactttgtagagtggtgctggctggggaggagcaggcagattaagcctgacttttggcccaccctcctcatgggctcataggagggtgacacagagaggcctgtccacccgaggtgagaacaattggcaaaagcagtagcagagtgccaagcgagagttgcaggagtgaagggagggtgttggggagagggtgggcccactgtggttagcttgggggtctggttgaggaagtctgcatacggggaaagggggtaagggtcagccaggtggcctggactcatctctggggccgtactgtgagaagagttgtacctcagagatggggataagggcagagagccttaccgggcaaagccttaggaggccagatgggaagataccagtgccagagggaggaagggaggagaaaggccatgatgctcttcagcactgttagatgttgctcatttgtttcagtcaatttcccacaatgactcgaattcagcattatcctcttatacagctgaggatcgggtggctctgactcatgactccttgggttacaagctggggaactggcatttatccaacacgtgcagctgtagagcccttggaggtcaatgaagaagaatgtggtgggatgaaggcaggtgttatgattttgctgctggtggtggggtcctcctgtccagtgaaccccacatgcaatggctactgtcctgaggtcattagagaatggggcgagagacatgtacagccccctggccaggaccgctgcctctctgagcagactggctgcctcagtgtctcctcccatcctttccctcccagacccatcctgccacctctgtggagtctcctcatgcataccctcacaggcacactaacaccttgccacacacacacacacacacacacacactcatccctgtgctgcccccccagccactccagtgacttcttggccttcctgcagagagcagtggatgtcaggacagcctggggcaagctctggggccagtaaagcccaccgccctgcccttcatggtcctcagcaatctgccagcccctccctgatgtgccccagaggggtcaagggagagaggcctgagtccccctttgctttggaaacacatgggcatcaggcagagtgcagcctctatcccatgacaggctggggcacctagctgtggtgccatgtagagtgaggcccactgggaagatggtcgtgcacaggatgacttgtacaggatcccatgctcaggatgatttttcattgccatttagccacattgaacagcagaagatgtctaggctctggagcttgacatatttaggtgtgaattccagtttcgtaagttaccaacattgtgaaatggagcacaccattctccttgtttgggaactcttggatttgagaaagacctgggcaactttccatttggtggtctccttagagacttaaatgatctgaaaatacatatcatgataaattttgaatgtttagatttaacaaagtgatactttgacaataacaatagaatgcagtgtaactgtgctattctcatgcttacaagatttattaaaacctcgtagttctcactgcactgcaaaggatgatgctctagccttaagctgcaggatcttctttcacccctgacagtgaatctttgtggctgtaggtgacctcatttgaagataatgaacacaatgttgatttaaggccttttgtgcatgtgaggcctgggccaaatggccttcgcgttccctttcctggctttctttgactctcagagagagccaatactgtcatccacacagggtcttaagaagattcattgcataatgctaaaaaaaaaagcactgcttagaaaaaaaaaagatagctacttttgactttgttaaagttctattcattacaagccactttaaataaaatagaaaggtaggtcacacactgggaggggatgtttacaatacatataaccaatgcaagattactgtcaagaatatattaataagaaaagctcaaacaacttaatagaaaactggcaagaggcttgcacaggccttccacagaagaggcaacacaaatggccagtaatcaaatgaagagatgttcaaaattattagtgatctgtgaaatacaaatcaggaccataaagattatatcattttacaccaattagtttggcacaaaatgagaggcggtgaagaagacgtggagtaacagttggttaattgctgatgggggtgtgctcagtacaatcactttggagaagagcttagcattctcttataaaatgggacacttacatactgtatggcccagcaattacactccaatgtatccacccaaaataaatgtccacatgcacttttggagacaagaaaggccatagtagcacttcctgtagaaccaaaaccctggaaaccatccaaatgaccattaacaatataaagaaagatgttgtctacaatgaaatggatgaatcttagcagaataatattgagtaaaataaaacattaaggcaatttcatacgggtcaactaatagaaggtaacacagaatattataccctcttaaaaatgtataaaatatacacatacacatccaaagcaatgataaaatacaagattcaccacagtggttgctacaggtgggagagccagagcagcagagaagagagaaggacattgttggtaagtcagagttggtgttaggtttagattagcaggagattttagaaaattagttaatgagttaattcaaaaagtgagccattcctggagaaatgtatgggtatcctgaagcaaaggttgtcattaatctcattctgctcacctccctactcttccaaatgcgtaagtccagaccaagcaaggcagtgctgggctcctcacaagtacccaccccttccctctttgcaggcgacatgtgcctgcttatgcctcagaaaggccaacacacaccactgagccctctggttggtgataaacctggagatgagtcattagagaaacacctcatcattgttctagctaccccttgtccattggcggcacttaggaaaccactcaccgtctggtgatatttagtcttactcatgaatacaacaatgttaaaaaatcagtagcaaacgatgcaaacaaaggatttcttatcaatgcctatcacttcatggtatagaatttaatctttgttagtacataagatggattagttttatgrtaccttcattttatgaaccccaagctggctttgggatcacaaatctctctcttgcatttggatctctaagaaaaaaaaaactgactgccagcactagacaaatgttaagggttttataactagtgtcataaaagtgagtttatagtattgtcagacaatgaagtgtgctgcattttttttagtggaagaaaagctcagatttactctcaaatcctccttcttcgtgtgcctgtttggatgactactggacttaaatgcttgtctgaaatctgtcttcttccctactcctatggagcggcccctctgctccctgcccccagactatggcttcagtaaccttgtgaatccctgagcccagagagcagaccagtctggagatggctgtgccctaagtgaggatgacgacttgaatccagaaactacagaacaaatccagcaagtagggtattatgggcctagtattcagggaggaacagcctctccaaatcccaaacagagtctgctgccatgcagtgtaggcagcctggcaaaggtgaggagaagcccaccgaggggcttctcctggaaacttctttagcaattgacagataatcacacttctgattttcagttgctccttgatgactcagctccattttcagggagtgtttggtagtggagcaatgtctaattgctgcaaaagtcaaggaggttggtatggatggtatgctgttattttctccttgggagtcctaaggcttttaatgacatgaaaccaatttaggtggggaattgtttagagtgatcacttgtccacggtatcagaactggagaagggttatgtcatggttggctcgcctctgagatccactccttcatgccaatacacatcattgagcctctggagggtaataaacctggagatgagtcattagagaaacacttccttatttttctagctactccttgtccattggtggcacttaggaaatcactaaccctctggaaatagagtcttactcatgaatacaataatgttaaaaaatcagtagcaaaagatgcaaataaaggatttaccatgccagtggccactaagataaggacaagtgagaccttgtcaggctttgatgaggcaaagatgaaagaatttggaacaggagggaatttttatttattaagagacgacaacacaccattttcacaacaaacctgcctggcacccagtaagtctcaataaatacaggattgttcctgaatgagtcatctgtttgctgtctgactgagcagaggcagataaatcggagacaagattcctgtcatcagttagcaggttaccccctttagatttcatggtggaagggacaagagaaatagctccagggttcctgtcaggcttgtctcttgataaccttctgtaagggagaagattttcctggtcctgaaagatgtgtcacaaagagagaggagagaggctgcttccgtttctctcagccacatgcacttatcaggcctaaggaaagactagaccaaggattggcaaactctgactcctggtcaaatctgacctacagcttgtttttataaaggtttattggacaacagcccaactcatttatttacrtgctgtttatggctgctttcctgctatttcagcagagttgagtagttgtgataaagatatgtggcccacaaagcctaaaatatctattatctggccctttatagaaaaagtttgaggactcctggtctggacaggggcaacccagggacattgcctgtagctgtgcatcatctcatagcacacaggcaccattagtagggagcatatcctctaactctatataatcaaatagtgcacaggcatctctgctaagaagctcctgctgcagctctgcaccatttaacagctcataggtgcctctagtagtgcatcatccagctctgcaccgttgaatagcatccgggctctgcccctttttgtcctctaggtctgtctctggtggcctggaaacttctccctcactgcgctgagacccagctttactgctggtctggcctggcctccctctgaaatctattgagcaatctctacatcccaggcactgggccagatcatttacatgcattcatactttcatctgaaaccgactacttgattattatctccaagatgtagaaactggacctgagcctcagagaaactaagtgacttggctaaggttcacacagatgtgagtaattagtggcatggtcaccaaaacctcattccactcgtgcctcttcccatggggtggtaatctcgtcttttctacacctcaatgtgtttccacccccttgtgtacattttgcttgtgcctctatttccttccctctctgacaccaaagtggcaagatatatgcctgacttccatgtttagcagccatactgctccttccatgtgtcatagcaaaggttattgaagtctgtgactttatcttttgattttcaaactattaaaatatccattacagaaacttggagatgcagaattggcctggcaaatggttcaaatttatatgataataacttcatcacatgaagtcagactttaatattgctgatgggattttttttctttagcttgatcaacttcatcaagcaacatccagcataacccaatttctgcccagtgccagggctgacctggatcaccagttgattaagcctttccataaatcagacctaatatttaataacactgtcaagtagaatatagcgttaatagtttaaatgtcaatcttcacagcttattcagtcctttgaataaatagatgagtagcttgtttcagaccctgtggctggagatagtatttttcagagggaagtatctttttaggccagcatttggtggtaacaaaaggtggtgtttttctgtcagtaaatatagctgaagtcataaagtgtgaatgcaaatgcaggaagaaaatgggcccgcaaatcttatttccactcctggtctaatgcttgctcttgcactagattgcatgtgggcatcacctcttagcaccaacatttattcgctttctcttcctttctgctctgtaacagggttgctctcattgcacacaatctctgcttagtgtcagggactacacctgtggcagagaagctgatccctagaaggatggcagtcttccacagtaggatcaggaactttggcacccagataacccttcatttggaaagggcaaggtgaggaagttggcctcatatgtggcagctcctggttccatggcatgctggaaattcctactgagaagtagggcgaggcttatatgggtgggcacttctgtgcacttttgggatgctagattcaaagatcaagagagtttgaccaagatatggaaggggatgtagactagatagccctgtgtagtgcaaagcaaaaatactgctctctataacagcaagagcccttgtagccatgatccaagaaattctgttctttctctgcttccacgtgagtatggattggggattttgtaagcctccttccctctcagccactcacattggataatcattcatctctatatcttttgtacctgctcaaaagaccctatatctattttgcaacttggatgctatcttctctttattcattcatttatgaacttactcatccattcaagaaatgtagtttgagtagcatcttccttttaggagttagaaaatgtgtgtttaaatgttatgctccatctagtctgtggctttgaacaagtgttcacctttctgtaccatctgtgatacttgcggaaggtctgtccagattagttgcaagtataccaatgtatagggtctaaagcatccagtgtcgattgtagcacaaggtatatgttcagcaggcatcagcaaactatcttagcatctactatatgttagaaaaagattttatttatttatttatttctgaaatggagttttgctcttgttgctcaggctggagtgcaatggtgatctcagctcaccgcaacctccgcctcccaggttcaagmgattctcctgcctcagcctcccaagtagcggggattacaggcatgtgccaccatgcccagctaattttgtatttttagtagagatggagtttctccatgttggccaggctggtctcaaactcccgacctcaggtgatctgcctgcctcggcctcccaaagtgctgggattacaggcgtgagccaccgtgaaaaagattttttaaaaaggcaacagcctttagtcttttatgaagtgtaattgaaatacacatatagtgtctatttcatgagtttagacaatttatgcaattctgtaataatcacccaaaacaagatacctatttccattacctgcaaaacttttcttttgtcactttttacacttctcctcatctgcagagacaaccgcttgcagatttctagcaccacacattaaatttacctgctcttgtagttaatataaatggaatcatacagaatatatgtatttgtgtttcattctttcacccaacaaaatgtatatgagatttactcatggagttgtgcatatcagtacttctttttttgtgtgtgtgggaatgatattctattgtatgaataaaccttgatttgtttatttattctccaattaacatatattgtagttgttgccaattcagggctaccataaatatgacaatatgaacaatattatacaagtactttgttgaaatatgtctccatttttctttgctaaatttgaaagggtgaaattcctgggtcattatgaaactgtctaactacctcctatgtggttatgctactttgcatcacctctggtaatatactccttatatacttgtaagtctcagttgctgaatgtcctatcctgcattagtgttgccagtatttttggttgcagccaatttagtgggtatgaacagaaatctgattattattttaatttgcttctctttggggactagtgatgctgagcattttttcatgtgcttattggccatccatgtatcttctttcataaaatgtgtgcttaagtcttttgttaatatttattgagttttccatcttctcattgctgatttatattcattaatttatgtattctggatagaagtccttgatcaaatataagtactataaatataattcttagtctgtaacttgcctattcattttattctattgacctatcaccattattaaaataatttgtatttaatcaattgactacatgccttgattgacagtcaactggccatgtatgtgttggtctatttctggactctctattctgttccattgatccatataactattcttatgccaataaaaaaatcttgattattgaagttttaaaataattccttaagtcaggtattgtaagtccttcaacttcgttcttcttttacaagattgggcaatttcagattctttacatttccacttgaattttagaatcattttgtcaatttcttcaaaaatgcctgttgagattttgatcgttattacatttaatataaggatcatttcagggaaaacttatatttttataatactgaatcttccaatctatgagcatggtttttctgttcaaaaataccaacttttgtcttcactgattttcactgttgtttttatattttattgatttcaacttttttgtgcataaaatattttcttctattttactttggttataattttatcttacctcttctagcttcttaatgttaaaacttatatcattaattttacacttgttttctttcctaatataagtattagagctataaacttccctctaaacactgttttaaccccaccctgtgaatttttatatgttgtgtattcattatcacctagttcaaaatatgaagtcccagacttaatctttttgtcaaggaattaagttctagaggacagcaaatggctgcaattgatttaatgtgggaaagaatatggatgcccagagcggggatacattctgcttagtgaagttagaagaagctatccaagatagtcatgttaggaacacatattttataatctataagcctcaactccttttctgatttgaagataaaagtgtgagaatgtgagagcaaaatggcaagcaagaaataaaaggtacaggaagataaaggaaattagagaggcaggaaaaagcagttgaactccatgtgaacaaaacccacatttatttctactaaatgtgtagctttagcagtagtttatttctactaaatgtgtagcttccttgtaggagaatgagggcagtggtcttttcactgcttcacagttgctgtcttcaatatgcctcccatggtcttgggcttcagcctcctgagttctataggccttgaccaattaaaatgtgcctaaacctttttcacatgctttgactctgcagtccacccaacggcagatccactcaaatctcccccagtccatatcaacttttaaaataataagcagttttgagaggaaatctttaggttatacatttatgatttacatgcaataagttcccattaagaaaagtttaaaatatttcttttttcaccacctaaatgcagttccaagaatcctcttgtatatttctgtctagtctttttagaatttctacaaacgttttatataattataatgctataaaaatatttcatcctgcatttttctgacaatgtggtaaaactttataaaaaagatttttctgacaatgtggtaaaactttataaaaattagtgactagtattttatcaaatagatgtaaattgatgtaaaaattttatttaaacattcccttcttgattgccatttgggtcatttccagttatttacagttataaataacattgtaatgaacatctttatgcctaatgtttttcagttactacatttatttctgtaggtctaattctcaaaagtagaattatggtgccaaaaaggatataaacatttaaagcccttgatgaagtattactgaatatcaccaaaagcagggctttgaatgaattacattattagttttgggatcaaaagaatatttatttgtcagtggattttttttcatcaactccttgtgatttatcttaagatttaaaaaataaattagtatttttctactttctcatatctttcattgtgattttttgttcctttttctgtttatatttgtacataggtatttgtgtatgcatgtatttttgctttattttgctttataattctggggactacagtggaacagcaatcattttcttttcaatctttttttcctgagcgttgccattataaactgtggctaattggggaaattgaataagatcatgaatgtttagcggtctgtggttgttcaataatcagaagtgatggacatgtaaatttcttccttaaatatagatttctgcagtgatttactctgtgaagtattttgtcttttatccatttattcattcatttattcatcaactcatttactagtgctgaactcagttaatatgtaaaagtggacatgacacttttcctcctaaaactgagttagaagagaagacaaaaaccgacttgggacagtatattatttcaaaagtaaaagatttttgtatcctttcttattttacccggggtcttcctttcctccactggggccttatgtcaatgtttggacaatcaggagattaatttaatcacaacagctaccatgagagaaacctggcatggatcaggtgtgaggttaagtttctcctatgcatcaagtctattgtgcttcagcacaaccagttcattaatgaggaaactgaagttccaagagggcaagggacttgctgacaatcaagcttgagtcagtattgaactcttctcactccagcgcccttgtcgttaccccgtgacagtctgcagaaatggaaggaactcgtgatcagaatgaaacttcagctcccccacactgcttggagcaccagtctctttctctgcctgccaggctggttcctggttatccctcaggccataacagaagcattaacgtctcctgagccttccctgggctttccctttccccttaccacacagtgcatcccagagtgcagcctcaccagatgccatccaaccctcagtgccctgctctgtcacagccctgctagacttggggcttctctagagtgaggcctgccttttatttatttgtcctcagggctggctgagggcagaggtaggcatggataaagcacttactcaatgtctcttaacctttcaaaaatcaaagtaaatgttcaatgagtaagaaatgagagtggatagaaatagcattcatatgcatctttcttaaacatgagtgagcagcaaaattgctggggtccacttgcagtaagggcaaggagggggcaggggagggcagggggtcctctgccctgggcctgggtggcagagtcagtcttactagagccagttgccatacaattgactgagttggcccctttataactccttgctgtttaattctgtttggtgatgattggtttgggataatacagtccaaatgtcaaggaaagcccccactgtgcctcccttattaaattattctgctttgggttttgagcattgccaagcaaatctcattatgaattcttcaattactttcttttacgatttttataatttgatagagtaagctctggaatcaaaccaatatccatgccaccatgctaaccttgattattttcaaacttcttattagaggaagtgggaggatgttgacttctcttaaatctgatttttttttttttttttttcagatttcctctgccctgtaatttgctttgtacccaggtctgatacgcttcaccttagtgctggctgtaaatgtgggctgattccattctgtttgttccattgaatattattgctttgggttttatgacttaagtttttacattttgaactgaattgttttgttatttgattacattaaaatcaagaagaaatttctgatgaaaataattttgatttatcatgtcagccagattgttggcaatttttgtttagcttatttttatttccactttattggcataatgtttattcaggagcaagagggaagagaaaatgaagaaaataacattcacaaagaaattaatatgtgtggcattgtgcttatgcactttatcttcaccattgaggaccttttgtggcgtgtttccattttgcaaataaggaatgcaaaactcaaaaaactaaattattttcctgaaaattagctgtctctttctaccatttttgtgtctttttgttattactactgttattatcattgtcatcattatcttgtcatcatcaataagataaaacatatttgagtagaagtagtggtttccaccgggatggggtgttccaataaacagctgataggtctcctcactctacaacatgaggatattaagatttgctctgggtcctatattttgaaattgtagtctgtgtgtgtgtgtgtgtgtgtgtgagagagagagagagagagagagagagagagagagagaggtgccccatcagggctgtgcaggaattcccccactacccctataaagcccctctactggtaaactttttttttttttttcagatggagtttcgctcttgttgcccaggctaccatgcaatgtgcaatcttggctcaccgccacctccgcctcctgggttcaagcaattctcctgcctcagcctcccaagtagctgggattataggcatgcaccaccacgcctggctaattttgtgtttttagtagagacagggtttctccatgttagtcaggctgatcttgaactcctgacctcaggtgatccgcccacctcagcctcccaaagtgctgggattacagatgtgagccacctcgcccagccctctaccagtaaacttttatggttcttttgactttacaaagctgtaaattccaacaggtagagcccacagcttgttcagctgtgaggagtgagagtctatttgtatctttttggtcagaatgtgacctcttttgtagctcctcaaagtgctccaaggctgttgtgtgagctctgacattttagcaaaggctataaaggaatacttagccacaaatggagttagaggatgaggctcttccacataagcccctggagacagtctcccagcacatgaagggatgttcgttaatattaattgggatagcatgcaattttgcttctctatcctcacagcacagttcgtgttgccagttcccagcaaccctttatggctaaagagactttaagaggaagctgcttcagacagcaaagccaccttggcctcagggtacagtttcatgggtctcaaactttgtttcagtaaagtcaaacgctccgttaaaggcaacatagcatagtgaatggagaatgtgatttgggtctgaaagaactggatttggctctcgtatccatcttttaccagctgtgagatcttgggaaaattaatgggctcctgaataataagaataataataccaagtcttatcagagttattgtaaagattagaagtgatgtgaaagagccagccatggtggctcacacctgtaatctcagcactttgggaggctgaggcgggaggatcacttgaggtcaggagttcaagaccagcctggacaacatggtgaaacctcatctctactaaaaatgcaaaaattaatacaccatggaatactctacagccataaaaaggaacaagattatgtccttttcagggacacggaggaagctggaagccattatcttcagcaaactaacacaggaacagaaaaccaaacactgcatgttctcactcataagtgggagctgaacaatgagaacacatggacacagggaagggaacaacacacactggggcctattgggggatggagggatggcatcagaataaatagttaatgcatgtgaggcttaatacctaggtaatgggttgataggtgtggcaaaccaccatggcacacgtttacctatgtaacaaacctgcacatcttgcacatgtatcccacaccttcaaataaaataatttttaaaaaataccaaaattagcccggtgtggtggcacatgtctgtagtcccagctactcgggaggctgaggcacgagaaccacttgttcctgggaggtggaggttgcagtgagcctgggcagcagagcaagactccatctcaaaacaacaaaaaaaccttaaaaagtatatgttaacagtgtagttctcaaagggtgggccttgttccaacaccgccagcatcatgtgggaacttgttagaaatgtaccttcttggactctactccagatctaagaattagaagctgggcaacagggaggttagcagtctgtgttttaaaatgccctccaggtgatccttatggcttctgaatttgagaacatttgcttgaacaaatggtgcttattgtcatgattgttgttttgttagtattttatttattcttgaattttagaaactgaggccaagggtgcccattgatgctgtcygtgaagcctctggaagagacttcagggtggaaaagggtggagggcagacctggaggggcaaacaggatgtgccccattcagcagctcagtcaagccaagaccaaggttcctggcttcccagattctacttgccatcctttcatcttttattcaatcactttacacatatttacttagcaccaactctatgccagacatcatgctaggggagcaaacaggacatgcatggtcaagcttacattcttgtgtgtgtgtgtgtgtgtgtgtgtgtgcgcatatgtgtttacatggcacacagggagtatctgcacagtcctcttcctgtgctttatgggctatttgaccacatgtatgcttgtcatctgtgtaacctgaattcatgtattcttaagttgtttcaatttcctgggatggcattcttcattctgtattcttttccctttgtaatctattttgtatccaggcacaccaatttgctctttcttttaggtcattcttaatttttcccatggaataactcagattagattattgtttatcatggtctttggacaatttaaaattttgacaaatcattgaaaatcaatgtgtccctttgccctactgacaaggttgtttatagtccctagttttgttgatagtgtacaattgcagattttgagaaaagaggcattgatttttccaacttargacttttctttttcctttataccaaaccagcttctttttttcttgaaaatataagaaaccttattttactaggacaattttttgctcaataaacaaaactattcctccccaaagtgctggaggccccaaaagggaatgcagccataatgtctccacagggtcagatgctggaggcagatgtcattaacaaaagcttgacaagaatctggcagcagaagaggggaaaaaaccagcatgaggacaggatggtcagggggctcaatgtggctgtttggggctactgatattaaacttttgatgtgacagagaggaaggcaatttgcagtcaaggagatctgaggaggaactgaagctctgccaatagcaaattctgtggccttggttctttttgagcctcaatttccctgggtggaaaatgtacacaatttggactatggaagtttatcctgaactttctaagaaattcagggaacagaattgatggtaagggaagagaatagctggtaaagcataaagtagagttcttttcaggaagatattcagtgtgactttcctttaaaatttgtttttagtagccttggtctctcaactctatggtttcccttcttccattcagtactccaattcaacaccctagagctttaatactatctccctttataaacctgtgttcaagagaagatcagaaattatttgacccagaggtctaagtcattacatcttgactttagcatgcatcaggatcacctgtaaaggttattaaaacatagcattttggacctcgttccaagagtctcttatttggtgggtcttgggatgggacctgataatttacatttcttataagttcttcagtgagctgatgctgcttggccagaaaacacactttgagaatcactagtctatagcatagactttgagaataccagatctggagaagacttgaaggaccacctgtgcccctcttccatttttataaattgatatgaaatgaataattgggccaagactgtgacccagcctagtctaacagtttttctaatttactaggctgatggttgaggacaatttcacgtgctatttattccaaggcactcgcgttgttatcaggatccaaactttaagctgtaaggtaatgctggtaatgattgtcatgaccatgagaataacgtgttgttgtctgcgtttcttcaatgcaccaggcactttccacactgtcttttcctgtgacaagtgtgtgaggtgggcatgctattcctgtcttctaggtgagggcattcagctcagagggcttagatagctggccaaggatgctaaagaaagacttggtccacctgtctccaaacccttgttcttgccaacataccatgccgtgctgtctgtgaagtgggattgaagactctataaaggaagttaaaaaatcaaagggcagataacataagagaaaaggcatttctgctattgttgctgttgttgagttgtttgagtgtcttacaaattctggctatctgtccctccattaaaaagtgggcaaaggacatgagtagacatttttcaaacaaagacatacaaatggccaacaagcatatgaaaaaaatgcacaacatcactagtcatcagagaaatgctaattagaccgacagtgagatatcacttacaccagtcagaatggctattattaaaatgacaaaaaataacagatgttagtgaggatgcagagaaaagggaatgcttctacaatgctggtgggagtgtaaattactacaacttctatggaaaacagtatgtagatttcccaaaaaactaaacatagaactacccagcaatctcactactgggtatctattcaaagaaaattatatcaaaaagataactgtagttatatgtttatagcagctctattcacaatagcaaagatatgaaatcaatctgttgattggataaagaaaatgtgatatatatgtatatttatgcaaaggaatattattcagccattaacaaaaataaaataatgtcttttgcagtatcgtggatggaactggaggtcactctcttaagtgaaataattcagaaacagaaaatcaaataccacatgttctcacttttaagtgggagctaaataatgtgtacacctggacatcgagtgtggaataatagacattagagacttggaaaggtgggagggtgggatgggggtaagggatgagaaattacatgaagggtacaatataggctgtttgggtgatggttacaataaaatcccagacttcactactatgcaatacatccatgcaacaaaactgcacttgtaccctttaaattcgtacaaattttctaacaaagaaaaggaactcatggaaaaaaagggattggtggcctttttgagatgcaaaattactctcattctctctatccactgctgtcctcctcactattgactatgttactctaggacacaggaataccaggatgagacaggcaatcatttgcagaaatcctggggcctggccatcaggagccatgtcctactgttgtagcctgggaacacctccatcttctcggttgtcctgcccaggtcatgggccgcctctctgggactttcatgacaaagctaagggctgccctcatgtctgtgctctgcatgccacacaagccagaggccttcccactgctagatggccttgctcccctttggttgtgtcaactcattgtccactcccattctattcactctgggctgcagccaggagccaaattaactttgcaccctgtggaccctcaggaaagcagctttttcagtatttgtggagagttcagctgcaatctcttgtcccccgactgagcctgtcctggtttgcctccttttgctggtccagagtctgatctggataaaaagtctttacctttcattctttgggtagcaggtttcctgacaacctcctagctgggcccaccaatggtctgcctcacagcctcacatcattttgattctgcatcacctttctccattgttctctctttagagatgggctctttatctccagctgaaggtccactttttctgaacccttcatggttctccagcagcttggtacctgagtcctcttctctgctgcctccctgggggcaatggtgctcacgataatacacatactcatacactcacacataaacacactcatcaacctacacacatttatacaattctcacatacatatacacacaccttcacacacacacattccctcacacttacacatgtacacactcacataattctcacatcctcacatacattcacacacatacacagtcatacctgcacatatattattccaacatgcacacactcacacacccatacacacacacattcccatgcacacatacacataaatacatacctatagacactaacatgtattattgaatgcacacacactcacccacccatacattctcacgtgcatccacatggacacatctatacacacacatctccctcacacttacacatatgcacatacacaattctcatgcacacacacacacgctcacactcttctgcatgcacacactcatgcacacacactgcttactcacacagagtgtgttgctgacttggtgaaggtgggggagtgactggcaggaggggagtaggtggaggaaaaatgcttcaatcacagctgacagatggatctcctgaccatctgggaactgaaggaaggagcaggaaacggaactcgcgttgagccctcatgctgtaccaggtacagtgttttgccttcgggaatttcccactcccaaccttccttttaggaaacaattcttagcccctgagacagtagggtcactggagagctgggctgtgacaatgggcaccctgctttttctgctgcactgtgcagaaggaaggaggccragcctcgatatccgtaatcacaaaaggtgaggcttgctgagctgcaggaaacataggcaacacagagatgttcaaaaccaacaaaagccacccatgatggcacctcccaaagatgaccatggcttgtatttggcacttatttttgattcttcacaaacataaagttttacataataatttaagaggcggtcacaatgtcaatactctagtgtaacaggttctttttccactaaacaatataagatagattattatttatttagcgtttaccatatgtcaagcaagatcctgagcacatcacacatattgaggaatttaatcctcatcaggactctgtgaagtagggaccagtttatccagtggaactgagactcagagatgttaaacaacttgtctgcacaggcagcaagcgtggagctagcatttaaactcatacagttggactcagtaacccaggctggttcatagctcaggggtgcctctttttttcccatggaaatttcccttaacaatcaatgctcttttaaagcaccatattaatggtaacataatgttccaccatctaatactatcattcacctatctgattcccaattattgagcatttaggttgcttccaacttctgactagtttaaacagtgtagccctgaaaaaatctctatgcaaacattttttgaaaattgaataattccttaggataaatcccacgggtagaatcgctgcatgtacacattttaaaaacattcaattctccccaccaaattgccattccagaaatatcacgccagccacactcccaccagccgattgcaaaattgtctttttctctgcagatggtctgggtttttactgttgaatcttacaatttggcatggtacatacataatacaggtaacactgtagccagggttcaggctgcatgtggtaatgtgttgccattgaatgaacgtgactataggaactaagacttgggatgcttgaaaaggctgaactctgcttcgttaggataaatggtggctgcaagcagaggcaaaatgcactctgcatggatggtgaatgtacatgagaatgtgtcaggtttccaaagagtccctgatgtacagagaaggggcagaccccatgtcctcccttcttccagagtttcagtgactccatgaaacacttttgtttctaaagctagggaaagacaggcattgccatttgtgtgtggtctgtcaccagcaatgtcccctaggaagtggtccaagagcaaagacagtaggtgaattttccccagtccatacttcataagtctaaccagggcagaggagacagcacagacttctttggagccagatgtaactcargttgacatggctccactgttcataattcaggcttgtttgggacacgtcatttaattttttggagcctcagtctttttgtctgtaaatggggtggaatcttctgccctcgagaagtattatatggataaaaaagggatcaggtttctgaaggccttggtacccagtgggtgccccacacctaccctgcacctggcactacaggcacctgtcttccttctgtgcttcctttcagatagcatttctgactgatgtttgcagcaccagcattctcatttggggggagcagtgtggttgcttgtccctttccaaagcagttaggatggaatggaatagcgtaatgaggttcttgccttaaaggctgatgtctctgaaaggttgtgctccaagtgagttccaaaaggggtggaatcagtggagcaacaaaaggcaatgccatctcattttactgccagtgtgaagtcatggaacacaagcaagtcatccaatcagctcacttgtggcttcttttatagagcccaaccttcctccagcaaatagaggccaatcatattctgctaaatgttagggaggatgctgtaagtgttagagccagactccctcaccatgtcaatttttttccttttgcaacaacccagggagcaggtagactgagaagggaatctgcttgctaaggtgtttgctgggggacaaggctgggtggtctctctagctgctgttgtcctggcatcccagggatggatgctcacatgcctttgactttttctcatgccaagatattcttcctcctttcactaaagttcctgcatctattctttttttgtctggaccatgtttgtttgtttacttttcttttaggaaaagcggagaatgaaatgaagtaaaatgtttagaagtaggccaaaaatgtcaaggagattttcccaagtgcttgggtattatcagggagccagtgtcctggagaggtctgagagctctcccaggcctttgtgtcctgttgatgggccagggcactgctccagtggagccaggggcacacagggtatgcagattggattagttgtctgtgtcatgcatgatagaacaaactgtgaaacaaggttaaataaacacaacactttcacccacttgtttagaaaattatcacttatcccactctattaggtgatgatcaatcttttagaatattacatttcacatgtacacacaacagtaataataccgtatctatcaataataatctgttcatcctattatttctgccactttccttaagtattcatatatatgtctatatataaatatatagtgtttttgtaaagtctttatattactatctgttacataaaatgctatcacatttatgaatcataatttattgttatttccctaatagtaaatatttaaaccttatgtttactttagagtcaactcttaatttagaatatttgtcatgcattttagatatatttaggttactttttcggtgaaattcccaacttgcaaaggtgaaagacatgagcagctttaaacatttgtgttctgtattattgtattactctccaaaggattgcatcattttgtggtgccggtagccatgaaggattacgcacatttttttcacagtttctttaccactagatattatcaattttttaagaaaccgctagaaatgtaatttggccacttacacatattagttttcagacctctactttcttagatgatctgcaaatacgtttcatagctcctggaagaaacgtgggggctggagtcccaggactccgtatctagtcctgaagggctctgtggggtcaaaagggcctggagtgttgggtgtctatgcccacctaggctctgcagacagctsaaggcttggagtaagcttggctgtatccacagccttgtctccagcctaagtttccaccagccttatgctaaggcattgatccatggtaagtcagcgattggaaattcagaatgcatttcatattataaatggactagccaggccagataaaggtaatttaacccattgaaaggtgaaatacagtgtttgtttttgttttattttaatagcagaactcaaatcagtggcatcccttttatcttttaggcattatgagataaatgccaataatctatttgcaaacagctcaccacctatcatgcctgttctcagacattatcctcctcaactccccacagccacctgtaagtagggacaagacagtactgggagatacaggaagaaggagttggtttgaataggaagtggcaaaaaatagcagatctaaatatctgttgtgacacttggtcaagggactctgggacacctgcaaggagatggctgggttcatcctcctccctctacaagcaccagaccacagcacaaggttgaaaggaagctagattcctgctgatgctctgtcctttccagagcctgaaaaacatcctcaacagaaaagagttaatataamtaggaaatgacaaatgcttcctaatgtgaaagatctctgaaatggaaatgaagggatggagcaaggcaagaaaggggtagacatgctttcctratagaactagaggctagataagaggttgcacccacagaggaggggtctgaacctaggagtgggattggaggaaatgctgagactcaaggaaggaggagggtgaacttgcaacaggaggggcagggaagagaggagttgcttggctgtcctggaggcagatgcttgatatatttggtgtcctccccccagccccccgtagtggggaagccagacctgtggataagtagcacagaataagggggtgaattcatcattatttggggccacgtggaaaactgattctgaccctacaaggaggaagcaaagcttagagtttttgtggggcaggatggagctcattctgcaaggaaacaagaagagggtctgtataaagacaacagggccatgatgggtgggatattttaacttcttagagctggtgtctgcaatgttcctgacagtatggtcagacctaagaagccttatgtctcagacaggctctgtgacacactggaaactggggagatgtctgcaagtccagaaagttctggaaataaatgaatttggggacccaaagaaagcctcagcactgccttttactcagcatggagttgaaagagaaaggctgaggaagctctaggatgccaaggaagtgaagacgacatttaggaatggagggtatttcctaaggacagagctagaatctggcctgtcctgccactattggagcttctgatttggccctgtcagggtcctgtccataaagtgttcttccccatgcacagggagctctaggcatgtacttgtgctggatattgttaccagttcttggaggcactgaagtcaaggccatttcctgtgttcaccttaagcagggctcagtcaagttctaagtagaaatatcaaatgggtaagatttaccacagtccatcctcccctctttctcatctccacactgttatactcccctacatttccatagaattgcaatcccctggcattagattttctgccgtctccaaaggtgagcccctcgatctgagacataagcccatgccatgatgagaaagctcatcctagagcctacctccagctcccatcacaaaatgtgggatagcaccctctccaggtgctcctgctttggcattttcagacagattcaggatccagccacatgcttcctcaagcagacacaagaaatatattggcagcctggcatagtggcgtgaacctgtagtcccagcaactcaagatgctgaagaaggactattgcttgagcccaggagttcaagttcagcctgggcaacatagcaagactgtctatwttttttttaaaaaaaagaaaaaataaatataatgatgaacttagtccctgtttacaaataggcaaatggggagatggagtgttcagtaggtccagaaggcagctcctactgtctcctccggacttccttcctggttagcagggatttgaggctgagccattgccagcatcccttctggatgttccctctttctcagcttaggccagcaggactataaatgtgggtgctttcatgcagctgtgctcacctgtccctgagcccaaactgagtcacaaatgcccaaatggcttgaaggaagccaagtgccccattagagtggccacatcaggctttccttggagtccctttccattctctctaagccagcatattttgttttcattcttggagcatcacttgaaatgtagaaacaaacctttatcttaatttttccctcaacgtgacatacccttttgaaatcatasaaataacaatgtctgattgtcatgttgaattgcaagcatggatgtgaaatgctccaaagtctgactaaagccaaatattaggtcataagtcaacattttgctgagaaacttggttactaagaggttgaaaatgtctatctttttgtgagaaaacttgtttgccagcaggaaaaatttataggaytgttatcttcctacaaggaaggagagagatgtgtgtaattttgcaacctgggtcaaagtcctttaggacttctgaaattggattggctgaggactgaagccttggtgtaatatttggattgctcctcgaggtgaaagtcaatgagtggcacaggtgtgtgtcatttcttacaaggtcgttgggcaaaattgtctgaatgtctgggaacaggctcttcccactgcaggaggtcacactctgcccacaaatccttctaatggagaacttctgacaaggaaataagctgtcttgggccatgagcacttggggtcttgaaagaaataaaatcttgactaacttcatctaagtagctacgacactctttggaaagtctcagtggacatgaagactcaactgaacaaaggcaggagccagggacaatgtcctcaacaatgccaagaagcctgtagcttgctagcatgrcctattattgtctgtgatgtttcagtgctgtcactaagcccataatgaggcccccatcatctggtgcaagccatggtaaaaaggaaagaagcggcaaaggggtgtctgtgtgctcactatagcattaaaggcaggcactttgctgcattaagaacattctactttgttttaagatggccaggtggcagtgtcaggtttgcatctccttccagaaagtaaagcagcttgcattccctccgagtgcccaaactccaggcaaagttagaattgttgttcaggatagaagagaacctctgctgtggatgagtgcgacagartagggctttagctgtcgctgcaggcaagttcctgatggaagaatctgccaccactgcactgatgtggagatagtgacaccagaaacctgcacctgtgtgtgcatatatatgtttatgtgtgtgtacaaacwtatatgcatgtgagtgtgtgcatgcatatgtgcacacatatttatgggtgcatatatgtgtgcttattacacatgtatgtgcgtgtgcacaggtgtgtttgtgtgcaggcatgtgtgtacaggcatgtgtgtacatgtgtaggggtgtgtgcaggcatgtgcataccttcatatgtgggcagtaaaagacaagtggcagaagcctggcgtggcaccataacagtcaagccctgtccctaatggatttttcctcatgcacagggggctctagacatgtgcttgtgcttgatattaagtcaccattactccgcagcactgaattcagggctattttccacattcaccctaagcagagctcagacaagttctaagtagaaatatcagtgggtaagatatgccacagttctattctcccctattcctcatccccaaatattattctccccaacatttctgatctcagaatctcagtcacctggcactagattttctgcactttccatggctgagccctctaatctgagacataggcccatagcactgtgaccaggaagctcgtcttagagcccacctctagctcctctgcccttcccctctccatgagatgttttgtggctggcctgcgcaccttttatgtctagtcaaagtgagtggcctcaaccaatgctggcatttgtaggccagaaaacagtagcagagttgctgtgctgtctggtgggtaggaagaccattgaggatgggtccctcaaatcccaccatcaagatggctcaccaatcaaagctgacacagctggccaggactgcctgacttcrtggtaattttgatctttcaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggtaggcttgggcagcaaggtaactaccgctgcctcaggactctagtggtcaagggtaggagaataacctcttagaagataagagccaatgcaaacatctttgttcgtcatattttcccaagcacatactatgtcccactgcttcctcctcccctaccctcagaccctgtggaagtatatggtccctgccaggaaggctcagagtctctgtgggatctctgataggagcaggtaatgccagcctagggcatattagcacatggcaaggacgtcttcaggatgctagggtagaggcagggagaaaacggcatctcaccagacccaggatatctgggagaacttcccagaggaggggacacccctgaagctggaagaatgaggaggagttagccagaaaaatgaataattagcaggatctgataagggcctactaatcacttttaaagagaaatgtacctgtaatgtggcagtagtcaatgtggagactttaaaaaagtagagtcagagaagcagaatgtctccatatttatttgcacgtggctgkatggggcctctgattgtagggcagaactttcctggtccaaggagatgctgtctgctggggcagggaagggatgtggccttagccaggaagggtggaagtggggcatgggtagttcagtggcctttgtccagtagtcagcctgcaaacaggggctcctgtcgccaaggtgtctaagccttgggccatcttcttgcacatatctgtgaagggcattttgctgggtgaagggatgaatctgcagagcctagtgcagaagccctggggcaggctctgccagagtccacccaaatccaaaatgaggcagaagcatctgaatggaaaggctggcatcgtgccaggctcaggggcaacactcattgactgattaatgcatgaatttcagtactaaggaacttctatttggagacgtgagagtcctcataaaccatttctttaacatcctgcagttcagagggcaactaggatatctgggttgctgagccagctgctggcagagctgggagtagaatccaggtctcttgagccctagtgctatgcccatgtggctgctggatctccaagcaccacgacctcccttctctcacactctagatgtccagattgtgcccttctgctcatgagtacctggacctcagccccaccaagggaaggctgaggaggagggcctgcaaccagtccattcagtggcttctttgcaaaactaaggaaaagagtagggctaattaaggtaaatgaggcttttgggttttcccttaaatttaatcaagtatacattcttttcctccctctgctctctggagcagagagagatgacaagagggaaggaggagtagtgatttatcaattgctcagattaaatgcatgaagaaagaatggcttctctccaggatttataacacgttggtgttcttgaggttcgcaccagttggttttccgaaatgggaggctcaggatgattccacagaccatcaacctctgagcatctctctagaacagatggtaagagagcccatggggccaacacagcagcagcaccaagactgctcatgtaccccaaggcagcgctcatggaagcacaggggccccagcgaggaaaggttagagtccccgtgtgctcacactgctcagatggctcctgagagtctgctgaagtgaacactgacacactggagagaagaggcagcagacattagtccaggaacccgggtcttggctggactgctgaatggagtcagagcagagggggctcccattaggtcagagcagaacctgagaatactcaacctggagaaggtggagatgagtggggaggggtgtggctgcccacctccaatatcgtaagccttgctgggggcagaaggagtgagatgtcctttgtgtggcttcagaggaccagggccagggccaacatggggtgtgtgtttccagagaccaggctttctgaaacaggcctgcccactacctgtccactcactgaccgtgaggtccctgtgtgaaacctcccaacagagaccccatgggttgctctcctgactccaatagtcaccataatcaaatgtggctagtccagtttccatgtcattttggcaagtagtgattgattactatttgctttcatcagaaggcatgtgctctgtgattataaggaaatgtcaccagtggcctgtgctggcttcccacagtttcctcatcttcctgtagggtacagttcctcctgggctggaattatcccttgagtggggacactcagacctcaggttgccaacttactgatgccagtggttctttaaaaggttctgttgggctgggtgcagtggctcccagcactttgggaggctgaggcgggcagatcacgtgaggccaggagttcaagaccagccagaccaacatagcaaaaccctgtctctactaaaaatgcaaaaaattaggtggatgtggtggcacacatttgtaatcccagctacttgggaggctgaggcatgaaaattgcttgaacccaggaggtggagattgcagtgagctgagatcatgtcactgcactctagcctgtgtgacaaaacgtgaccctgttctcaaaaaaaataaaagggggggggggctttgttgtatggtgcatgcagaactgtgagctgcctctagcttcagaggaatgaagggataggtcctgagagcaatgcctgatgccatttgcagaaaacaggttctagtataaatgacaggtcccagccttatgtggaactgctataactgtcttccccttcatcctgggaactaaactatttccttcaataaagatatgctcctttgctttggcagaggacaggatgtagatgtatgtgtgtgtgtggtagggcttatgtgctataaacaggcttgcagaccacagcatgcagttggggcattcaataaatgtttagcaacttaatagccatttattgagcacctactgtgtagcaggctccacagctattgaatgaaaaaaagcacctgcaattatatctgtctggaaaatagaacaactggcttcaggaagtggctattatccctctggcttcctcgtaagcgagagtatggattattatggtgtgcattagtttagcctcattttcaaagtcattttgtacccgtgacttgttttagctttcctctgtcccttccatacttaaatttcctttgtttgtttaggttttttgttttatgttatgctttcgtataaattgccttactatcattctgggataagattgggtataaaaaatgcatacaattatagggagcaggaagaagagaaggtcagcaaaattaagcaacttgcctgacattgcacaggatctgcctaatgagcggaggagtggggatctgaccccacaaccaccatctggccagagcctcaccatcccctgggccagaagctggccccggaagaacagcctgctgttctggaaagagcatggcctcctgggtcagaatgacccagctctgatgagcagcatcaccactttctaattacaacagtgggcaagtcatctagattctgagctttaggtctttgagatgtaaaatagacataataagaaccactttgcaggctgttatgaggattcaaacagtgtaatatgatcagctcctactgtgttctctataaaaggtcgctcatgtcagtgctggcaggataaggctactggtcaatgtggccatcaggctgacaactactaaccagcttttatggagctctgattactggctggatctcgagctaacggtctgtatgtgttccctcttctcattttgtcgcaatatcctgtgaggtaggtacatttattataacctcaggctttagtgatgagagagctaaatttgagaggctccaagcctggatttgaatggatatccatgaacacgaagctctactgtctatccatagctagctagtttttcaactgctgacatcctcaaaggccctgaggtcctgcctatctgtccctgaggttcctgcaactgccaggaggctcagcctcctcacccctaccagcagagacttattaaggccagtgaacaggcagacatgtagccacggagttggcccgacatgatccatatgaggtggtgcaacactgcggctgtccagttcaccatgtggtgtgccatgagagaggtctgtagtgttctggggcaatctaagcatgaccccaaaccatataartgcacatgtatcttaacaactaagtcactgaatgcacagccacattctgtgtcttacatgctgatcagtgccctaagcacttaaaggacattatatcaatatctaaccacagccatcttagtcaagttttcattactcattagtacattcacacatttattgacacaacagacagccttagtggtaccagccactgtgcttgctcagggaaaacagagtaacccacagctcctgtcctgaagggtctgctcatctaagtggcggtcaacagtttatgttgcaaagatgagaacactgatctttagtaggagcaagtccctggtccaggtgaggtctggtgcctccaaagccaatctttgcactgagccaggccattcccagccatcaggaggccatgctgtactggacccatgatgctgacacatcttgggaccccctcagggttgtggctcttgtctccaccagacacaagcccatgtgtgggaattgagcaagacctcatgtttgtggtcacagctgacctggaatgcaggtccagggtagagatcacacaactgtccagtgggcagtgaatttttcctggctataaacaactgttgctctctaacgacacatacccagagaactcagagggacctctactgatgatatcagtcgaaaatatcaccatggatcaggcttaaagagctccactccccaatgaaagcttgggtgtttggggtctgggtactaccagctaccactggctctctgttaagacttctgggttacagacaaaataccacaaccaaagaaaaccacaatggggagtatagaagcagcatgggttgtcccaccattgcacacatgatgaaatcgaaactgcctctcatgccccctcagagcctgtgttctgggctctgccttcttccctgtcctcacctaatgcctgctcccatatyacccaatagtctcactggccatttttctgcttcttaaatgtgctaagtgctaccccagacatgactttcacatggggttttagtcttaggaagtttcttcctcccccaagttgaaagccaaccctggcagcctcataatgacttttggcaagacatttcacctctctgtgccttgatttccttctctgtaaaatgggaaaataggaataaccatctcaaaggactggcatgcaaatgaggattcaacactatttgccaagcatggaggatactccttggcactagaacatgctagacccatgtgagctgttttataattagtcatccttcaagcttccccttacatgttagctccttagtgagggtttctctagtcctccagtggacagcactcaccatgtggtgtttcctggaacctctactttgattcatttttttaaatcacagctctgcctgcactttgattgagctaatttttttagggtcagtgattgtatctctagaccataagcttagtagtgctgaacatcatactaggcaaagcacagaagatcctcaaatcaaatgactgtaagaataatttggtgaatcccagtgggagagacttaggatatagtaatgaaagctcaaaagaaagcattttcatgatcaggaatatcctaaatccacaacctaaatgtttgcctctttcatgtctatttcctagttttaycttgagctcttgccacagaatccatgtaatgggccttatgtgatttgctgttagactttatccttgggcagtggaatagggtgggagagggcagaggggctgttggggaggggagtgacaaaacctaatgtgcgttttgggaataacactttacctgcagtgtggagagtagactgggaagagaagagctaaggcagaaagctgctaggatggctcaatgttgtctgtggtggggccagcatggtggggcaggggccagggccccggtggctgagttgatgacgtcagtggctatagctcaccttgattgtgtcttacaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggtcagcaccctggggcctgccctccctttcacagcctagaggcaggagtgtcacactgggccattgggagggcaggttgtttctagttagtatttacctgagtcatcttgtctggaggcagcagtgttttatattgggggattttgttattgttttattttgtttttaaaactagagaagaaatgtaggggatgttttcatgcttgaacaaagtgctgcagtaccagccttagccactaaagtcctgtatttatctatagagcaggtacagcgtgggcagcgccagagagcccttccctaccctgccccgcccatgtgcctccaccctgacctggagagaccacctgtagggtaagagaggagcccattccttcctgattctcttttacttctcaccaagggacacagggcgctgctctcccagcgcatcaggggatccctgtccctcccagcactcctttctccctatattcctcctgcttgcagggcccagccttgcccctgtccctcctgggtgcacccagcctgggggacactagctctgtccacactccgggttctgggcacacatttctccccatgtgtgccaactgcaaactgattctgcccctccacacttccttcttactgggtttgtgttctgcaagctcttttttaaatttttttttttttctgaaataaagccttcaccaaggtcccccggagacctttgccctacggaagggtggaaagtagtgtcatttggtggtgatgctttgccagcagaaactccacatgcccagccacaccatccgtggggctgtcactctctgccacatagacctcagctatgtctagaaccacagctctgcttagagactctgtgggtgcagatggatataaacctcaaacaggaagtggtaaagcaacctgcatcaaacccaaaagcacttctgttttgttttgttttttgtctgtttttgtttttactggaggctcagatagtacagggcagttcattaaatggtttcagaggtagaaggtccaaggggcacaaaaaataaactgggacaggaaagaaaaacagccaggaggaggtaagagccggcgggctccttctcagactgatttggggaagggatttggcacctctggacagcaaggctgggtccaccatgtgtgtggcctgggtgtctggccacatcgcaccctccattcattggtccataagggcattcctggcaggtcaggggtgaggacaggggtgggcgtccctcgctccttacaggactctgcattataccaggtagtgagctctctgtccttatgctgtctcttccctggaaggacactgcttaactcagtacatctgcaatgttcggggatatctgtcttcctctctggccttctgtgtatctccatgtaagggaatgtgaagctggggccagctgcagcctcagtggctgtcctatcacccctggagctcagaagggaaggaagacagacctttgaggaaaaggccctgaaaggaatagttgatggttctgtcccaagcttctttggctactggaaaattttgtataaagaagtcagtgggagggacagtgaattattctgactagcagttgtaaggaagggctacacatatctgacctctcctcatcatgtcagcccctccacgccatgaccagtgtgcacccttcacctgcttgttaccacccaggtctctatgcacagaagcatcagtaggcagctgtgatggggtggccccaaagccacccccagtagaaccaagaaggatgagaaggatgggaaagaccaggcccccaaattggcacacgttgcacccgctccgtgttgtttgttttggattttgcttgttttccctaagtcttcaacctggtttcctctgtgcaaaggccccttgtgtcagcggagcaggggagggtctccaggtggatgaaaattgcactgtcaggaatttgtcttcctgggcagctgtgggcaagggtgggggcctggagacacaggttcaggctcagccccagcctctagcctatcatctgtgagccacatgcagggagagcttgtcctttggatgggaagtcattgtctgcttttagctttgtcccttcacaatgcctagtttagtgacggtttggacaatttcagcctggaccacccacagttaattgttgtggtctatgtgtgtgagagagacagagaaagagagagagagactggtgattgttaaagagacatagataggaagacagaaaagaaaagagaaaaaaatggagagaccaggagaccaagggataacctagctgtgaggaacagctcctttcttgccggtaaaacatcctaccttttattctggcttctgcataagtccaggatctcagttatgaaatgatgaatacattagccctgcttccagaatgtgggacttcctgcccctgttgccaacctgcttccagataggaatgaggacacatggagagaggcaggttggaaaagcacagcagctgcctgtcctccaaccccttctggtgttgctaagaagggttgcatggaaatgttccatctttttcatatttttatgggtttccaaatttcaaatgcaatgtctcccttccttcttccctctctccctttcttcctttaataagcctgcctatagagacctggcccctgccttcagggagcttacttcctcatgcacagatgtggcagagagctgggcccagcagtctccactcattgagcaggctgtactgcagtgatcagcaggtatcacaaaagcaccgaggacatccagcccagccagggcatggtggggtcagaggggttaggggtgctggttattgaagactacttggggctcagagctgttagaactgagctttgaagcattgatacaaaccctggtactaaagatgagataggaagttgcattttgggcagggtgaacagctggaggtgaacaaagtcatcatacctcctggagctcaagggctgaagtgtcaacgtgaggaaggagatgctggcaggggaggctggggaaggatacggggcctgctccgaaggacttaaatgccagactgagaggttttgactttatcatgcagggaataggcaggaaacggctcaaaacgacagtcttttagaagcatattcttaaaaccttcaaaaaataatgatggtatttaatccggaactactttgtgctactggttgcctgtgttttatggggcagcatttgcaattaggtgagagtgtctggttaatctttgaatgtttcattttgaggcattggccatatttcttaagagccagaaacctgtctttgggtggagcccaagttgtgcttaatggcttgctctaggatgtcgtcacagtttagacacttacttgaagaagagtagtaatgtgctttcaaccccttaatattcatgtagatttcagctcatattttttctaaggaatcagacgattatgtagttacccaatgcaggtgaatgcaccaaactccatggatgcagtaaagagccactcgctagatttatgggggatgtggagccattgctctgagaataaaatattcatgaaataaagatgagaactgcacaaatgggagacgacatgaggagtgagggatgagtcatccatcactgggctcagagtttggaattcttgttgctttctgccttgcctgccctcccctggcccggtttccatcgcacacaggagctggctgaggccagggtggccgggcagcaggggacagagaagcagatggcccctctgttctggctgtgggcagcctctgtctgcatgccccaacccactgtgaaagattagatcccaggggccctcacttcttcaactccacaccctttcttgcctccactcctttgatgtcttcttcaactgcatgtaaagagtttgccagtctgcacatttttcttcttcatttatgccaacccacagcgttgcactgaggattcaacaagggaaggcatataaagtgaattaaagatgtgcctggcccagagacacgcttggttgttggtggccaaggggctactctatccaaaggtcctgggctaggcaatgaggaatatgggagagacaagtgacaccttagggctcctttcctgtgctgagcaatcttgttagccctcttcagtagttgaagaaggcatccttatccctgatgaaatccctctcagaagtgagaagggtagagatgggatgtgaatgatgtgtctacctctgtacccctgctgcctcccaggcgcaagcttgtcaaaaggccagggcactgtcctttcctctgggtatgtgcatgagcccattgggttccgaggtagcattttccagaggacttgggartgaaggttgtgactcagtgctctacccagggccaggctcctggatcctggcttctggctacacatttacattatctgaacctcagtctctcccttctgctggaaacagcctggcctgagaactatgctcaggagcaaatggcttagcatgagagtaagaatagtgagtgtgcatgtttcagcccacggcctccagtgagaagccatggaacatttaccatacaccgctgtgtatctcaaaaccagatcacttggcaaagcctcccctgcttgctgccaccactagcagccccccttgctgggtatgctccacattgccagtaatggtttacctgcctgtctctgcttcagatccaccagtgcctcctcacctctgcattgccatcaatgtgccttctctctggaacagtggaagctcttattaaggggtgatgaatataattcaagtattgagcactttctatgtgccagggaccaagatagatgctttaccaagaacattagctcatctggtagtaggagctcaaacacgtttattgaatgaatgaactagtcaagactcccgtaaagaagacattactaatgttaaattgttgtgtaatcattgcacctggatcaatggcttttaattctggctgcatgtcagaggtgattaattctggggctttttagaaatacagatgcttgggccctgtttcccaaagggtcatattagggagatctggactgccataatttctaaaatctccacctgtgcttctgatatccagccaaggatgaaaaccactgatttatgccaacattccaaggtaaggagctacgggggtaatgaaatttgagtagaatgaagtctcactggtatggggaggatgaatttcttgacacactggtgtcatggaaaagagcccaggttttgggctgggtgtagtggcgcatgcctataatcccagcactttgggaagccaaggcagaattgcttgaagccaggagttggagaccagcttgggcaaaaaaagctagaccccagtctctacaatttttttttaattagccaggtgagatggtatgtgactgtagtccgagctactcaggaggctgaggcaagaggattgcttgagcccaggagttcaaggctgcagtgagccgagattgggccactgcactctagcctgggtgacagagggagaccctgtctcaaacaaacaaacaaaaaaaaaaaaaaaaggaaaaggaaagagcccaggtttgggaacctggtagatgtgagttctcgtcctgaccttccacttactgtggaattgcctgagcttcagcaagctgccttacccctagcctcagtcattcctcggtgcacctgctgctaccacccacgatgtgaagtcattgtcggttcrctctcattgccctccctaaaacatctgcgattgaactgatcagaactctttctcctgatgctttgaaaaactgcccaccatctcctgagaccatttcacttacgtacttgagctcctttgtccttacccagccaatactctcagacccctagcccggcccgttggggttgggtaagtcttgggaacaacactgaagattgtgttggtagcatttctcccagcccttgggtcccatttagcacctgattggtgtcagtggtaataggataatgccaccaacagccagctcagtcagggggaagttcctcatccccatttttgttcctgcccaacttacaataagagctgttggactccaagcaaagtctgttctaaggagtcccatgtgtaacaggctgttacaaagatgatagtttagttaattaccgttttccaatacactgtattatttccacattggtgaacagcagcttaattacagaactttatctctgcaagacaatgcctgggagaggttccccagtaacctctgttggtgcatctgtcgtcatgtttaatatgggatgagaaacgcagagctggaattcagccggattcacgggtaaacacagtctgtgaattttatatcatattcagggatgtttgactaggtcagttacctacagtaaattaatgaagatagcagtaagtttccaagtctgttttcacagctgtcattacctggccgaataccgaaaccttgggataatgaggatgtaaacggatgtagttcacataaaaaagcccattatttgaatttgcataacataatagaatgcagtattttgtctaaaagatagataattattcaaatcactcctgcctctttccttgagtaggctgattactcctgtctcctctttccttggctggagacacagaaggaacagacagacatgactttatgagtgctaaatctatgaccccaggtaatacaagcagaccatgcttccaaggtttccaaaccaggcggtctgtcctgcgcacctcagctctggctcccacagacagcagcaggagcaggcgacttaaaggacacattgtgagacacagcaaatggctgcgtttgttttccaggaaagataggagtcatttgctgcagttatacacattttcttattcagttaaataaccaaaataagagacttgagatggcaccctcatctcctagggtttgtcctcgtgttggagctattgggaattgatggaatttgagtagaatgaagtcccactgatgtgaagaggatggatttcttaataagcagttgggaaggaaaccccctggaacgtttgtccatttggtgtagacactttctgtgtgtcttgacacggagactttaaaggcgaatgataactgcagtagggagttggttcccgctgcgcagctttgcagtccttagaactgcttcatccatacttgatttgagacaagcaaaaaaaaatgtgagtaaaataaacttagtcaagctctttcttcagaaataatagactggcagagaactagttatctccacattcagtctgagggctggccttgattctaaatgctccattattaccggatccactccccaccaccgcgtttactattccagcttggcacttgacaatccaccatgctccagtgttctctcacttgcacttcagtggtgaagtcatccagctcagagacttccctcacttacatcttccttcagagaattttggctggtctgtcttccccgaagctcccatgtttgtttccctggcattaaatagagagagttctttcaccttgtcccttacttccaacctcctacctccctgtggctttcttcttggacaggaagttaatctttccctctctccaaactctaacaaaatgggagcatctcctgaacaccctgggctagtgctcarttgactgagaaaaaaggccaggccctctatcaactgccagaatccagagttgagcagccctggaacctagacacctgcttcccactttaattgagtccactcaaactttctttcttttcatcttcaaaggggtccttaaagtcctgaagggaaattagaaaagaggataagggaagattatgcaactgattaattactaactagttcttccaatggtcccaggtcatcagtttcccttccgtrgaaatgaaagtctttgacagtgagggtgaccagcttgttcaggcttctccaagctttgctagctgcaaagaagagagaaggttatcttattaaaccctaaaagtacctgaatttctytctcaactacttcagcttccagactccctggtacttgttttgtgcccttcatacattttgaaatgaacatgccttatagatacaaatattcgccaaaacgattgtagcactgattctggctaatacagatgacactgtatccacagtttaacaggagctcatagcagccccaagaatgctagagatgcaggcttgatgctgggcaagagtcagggcttgtctggaggcccagaacactaggaggatggctgtggaaaagaaagtttggcagagtcccactgctgcagcagatgaagcacctgctgctttctgtctctctgtctctttgttccggattcagcttcagtcttactgtccttatttggatcatggtcctgtctcttcgttaggtaacctgtctcttgatagtctgtcaaactgttatccggtggggatagtaactccctaaaagcaataaaccatagacttccttgggaaaagatcattgatgctgagtggcgctaagccactaacacactgtataacggttataaaatattcctaaagtagtcttacatgcaaaaatgaaaacaaagcaaataaaatagaatacacaaaaagtagcaaagttgaacagaactggctccaccatggtgtaaggtaattaggaaaataacttgaatttggtttgctctatattttacaaacctttgaaggagtcagcataaacatttcatgaataatttagctgggacaagtagaagcctggcattctccagccagttcccacaatttcccgacgacacttgccatgcagaggtgaccctaactcagagatggtctcccagcacgaatgagctgagctctgcttgtgtgggtgggcttcagatcactgragttgtgactgtgcctgtgaggctgtgccaatggtttctgatgtcattttcacctatgacagcgagccacatcccatagcatcctctattctcaaactagttggctgtcttgatttcctcctgccctggaatgacttgtcagttgtcctatgggtgttgtcagttttcttgtcctgggaaagattctaggactgacagcaggtgtctcatcagaagccaaaccatgtgtgccaaccatgaactcataaaggtgcggagagagcagtggtcccaccttctatatgccaggggacattgaggcaaggagtgaactgcagagcacttcacctccttgcttgaggaacactgagttgaccctttgtgggggttagccctgtgattcatgcactcatctggtcagggctcatgcctatcattcagttgaacttctgggggtggaaatcctctcccactgtccccacagaagctcaaagcagtcactggaatggctcttagattcatgtgattccttctttttccttctgaaggcatattcagggcttctacatttcttaatatttctaactcccctgcaaggtggacaggggatgggttcctttctccaatacaagatgccaacatgagaccacctgcagggtggcctgggagctgagctttgggactgtatttctctaggagtttgaggtgagggaaaggtcaccacattccctggcgcatcagcacccatgctgcttacaaagtccctgcagcctcaacctcaccgggaagctcatatggctcctctgctgagcaccaggtcctgtgcccacctcacagcggggaagccaaggaaggagatgacgtcttccttgagctttcaggcagtttgtctgcctttaattattctgacattgtagggaaatcatcaagttatttgaaaggaacaatatttgttctgttttgttttctttcttaagcaaataaacaagccaagtaatttcctgtgatatcacccactgtggtgagacagtatcaggtgtgagatcacccacttagatagccttgaaccctcatgaaaccaggagggtcagctgaccctggggaagtcccattcctcacaatctccacccaggaacccacgcccccttgcccttccagacagggatatgtccccctccttgggctgcctgaagagattgcacagggaggacacaggtcactgggtgaggcagggcttctctctggctccaggcctccaagctgcctctaacactgatggtcctgtgactctgatgaatcattgaaccttcctgagcctgagcctccttttgtgcaaggtggggatgatcatacaaagtcttttcatcatcttgaactctaagtggcaaattcatgggacaccttaggggctcaaggactatttcctttattcctgtgggacttcttctcctgtctctgcctgctcttgaaagcatcttgtcctaagggttggttctgggtatggcagtgactctaaactgagtacagaggcaaggcaggatgcagccaaggcctgttgatggcatcttctttgctacatagggatcatgtctcccccctggcttctccagataactgagggttggccatataattgaggggaggtgggagccacatgaaagggatactcgcccacagcccaacaggctgaccaggcctggtgactacagacatccagagctgtagcaagccagccttgactcactgttagggctccacctgaccttcctatgccttccctccaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaayaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaacyctcccttccasctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgcyccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgtgagagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataataaatcttgtctttgctccctatgctcttattctctggggtgaagaaatactgtctgcttgtttctgggcatgctgagatcatgaagtaaattctgtgctatcagcagggacagtcatgaggaaaactcctctcctcaagggggtctcagatatgcctggaggtgggggcaggccctcctcacccagtgcatatccagagttccctgaaaccaaccaggggacagtgtgagggacaggctgaggagcaagtctaatttttggttaacctaacagtgttctttaaaatattacgttcttggaagtgtcttaggagagaactgggtcatcatcatgcgtagagaagtgctcccatggcctggaggaatgaacacccctttaattgtcagctgactgtgctgccactctcatctctgcactcaccctgacctcagataagttgcttccctgtgcttaggtctcagagctaagggactgtcattcctggtggagcacagcttggctggacccccagcttggcttctcaaaatttggcccttacaggatctgtggagacctttctccaatgaacatcttatgccctcagtcatcctacaggcctcaagccatcaacctgatcttccacccccagatgtgtgtgcttttcagccgacctctgaaaaagtcccctggcttcagtgactttgtgggggacagccccgctgtcggcctcaagctcagtaaagctgatctgaggaggctgtctgacatgatcaaaatttcttcttctagaaaccaaaaggaggatgcccagccctagttcttctgccctgcaccaaggacaggcttctccacgttggggccactcctcagactggggctgaggggcgggcaacagacaccgctggattctgtgagcagatgggtggacaggagcagctgcagggaaccacaaagggctgttttcttaagaagaagctgcctagttcctaaatcagaaatcccccgaatagtgccaaggtaaaactaattccatacctaatgtttgtcttttcaagtactaaaggagaagcagacacattaaagaagaaaagaccagtggtcctaaaggccacgaggacatggagggacgcagtctatggcctgtgcgttttcatttaaaagtcattccatttaataatagatgatagaaatataaaaaattgaaatattaaacatattttaaatattattaaataacagagatgggcaaggtctaacggataactcaggtctctatgtgaccttctgctcccaaggtgaaggggtcacttaattgagtgcctccagcttcgttttcaggaaactttcactcccaaaagtatctgctcatgaattagcatctgtgtcttaactagagccttgttttgtactcctagccttggcaaaagtaaatgagataaaagctccagacaattttaactgacctttccttgctgtggacacaataaaagaggcagcatttctgttcctaatgtaacatttttgtatctaaaatattcttttatgccattagttgtttttaataaaactgtttattcttattatcctcacccttygtaccaagaaactgcacataaataaccctcttctatgccaataactttaatcattgtcttttttttttttttttttgtctctcagtggtggtatttagtcagaggagattacttatgagagaagtgaacctattccagataaatcaggtgagctaatagtcacctcctacaaaagaggaagggacaattgtctgtaatgtctgatcatccctcccctgccagyatttattgtctttattgtctcacctctgaacttgacattgagcactgagctcaaaagataatagaaattctgtctgcaggaaaaacaaaaaacaaaaaagatgggcacagaagtttacaatggccaatggctgggatctgcaagatagggcactagatagatctggattacttagggtgagcaaccaaatgtgacccaaggagagctcagttgctggcagattcaagtagacagttgccaggggctcaggggtgtccaaactcagaggaaaacaaaatattcaccaacatatggagacttgtacatctaaaataagtatacacagacacatatacacatatgtacatgttcatgcacaaacaccgaagtccatgcaaacacagtcaccatatcaggcacatgcatgtagagttttaaagcacatggcaatgcgcttgggtgacataagcaaatggagataggctcatcagaaacagaacccaggggagaaaagaggctgtttcagggcttccctgcccagtgcacagtctcaatacaacaatcagccaagcggtgctctgcaatcagctgccgaggagggaggagcacctcctgcaatgcggcctgctgtctgcaaagctgcctggtgtgctcaccaaaccctcctgtgtcatcagtcccttgctctaaaatcctgacttgcaaccagaatccctgaaatatgcaaagaagccccaagcattctccaaaacatcctgcttcctaataagaaaacccattatcatccgtatcagtgaccgtttcttgatcaggtgtgctgtttgagagactgtgctatacccctcacatacaaacactctcttattctcagatcagccatgcaaggtaaaaaaatattataaatagatttatagataggaaaactgaaactcaaaaagacatggttccaaagctggtgagagacagtgctgggattcactttcttgtctatctgagtccttagtgagtactcctgccagtacagctggctctccctcccagagagcatacccactgtgcctcagctgctgcacctgtgctgaccttccctgtcaccagcctatcaggtacctcagcctccacatctgctgccttctctccagtggcttcagggcagtcggtgagtatctgcttgtgcacccctgcagtggctgtaggtaggctgggctaacagggtcatttgtaaccacagagttgggctggatatctgctcccctgaagttgcctaagccaggcagggcatcagtctgtcaggcttactcagaagctgggctgttcctttatggatatctccttcctcccctagactccccaagaggcatatcctccttctgccgaaggtaaagtgtgcatcaagctaagggaaactctgagactaactagtgctctaaagagttttaggattctcccccgggcaggaattccttcaccaaagtcccttgatagacctcagaggtgcctgaaaacctccaaaaattatctgccaaattgcttgtgcatgtgtgtatgcatgtgtgtatgtgccttttttccaggaacctggttcatatcttccacatattcctaaaattctcgtataaaagctctaagccacttccgttaagagttgtgagtcaggcaagcctctgcatctcactcttccaaggtgagtgtttaggtgcaatcttattttgatgctcatctgaggtgaaaagcagaacagtagccgaggagggagtgtagaaaatgcattgcagatgggggcgttgtggctttgactaagaggaggtgggaaaatcccactggcagggcaccgtgggcaccatgagatacatgggcaacagggtagggctggtgacctgatcctggcacccaggaaagtgctcaagataagtcaaaggaaagaacactaaaactggccaggtctggactggattcctatgtctggccattattggaggtgacatcttgagcacattcctttttacttctttgagtctctctgtttcattcttatattagtgacaataatacctatatcttctatttggtgaaaattccatagttagtaatcataaaaaaaagctgcaattgggagttgcttcccacaacacagctttgcagtccttagaactgctttacccatccttaatttgaggcaagcaaaaaaaaaatgggtgaaataaacttattcaagctcttccttcagaaataatagactggcagggaattggctgtctccacactcagtccctgggctgatcttggttctaaatgctccagtattacctgatccactccccaccactgtgtttactattccagcttggcgcctgtgccctgccacttgacaatccaccaccctccagcatcctctcgcttgcacttcagtggtgaagtcgacctgctcagagacctccctcgctcacatcttccttcagaggattttggctggtctgtcttcccctgaagctctcatgcttgtttccctggcattaagtagagagggttcctttcaccttgcctcctgctttcaaccccttacctccctgtggctttcttggatgggaagggtcagtgccctgcctgggatatatccacatttcctctgttctcctaggcctagctccctgggcaaggggtgcagggagaagggattcgtgcaccttagatggagacaaatgctagacaaatgctatggcaataaaataagtgagacctgcttttgcattttggctctggactttacagttgtatgattttggatttgaagtgataagaatgaattcacagagctatatgtgtgattcatgattgctgaaatgatgttttcccagttcataagctcccctcttctgccagctgagcctcttgcagaacctatacagttcccaaagaccagagctggctcttgacaagcaaagccatgcttccttttgctttgtggcaaattactttttttcctgcaaaacagcatggcctagtgctgattcagtagatcagagtaggaaaagacagatctggcttaaaaatctgttctttgccactcactagatgggtatccttgatcctattaccaatgtctctgagccttctttctccccctcacctgtagaatggattctgagtcctgagctgttttgaagatcagtgataatgtgggtaaggtacctgcacaaacacactcttataaatagcagctcttgtgatttgcacacctacagcatcctgcctcttggtgtgaactgctcaggcttttagcttagtcacccatctcatttgtaacattcacgtacagaccacttccttccagcttgtcagctgagacagaggaaggaagcatttccattttcgtccctagaactggaatgcttgcattgggtctcactctcccactggaagctggctgtaacagcagccctcacttctgttcccgagaccctctcaggtaatcactctgattgttatcagaaagcaaatgaaaagcagcctggcttacctagagaggagtgatttgattgtgagaggctcagtcagtgccctctcagctcctgactttcagacatgctcatgatgaagtgcagccgaaaagaagcaaacttcagcgaaactagctctccaaagctggtggagatatctatgcatcctccagaatatagtttgagaggtaaggtttatggccatatagttcaaaaaacaaagaccttcagaggttcctggggtgatggccctgtgcttttcaggtagcatccaaccccttgtgttttatgggggaaataaatgcacacacctgaagcaatgagctgtgtatgtgctgggattattttacatctattccatcatgtctgcttttttttagcttctgcctctaccttaggcccgaagcccaaaggtagttgaatcttcttttgttggcaacttgtcatctggctaggctaagtaatctcacatagaaggtgcttgttgtattctagagaaaatgacccagtgagctgctatgtcagtaaggatcctgcatggtaagaaagagatggcacagggaaactgagaaatttggggagagagactatttggaaagatgtgcacaggcaaagcaaagtcacaaggagaactgatgattaatgagattgagccttttacacatgcttatgtgcatattgcttttgtgagctgtctcttttcttccatagtggagaagcctgagtgta

SEQ ID NO: 10627 - DNA, 184809 bp, Homo sapiens
  misc_feature (1)...(184809): n = A,T,C or G, or insertion/deletion polymorphism (see Tables 1-2)
cttgagcccaggaggcagaggttgcagtgagctgagatcatgccactgcactccagcctgggtgacagagtgagaccctgtttaaaaaaaaaaaaaaaaaaaagatcatgccactgcgctccagcctgggggatagagtgagaccttgtctcaaacaaacaaacaaacacacaaaagaaaatcttcagcaaaacacctatagtgatagagcacactcatgtagtggttatgcttgaaaactttatgatagattgcttgggtcccagtctcagctccagaacttacttctatgtgccgtagttagctcatctgcaaaatgaggctaatactagtatctacctcatgtggctatcttttttttttttttttgatggaatcttgctctgtcacccaggctggactgcagtggcgcgatctcggctcactgcaacctctgcctcctgggttcaagcaattctcttgcctcagcctcccgaatagctgggattacaggcacccaccaccacgcccggctaatttttttgtatttttagtagagaccgggtttcactgtgttggccaggctggtctcgaactcctgacctcgtgatctgcccgcctcagcctcccaaagtgctgggaatgtggctatctttaggagtaactgaaataatatattggatgcgctgaaaacagttcttggcacacagtgacagctgtacgattgctagccatcatttctatcatcataaattagtttaaaaggtaagagatctataggcatcgacaaaaaagatctctaagtacaatatatcactggaatattgttaaatgaagatgtaaaatgcaaacatgcaaatagtaatattccatttatatatatatcaatacaaagcaaagcatttctgcatgagaatgccacactttgctatgatgggcctgaaagtgggaacaagaaaatccagcttcatttggattaygcccatttgaggaaactgcgacttaagatgtttaaattaagtaactcactcaaggtcatactttgtatggagtaagttgtgattcaagttcaagtcagtttgcctgtacagtccatgatcaggcaggagaatgcaaaggaaaggagtgaggggtgtcaggcactgaaggagaggaaaactgggcaagtcttggaggcctttcaagaggtaatgggaaacaaggcatagctggggcctgagaaggagccaagtgccaaatggctcctggaaggtttactcagaagctgctgcaatggcctgagtggccagaaggaaggcagagcagtggtgacaggctggagaaatgcctgagcccagagaccagtcctgaccaagaagagcagtgcagggaggaaaggaggaagatgatgctccactttgggtgacagggtagatggtcagggatcaaccaaccgcaaacacagaggagaaagggtttggtggggaggcatggtgggggggtggtaatgcaagtgagttcagtgttgaacacattgagtttaatgtagcaagggacatccaggcagctgcaatacaataaaataagagaaaatacaaatctggagggagagcgaggttggaatcagaagtcactaacacaggcatatgaaaaggtgctcaacatcactgatcatcagagaaatgcaaatcaaaactacactgagatatcatctcactccagttaaaatggcttctatccaagaggcaggcaatcacaaatactggcgagaacgtggaaaaaaggcaacccttgtacactgttggtaggaatggaaattagtaaaatcataatggagaacagtttggagtttcctcaaaagagtaaaaattgaactaccatatgatccagtaatcccactgctgggtatataccccaaagaaaggaaatcagtacattgaagggataactgcacacccatgtttgttgcagcagtgtttacagtagctaaggtttggaagcaacctgagtgtctaacaacagatgaatggataaagcaaaagtagcacatagacacaagggagtacacaaaaaagaatgagggccaatgttgtctgtctgccaagacaacagaaacatgatcatttgcaacaacgtggatggaactgcagatcattacgttaagtgaaataagccaggcacagagacaaacatcacatgtcctcacttacttgtgggatctaaaaatcaaatcaattgaactcatggacatacaaagtagaaggatggttaccagaggctgggtaaaaaaaaaaaaaaaaaaaaaaaaaaaaaaaaaaaaaaaaatgaataagacctactatttgatagcacaatagggtgcctatagacaataataacttcattgtatattttacaataacttaaagaatgtaattgtattgtttgtaactcaaaggataaatgcttgaggggatggatacccctttctccaacgtgcttatttcatattgcatgcccgtatcaaaacatctcatataccccataaatatatacacctatgtacccacaaacattttattttatttatttatttatttttgagacggagactcactctgtcgcccaggctggagtgcagtagcgcgatctcggcacactgcaagctccgcctcccgggttcaagagaattctcctgcctcagcctcctgagtagctgggattacgtcaccatgcccagctaatttttgtatttttagtagagacgaggtttcaccatgttggtcaggctggtctcgaactcctgagctcatgatcctcctgcctcggcctcccaaagtgctgggattacaggcataagccactgcgcccggccccacaaaaactttaaaaaataattttaaaaaattaacaaaagaagtcactaacaataagaatgataattaatatctactgaacagactgtatcaggctctgttctacactctgtacatgcacggtctatgaacttatctaatcttcctaacaacactctgatgtaggccgattttatttcattaattttttttgccagagaacagatttaatacctaatgaagtaggccccttttattttatattttattttatgtatttatttttgagatagagtctcattctgtcactcaggctggagtgcagtggcacgatctcagctcactgcaacctccacctccagggttcaagcgattctcctgcttcagcctcctgagtagctgggattaccgtttctcgctctgttggccagactggagtgcagtggcgggatcccggctcactgcaagctccgccttccggtttcacgccattctcctgcctcagccaccaagtagctgggagtacaggagcccgccaccacgcccagctaattttttttttatttttagtggagacggggtttcaccgtgttagccaggatggtcttgttctcctgaccttgtgatccgcccgcctcggcctcccaaagtgctgggattacaggcgtgagccaccgcacccggctgacctaaaacttttaaagcctcactcagccccactcaagcttgctttctctagcatctagaacctagaaaagatcaaaacaaccgcttgcccagggcagcactaattggccgggtcatccrgtggttttattgctctgtaataaggttacctaagttctttcttgaattttattttattttatttatttatttatttttgagacaaagtttcactctgtcgcccaggctggagtgcagtggtgcagtcttggctcactgcaaccttcgcctccctggttcaaacaattctcgtgcctcagccttctgagtaactgggattacaggcgactgccaccatgcctggctaatttttgtctttttagtagagatggggtttcgccatgttggccagactggtctcgaactcctgacctcaggtgatccgcctgcctcggcctcccaaagtgctgggattacaggcttgagccactgcgcccggcctttactttaatcattacgcacaaggatttccatctgcctttttttttttttattattggagacagagtctcactctgttgccaggctggagtgcagtggygcaatctcggctcactgcaatctccgcctcccaggttcaaatgattcccctgcctcagcctcccaagtagctgggactacaggcgcgcgccaccatgcctggctaattttttgtattttagtagagacaggatttcaccattttggccaggatggtctctatctcctgacctcgtgatctgcctgccttggcctcccaaagtgctgggattacaggcgtgagccaccgtgtccggcctcctgtctgccttttatcttaccctatcactagtggctgcctgaagatctcagaacagcatctataggagatgcgcatccgatcctaggaaggatttctgatgctattttatctttagggacttgttactgggcttctgtctgccaagacaacagaaacgtggcctagcaaacaattccttttggttggaaggcagtctcgctaggggcatttgagggccttgcctaggacataggaccagcagtatttcacagctactacagaaaataccccagactttggcccataagatctcttgtattatactgcagatctaccaatggcactcagacccagaggcagatgcaatctccggttcgcgggttgggagcagttttgtggaacaaagacaccgtctagttctgacatggtacagggaggaaacacacagaggttaagacttagacaagaggccaggcgcggtggctcacgcctgtaatccctgcactttgggaggctgaggcgggaggatcacttgaggtcgggacttcgagaccagcctgaccaacatgaaggaaccccgtctctactaaaaatacaaaattaggccgggcgcggtggctcacgcctgtaatcccagcactttgggaggccgaggcgggtggatcacgaggtcaggagatcgagaccatcctggctaacacggtgaaacaccgtctccactaaaaaaaatacaaaaaattatccgggcgtggtggtgggcgcctgtagtcccagctactccggaggcttaggcaggagaatggcgtgagcccgggaggcggagcttgcagcgagccgagatcgagccactgcactccagcctgggcgacagagcgagactacgtctaaaaaacaaaacaaaacaaaattagcctggcgtggtggcgcccgcctgtaatccagttactcgggaagttgaggcaggagaatcgcttgaacccgggaggcggaggttgcggtgagccgagatcgcgccattgcattgcactccagcctgggcgacaagagcgaaacttcgtctcaaaaaacaaaacaaaacaaaacaaaacaaaacaaacttaagcaaggccaggtgcctgggtcgaggcagagctgaggcttatccgggcatcctctcacttagcagtctttcttccacaacacactgatccccgtgtttggcgtattgtggagagttgcagggcattcctttccctggacataaatttccacgtctaccggtgacatcaagtcacaagaggccagaacgcagttttcaagtcagaatcttagccagaaacgaagttggcctcttgccaaggagccaaataactggatggacgctcgcacccgcttcgcagacaggcgcacgcagtggagaggtgaagtgatttctgcgtttgggtagagcggcgtcggctttaggtgtccacggtgcggaagccagccgttttccaaaatgcaatacctctaatggtccctcacgaacagcagtccccaaatacagccgctcttggacctcgacgaaggggatgccactaacgctgtggggagagcgcacggtccccgccggcgcagggagccgggggtagagcagagggcgtcgcgtccccatcccagccccagcgcgggggctggagcagtcgagagggcggcctcccgccgcctagaggcgccggtccgctcgtccgctctgcctgtgccccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcagtgagtgtgacgctgggcaggggaggatgagccgtgccgccctgcctgggccccgagaaygggacggcggggtggagacccggggctcagggacagggagaccctcgggggcgtgacgggagcagggccacctggcggggggcttacggggatttcaaagagtggaatccctaggggtcgccctacgcggttaaccgacgtttcaagggattggagcccaaggggcttgtgggtgcgggacaggctttggctcctgggaggccttttgggagtctcgaacctgagggccaggcttgggggaaagggggagagggcgaggctggcgaatagggctggtcggcgagagtgagagaccgagggagaagtgctgggcctgggagccgaaaaggctgagtaggaggggagggatgtgggagctggaagtggggtgggaatagcggatgacccgaggcgggagcggggagatagtgggggatcttggggtgaaagaaagcgatctgacctcaaacagacgctcaggaattattaaatgaattaatgtgggtggatgaatggctgcagggaacagttggggagaggtaaattggcgggatgagagggagcagggattctagagaatcattgtaggaaaagagacggcaaatgaaaaggattcagagggccgggtgcgtggtggcttacgcctgtaatcccagcactttgggaggccgaggcgggcggagcacaaggtcaggagatcgagaccagcctgaccaacatggtgaaaccccgtctctactaaaaatacaaaaattagcggggtgtggtggcgcacacctgtagtcccagctactcgggaggctgaggcaggagaatcgcttgaacccgggaggcggaggttgcagtgagccgagatcgcgccactgcactccagcctggtgacagagcgtgactccgtctcaaaaaaagaagaaaagcgtccagagaaaatttaaacggagggctagaagactggaataggcagagacaaatagcacaggaaagagactgtgtgcctgcacacttgagaccagatgtgcttgtttcatcaagttttgaacttgggtcagggacttagggatacgtggacaaatgtctttgtgtttttttaggctaaaacttattgttgtgcatcagatattgtcctaaatgctttacatgtacagtataaacgtattctgcttgcccatgtatttccttcttttaactcaaggacgttaaaagattgaactatgtgtatttattaataacactagtgatgtttaaacctctgtcataaatagctctgtaatgtattagaaacatacatttaattcataatacagtttaattcaagagtcttgctttgcatttcattgtttacatagttgggatgctgtctatgagagagaactgcaaactttccgagaatatggagatacaggtgaaatctggtgagttaggaaaagaatcaagttataatctagaagattatatgtatatgtgtgtgtgtttaaaaaaatacgtatatattcgccgggcgcggtggcttacgcctgtaatcccagcactttgggaggccgaggcaggcagatcacgaggtcaggagatagagaccatcctggccgacatggtgaaaccctgtctctacgaaaattagacaaaaaattagccaggcatggtggcgcgcgcctgtagtcccagctacttgggaggccgaggcaggggaatcatttgaacctgggaggcggagattgcagtgagctgagatcgcgccactgcactccatcctgggcgacagagtgagactccatctcaaaaaaaaaaaatgcatatattcaagtgcttatacccaaagaaagcctaaaaatcctgggaaccctggattaagtctggctttagtgggtagatttaaagtatgtctcttcttttattcttttttaattttttactttttttttttttttagagaggtggggtgtcattctgtcatccaggctggagtacagtggcatgatcatcataactcgttacatcctggacctcctgggcccaggtgatcctcccgccacagcctcctgggtagctgggactatagctgcatgccatcatgcccagcaaattttcttttttgtagagacagggtctcactgtgttacccagggtggtctcgaactcctggcctcaagcagtcctcccaccgtggccttccaaagtgttgggagaatgggtgtgagccctcttttaatatctcacatttacgtttgatgacagcatttcaccctatagttgtcctttgtcaataaacaataaaattctgagacaccaacacatacaactgttaatgctgatatagagaaatgttagtaaataacatactgaccttgtctattctgttgtattcctggaggtggtttctcctaaattacagtagagacaaagctgaagcagtcacagatgttttcactttcaaataagagtttgagcatatggtataaatagcttaaatggaatatagtggtgacttttgctctgtatccctcagttatttgactgattctctctaacaggtttggagaagagagtatgaatcgactaataaggtggatgcagaaacacaagattccactggatgcttcagtgcttgatattggaactggaaatggtgttttcctggttgaacttgttggtacttttagtatttgtttgttaaagacaaattttaaaaggaaaatttttaaaggccctgcaattgaggatattaaccatctaaatataaaatagtaaagcagtcatacttggagaagtcagatagtacaaaagggaggctacatggattgtgagagaacctaggcaatctgagtcctagtcttgactcttttggctatagycttaaccttgagtaagccacttaatttttctaggcttctgttctttcctaagggttgtgactaggtgattgctattggtttcttgtagctcaaaactctagaaatgcwtatatatatatatatataaaatatatatatatatatataatwgatgaccttttgcaattccagtaggacatacgtatcttatcttataggtaagcatatggtttgaaaagygcattttgtccatggaactgtgtttcggtaaacattccactgctagctaaaccatcactgttgtatgcctgcagtgtgctcttgctatgctgtgtgctgtggaggaattataagacttaggcttcatcctagataattttacagtcttaattagtacagaaataaacataagagtgaaatttgttaagtaaccaccacatgccaagcctcatgtttggcattggcaacaggaaaatttagactttgtgcttgaattgtttacattacaatagagtatggactgacatatggacagttgtgccatcacttgatgcatgcagtaatacactgaatatagaaaagagggtgattaattttggagtggaggggtagggaagcatcttggaggagtaaatatccaagttgggtggaaatttcagggacagtttggtgacctagtggcgtgtaaagagggagaagatttcaactaatggaaatattatctaaaggcctgaaggctgaagcagtattttatgttctgggcctgtaaataatttgataaattgaaatacaaagtatacgtggggatggacagacatgaggattaagttaaagataggaaccatattatgctttgccatgcttaagaccttcgattttgcatttaggctatggggaattgttaaaatgtttttagtagtggaatatgattagaagaacttgaaataacccttcttgaaacattgagatatagtgtgtgtacattaaagtgcacaaatcagaagtatacagctaagtgaattatcagaaagtgaatacatccacataacaatcacctggtcaagatgtaaaatattatagaactctagaaattccccttgaactctctaccaattattactcctttcttcctttttttttttttcaggctttgtcacccaggtaggagtgcactggtgagatcatggcacattgtagcctcaacctctcaggctcaagcgatcctgtcgcctcatattttgattttttttgtagagacaaggtttcactatgttgcccaggctggccctccttcctttttaaaagtaaccactatctaccaatcatgaacaaaagatgagttttaacatcagattaatttgcctgtttttgaaggtataaatgaaactctttagggtgtgctattcctggtgtctttcaggcttttttttttttttttttttttttgagacagagtcttggctctgacacccaggctggagtgcagtctcacgatcttggctcactgcaaccttcaccacctgggttcaagtggttctcgtgcctcagcctcatgagtagctgggattacaggcgcacgccattatgcctcgctatgtagttcatttttattgccatataagattcctttgtggctgggcgctgtggctcatgcctgtaatcccagcgctttgggaggccaaggcaggtggatcacaaggtcaggagatcgagaccatcctggctaacacggtgaaaccccgtctctactaaaaatacaaaaagttagccgggagtggtggtgggcgcctatagtcccaggtactcgggaggctgaggcaggagaatggtgtgaacccgggaggtggagtttgcagtgagcggagatcagcctgggcgacagagtgagactccgtctcaaaaaaaaaaaaaaattcttttgtacaattatatcagtttcatttattctttctttacctgtataggttcttttgggttttaatagtttactggtagaggctaatgatttatactttgagattaatagcttgtagattattttcttttctttttctttcttttttttttgagatggagtttcactctgtagcccaggctagagtgcagtggtgcgatctcagctcactgcagcctctgcttcctgggttcaagcgattttcctgcctcagcctcctgagtagctaggattacaggcgtacaccatgcctggttaatttttgtatttgtagtagagatggggttctgctatgttggccagctgttctcraactcctgacctcaggtaatccatctgcctgcctcagcctcccggagtgctggtattataggtgtgagccactctgcctggcctgaacttcttttttttttttttgagacggagtctcactctgtcccccaggctggagtgcagtggsgcgatctcggctcactgcaagctccgcctcccggattcacgccattttcctgcctcagcctcctgagtagctgggattacaggcacccaccaccacgcctggctaattttttgtattttcagtagagacggggtttcactgtgttagctgggatggtctcgatctcctgacctcgtgatctgcccgtcttggcctcccaaagtgctgggattacaggtgtgagccaccacgcccggccctgaaattcttaattgaagtgtagtttatgtagaaaggtgagcataagtggtacaaaatgaaccccttgtgttattcaccaacctgaccaaaaaataagacatttctagtaccataggagcttccttgtggcccctcccactccttcccttctaaaggtgaccactgctgtcacttctatcatcatatagtaggctgtttttgatattaactgtagtagcttcttacggttttaatttgcatttctctaatgagtaatgaatgatgttgagcaccttttcaggtgcttgtttgccacttgtgtatctttttttttttttttttttttttgagacagagtctcgctctgttgcccaggctggagtgcagtggcatgacctcggctcactgcaacctccacctgcagggttcaagtgattctcctgcctcagcctcctgagtagatgggattacaggtgcgcgccagcacgcctggctaatttttttgtatttttagtagacatagcgtttcacyatgttggctaggctggtctcgaactcctgacctcaggtgatctacccaccttggcctcctgaagtgcttggattacaagcrtgagccaccacgcctggcctgtttatcttctttagtaaaatgtctcttcagatcttttgcccatttttaaattggattgtttacttattaagttttgacaatttttaacgtattctggatataagttcttcaccaggtacaagatttgcagatgttttcttctattctttggcttatcttttcattcacttaacagtatcttctgaagagcagttcttaattttgatgaagtccaattaattttttccttttttggatcatgcttttgttgtagtattaaaggactctgcctaacacagggtcacttagaacttcttctgtgtttttgtttaaagttttaacactttaccttttacattcttttttttttttttttttttttttgagacggagtcttgctctgtcacccaggctagagtgcagtggcatgatcttggctcactgcaacctctgtctcctggtttcaagtgattcttctgcctcagcctcccgagtagctggggctacaggagcgcaacaccacgcctggctaatttttgtatttttagtagagatgggctttcaccacattggccaggatggtctaaaatgcctgatctcgtgattttccccccttggctccccaaagtgctgggggtgcaggggtgagccaccgcgcccagcctaccttttacatttagacctttttttttttttttttaagatggaatcttgctctgtcttccaggctgtagtgcagtggtgtgatcttggttcacttcaacctctgcctttggggttcaaagaattctcctgcctcagcctcctgagtagctgagattataggtgtgtgtcaccatgcccygctaatttttgtatttttagtagagacagcgtttcaccatgttgtccaggctggtcttaaactcctgacctcaggtgatccacccatcttggcctcccaaagttctgggattacaggcgtgagccaccctgccctgcctatttttatgtttttaatttcattgagttctgttctttttttttttcttcctgattttactttgttcctttttttactttcttaaggtggaagcttaggttattgatttgagacttttctaatgaaattatttaatgctatgaatgctatgaatttatcagtaagcactgctgcatcccacaaattttgatatgttatattttaaaaaattgttctacacctcacttgaatttttttttaaattgttgatttgttgtatttttattcagtccaaaatattttctaatttttctaattttttttaatccacgagttatttagaaatttgtttaatttccatgtttttgggatttttctgttatgtttctggtacagatttatagtctaattcagttatagtcagataacatgccttatatgatttgtatgatttcaatccttttaaatttgttaaggtttgttttaagacccaagatacagtgtgtcttggggaatttttcatgtgaacttgaaaaatgtatgtattgccaggtgtggtggcttacacctgtaatcccagcattttgggagactgaggtgggcagatcacctgaggtcaggagtttaagaccagcctgaccaacatggagaaaccttgtctctactaaaaatataaaattggttgggcgtggtggtgcatgcctgtaatcccagctactcgggaggctgaagcaggagaatcacctgaacctgggaggcggaggttgcggtgagccgagattgcaccgttgcactccagcctgggcaactagagtgaaactctgtctcaaaataaaataaaataaaataatttagccaggtttggttggtggcaagtgcacctgtagtcccagctacttgggaggctgaagtgggaggatcacctgagcctgaggaggtcgaggctgcagtgagccatgattatgccaccgcactccagcctgggtgacagagtgagaccttatctccaaaaacaaaggaaaattcatatgtaagtttttgtgtgtacatatgttttcacttctcttgggtatttacttaggagtgaaattgctgggtcatacgccagttaagcatactcggtaagtttaaccttttaaggagctgctggaccattttccacagtggctgcaccattttaaatttccatcagcaatacatgagagtttaaatttctccatattcttggctgggcacagtggcttatgccggcaatcctagcactctgggaggccaaggccggtggatcacttgaggtcagcagtttgagaccaccctggccatcatggtgaaaccctgtcgctaccaaaagatacaaaaattagccagacgtggtggtgtttgcctgagtagtcacagctactcaggaggctgaggtgggagaattgcttgaacctgggaggtggaggttgcagtgagccgagatggccccactgcactccagcctgggagacagagtaagactctgtctcaaaaaaaaaaaaaaaaaaaaaggtttttccctatatcctcaccaatactttttattatctatcttttaaattatagccatcctagtggacatgatgttcagcccctttttgtttagtttttacatgttatattgttttccatccttttaacttaccttattattatatttgaagtgaatttcttgtagccagcatatagttggtagttatttttatctattctaacaatctctaacctttaactggtgtatttagaacatttatgttcaatgtgattattgatacgtttggatttagktctacattttattgttttcccttttttacctctgtttttttttttttgagacagagtttcactcatgttgcccaggctggagtgcaatggagggatcttggctcactgcaacctccacctcctgggttcaagtgattctcctgcctcagcctccctgagtagctgggattacaggtacccgccaccacacacggctactttttgtatttttagtacagacggggtttcgccctgttgtccaggctggtcttgaactcttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatcctcccgcctcggcctcccaaagtgctgggattacaggcgtgagccaccgcacccggccggtcttgaactcttgacctcaggtgatctgcccgcctcagcctccctttgtgctgggattacaggcttgagccactgtgcctggccttacctctgttttttattcttctctttttcctttcctgctggtgttggtttatttgaacatttgttagtatttcattttaatttatgtgtatcttcttgaatatatctctttgcgtatggctgttttagtggttgctttaagcagttgactgtgtcttttggtgtggcttttctagtggttcctgtgtagattacaatatatatagttgtcaaaatctccttggaatcagtattttaccactataagtggaatgtgaaaaccttatcatgttgggttcttgatctttcacctttatgttgtagttgtctttactattacctttatgttgaaaattccattagataatattatgatttttttcaaacattttaaggaatgcactaggagaagaatatttaattatattcacctagatatttatttcacctttgtattctggatctcctgagctttttttttttctttctgtctaagaaattcttcttggaaattattttagagagggttttcttgcaacaaattttttttgttttcctttacctgagaatagctttatttcaccttcattcctaaggagtgttttttttttttttttggctgaatatagaatcttttttttttttgagacacagtctcactctgtcacccaggctggagtgcagtggcacaatctcacaatctcggctcactgcaaccttcgcctcctgggttcaagcgattgattcttctgcctcagcctcccgagtagctgggattataggtgtccaccaccacacccggctactttttgtgtttttagtagagatggggtttcaccatgttggccgggctggtctcgaatttctgacctcggatgatctgcctgcctcagccttcaaaagtgctgggataacaggcgtgagccaccgcagccggcctgaatatagaattctgagctagccgtttctttcagtactttaaaaatgttatgggctgggcacggtggctcacgcctgtaatcccagcattttgggaggccgaggcgggcagatcacgaggtcgggagatcgagaccatcctggccaacatggtggacccccatctctactaaaatacaaaaaattagccgggcgtggtggcatgcccttgtagtcccagctactcaggagactgaggcaggggaatagcttgaacccgggaggcgggggttgcagtgagccaagatcgcgccactgcattccagcttggcagcagagcaagactccgtctcaaaaaaaaaaagttacgtcacttgtttttgacttccatgttttctcatgaggaatctgcagtcatttgaattgttgttttcctatgaatgcatcatttttctagatgcttttaagattttttttctttgtcttttgttttttgcagtttgcttatgatgtgtgctgtggcttggatttctttggcttatcctatttggtgttcactgaactttttacatctgtaagcttatgtcttttgccagatttgcgatatttctagcttttgttttttctattttttttttctgtattactgtctttctcctttcattttgggagtctatacacatgaaatgtcaatttttytgttgctccacaggtccccgtgaactccacaggttcaattttttaaaagtcatttttgtctttgtcggccaaatgttatatttcaattgatctgtcttcagattcactgactttttctctgtcaccttcattttgctgttaagtccacacattgcaattggctgacatgtcttaattttttaytgcatgatttctttatttaccattacgatttattttttgtaggaggtagttcatttgtctgaatggtttttcacaatgtgaattttctaattacatctctatagtatttaacatgttttctgtccctcgtgttgtctgtacgttggaaattagacctaaattaagggtcagcaaaccacagtctacgggtcaaatctggacctcctttgtttttataaatatttgttggaatacagccacatttattcatttgcatattgtctatggcagcttaagtgttgcattggtagagttgactggttgtaacagagactgtatggctggcaaagcctaaaatatttattctgtttctttttgttttttgagacagagtcttgctctgtcgcccaggctggagtgctggagtgcagtggcgtgtgatcttggctcactgtaagctctgcctcctgggttcacaccattcttttgcctcagcctcccgagtagctgggactacatgtgcccgccaccacgcctggctaattttttgtattttttagtagagacggggtttcactctgttagccaggatggtctcgatctcctgacctcaggatccacccaccttggcctccaagagtgctgggattacaggcgtgagccaccacgcctgactattctgtttctttttttttttttttttttttttgagatggagtctcgctctgtcgcccaggctggagtgcagtggtgcagtcttggctcactgcaagctccacctcccaggttcacaccattctcctgcctcagcctcctgagtagctgggactactggcacccgccaccacgtccggctaattttttgtatttttttagtagagacggggtttcactgtgttagccaggatggtctcgatctcctgacctcgtgatccacccgcctcggcctcccaaagtgctgggattacaggcgtgagccactgcgcccagccactattctgtttctttatagaaaatggttgctggctgggcatggtggctcacacctataatcccagcactttgggaggccaaggtggaaggtttgtttgagctcaagagtttgagaccagcctgggcaacatggtgaaaccccgtgtctactaaagacacagaaaaatagccaggtgtcgtggtgtgtccttgtaattccagttactcaggaggctgaggtgggagaatcgcttgagcctggggaggttgaggctgcagtgagctgtgatcacgctgttgcattccagtctgggtgacagaaggaaaccctgtttccataaaaaaaagaaaaagattgctgaccctggattgagagatttttattagatttttttttttggcaagtaaacttattaggtgttggtgtatatttgcatatgtggcgtagaatatttggtgtagaacattcatctttttgttatattaacagccattgaagaccatttcttatacgtactactttttcattgatcagctacatttttgatggttacttttcctacatttttgatggatgtttttgctatatcattttaggttactatttttcttttactatcttctggcttccattctttatcacttattgttagctataagccttatcatcatccttttaaaggtaatctgtcgccttgtatcccacatccctactccctggatgtttttgagatttttctgtttttctttttttttttttttggtacggagtctcacgccgtcacccaggctggagtgccatgtgccatctctgctcactgcaacctctgcttccggggttcaagtgattctcttgcctcagtctcccgagtagctgggattacaggcatgtgccaccacacctggctaatttttgtatttttagtagagacggggtttcaccatattggccaggctggtctcgaactcctgaccttaggtgatccgcctgccttggcctcccaaagtgctggtattacaggcataagccaccatgctgagctgatttttctgtttttgtttttcatcagatacactatgatgtgtctaggtggagtttgctttcatctgccttgaatttatactgtttcttgaatctgaggcttgggtcctttgtcactattggagtattcttagccatatgccattttttcttctgccctattctcatttcctttcctctcagattccacatatggattgggtatacatatatgtttgtgtgtatgtatgtgtgtgtgtgtgtgtatgtatagactgtgtgttaaaattgtctatacatacacactataacctccaactccggagctcactataacctccaactcctgggttcaagcgattctcctgcctcagcctcccaagtagctgggattacaggcacccgccaccacgcctggctaattttgtgtgtttagtagagatggggtttcaccatgttggccacgctggtctcgaacccctgtggatatagagggttgtgtgtgtgtgtatgtatatatagtcatacactacataacaatgtttcagttgaaatgtaccacatatacaatggtggtcctataagattataatactgtatttttaccctttctatgtacagatatctttagggctgggcacagtggctcatgcctgtaatcccagcactttgggaggccaaggcaggtggataacttgagctcaggagttcaagaccagcttgggcagcctggcgaaaccctgtctctacaaaaaaaaacaaaaaacaaaaaaacaaaaattaaccaggcatggtggtggcatgagcctatccagctacttgagaggctggggtgggaggattgattgagccaggaggcaaggctgcagtaagccatgattgtgctactgcactccagcctgacttacaagagtgagaccctgtctcaaaaaaaaaaaaaaaatctttaggtacacagataccatcgtgctacagttgcctccagtattcggtacagtaaaatgctgtacaggtgtgtagcctaggagtaataagccataccatgtagcctaagtgtgcagtgggctctaccatttaggtttttgtaagtacactccatggtgacacatgactgtgtgtgtgtatgtgttacatcttatattctgtgctatattctgtctttttttctttytttttttttttttgagtcagagttttgctcttgtagcccaggctggagtgcaatggcgcgatcttggctcactataacctccacctcctgggttcaagcaattctcctgcctcatcttcctgagtagctggaatttcaggtgcccaccaccatgcctagctaatttttgtatttttagtaaagaggggtttcaccgtgttggccaggctggtctcaaactcctgacctcaggtgatccacctgccttggcctcccaaaatgataggattacaagcttgagccaccatgcccggcccatattatgtctttgatattctttcctgtttttaattttccattcttttgtcattctgtgtataacagggatattttcttctgactgttctttgctgatttttttttattttttgctgtgtgtagtctgctatcaagcccacccttgaacttcctaattactgtatttttcaattatgttattttttattttattttttttgagacaagagtcttgttctgttgcccaggctggagtgcagtggcatgatctcggctcactgcaaactccacctcccgggttcaagcaattctcctgcctcagcctcccgagtagctgggattacaggcactcaccaccacaaaattagcctggctaatttttgtgtttttagtagagatggggtttcaccgtgttggccaggctggtcttgaactcctgacctcaggtggtctgcctgcctccgcctcccagagtgctaggattataggcgtgagccaccgtgtctggccctgtttgtttctctgttgtggttttcagttctctgctagaattctcccacttgtcattgtcatttctgtcagttgttttgaaatctttttctgaaaattcatttatttgggtctcctgtcgggtctgtttctaaagtcaatttctccccttgggtttggttgtttccttgaatgtctgctcatttttgggtgccagaaattgaatgtgaaagacattggagatagtttgaggccctgagtgatatctctagaaacctaaaacatctatttgtgatttttataagttgtactagaagaataaacaggcatgggaaaagaaggaaccggtaggccgaggtgggcggatcacgaggtcaggagatcaagaccatcctggctaacacggtgaaaccccatctctactaaaaatacaaaaacaaaattagctgggcgtggtggcgggcgcctgtagtcccagctacttgggaggctgaggtgggagaatggtgtgaacccgggaggcagagctttcagtgagccgagatcgtgccactgcattgcagcctgggcgacagagcgagactctgtctcaaaaaaaaaaaaagaaggaaccggtaagaatcagttaatagactcatcctgggttctaggtctcccagagaagcagttaagggaaatggggagaaaatctcaaggaataaggagggatacagctaaaagggtggaaggttggcatcaaaaaagagaatattagacctttagattaaaaacaaaaataaagggagcaatctacctgtagaaagtaattggtatacttgttccttgagtttagattaggaatcagttacttagggttaaaaagacttggtaggtcttcatggatttgatgtggcagtaggttaagttttaaaggaagtaaccatttagtaaatggtgaagagcaggaagggaatttcaggctatactgtactttgtaacttactttgtttttcatgtttcctttgaaattatttttagtctcattggtctaaaaatgtttagtgttgttagggggtgtgtaaagaccagaagcttccatgcttttgccatagacactacacagcctagatgggttaatggctagcaaacaccaaaactctcaagtccattgagttaaagaaacttcttggggatactgatacctgcccaccctacctcacaggttttctgtaaagatctaatgggatgtatgaaatatttttaaagacgtaaaagtagtatacaaatgtagaatggttaaaaatcacatggctggtggagaattgcataatgtataattacactgaagggaaaatttaaaaattgatagcttattacatttgcattgattttgttaatataatttaattgggttaagtaaaatatatgacaaatttatgtgtgaattggaaattatcagcatcaaaagttaatgttacctttttttgcctgagggcttatacatatattttcattatttttgagaacatgaatttccttttgaaaaagagataaaatattatgaaaacaaaggtattgtcatagtatatacactttcagtttttatttagagtctacaataaaatttaagcattatgaattggattatatgtcattttctctacatcaaaaataagacatcaccagtcctaaaggaatattataattcataaacaaaacattatattaaaattttatactaaagtataaaattatttctctctaggcaaaatttggtttctctaatattactggaattgattactctccttctgcaattcagctttctggaagtattatagaaaaagaaggtttatctaacattaagttaaaggtaactattatttatattactataatatttacaatagaggttaaatgtttctagagcatattaattgacaggttttaaactcataaattagggatcaatcataaataatacaaattgaaacatttttaaatagccatattaaaaatttaatctagttggtttggggaaattattttttcttctgtatgtttgttcatacactactgctcctgatgtttgcaaatacacataatacttaactatggattaaccagatcaaaagggttttcyttttttttttttttttttttttttttttgagactgagtctcgctcagttgcccaggctggagggctggagtgcggtggcgccatctcggcttactgcaagctccgcctcctgggttcatgccattctcctctctcagcctctgaagtagctgggactacaggcgcctgcagccacgcccagctaattttttgtatttttagtagagatggggtttcaccgkgttagccaggacggtctcgatctcctgatctcgtgatctgcccgcttcggcctcccagagtgctgggattacaggcgtgagccaccgcgccctgcccacatcaaaaggttttaaatgcatcaagtggtataatgtcaccaaaaatcatttagtttatttttgtgtcctatgatctgtgagatgatgattcctaaatttacatttctagcccaggcctctcttctcagctctagagttatagacaggcatgccctgtttttttggcttcccaaatggtatgttttttgacaaatcaaaggtttgtggcaagcctgttgagccccatctgttgacaccattttttcaacagcatgttctcactttgtatctgtgtgtcacattttggtaattgttgtaatatttcagagcttttcattattattttatctgttatggtgattcatgatcattgatctttgatattactattgtaattgttttggcgtgccatgaactgtgcccacgtaagatggtgagcttaattgataaatgtatgttctgtctgctctacctactggctggtctcctatcttcctccctcctcctcaagcctccttctttcttgggacacagcaatattgaaattaggccaattaaaaaccttacagtgggacaggcgcagtggctaatgcctgtaatcccaacactttaggaggctgaggtgggcagatcactttgaggtcaggagtttgggactagcctggccagcatggtgaaaccatatctccaccaaaagtacaaaaaatagccaggtgtggtggcgggcacctgtagtcccaactacactccagcctggacaacagagggagactgttttaaaaaaaaacagaggcaggaggattgcctgaacctggaaggtggaggttgcagtgagctaagattgtgccactgcactccagcctgggtgacggggagactgcgtctcaaaaaacaaaaataaaaaaacaaggataaaaaataaacaacccccacctcaacacagtggcctgtaagtgttcagttgaaaggtagagtcacacatctctcactctaaatcaaaagctagaaatgattaagcttagtgaggaaggcatgttgaaaaccgcgataggccaaaagctaggcctcttgtgacaaaatttagtcaagttgtgaatgcaaaacaaaatttctttaaggaaattaaaagtggtattccagtgaacacatgaatgatgagaaagtcaaacagccttattgctgttacggagaaagttttagtgctccagatagaagatcaaaccagccatagcattctctcaagccacagcctaatccagagcaaggccttgactcttttcaattctgtgaaggctgagagaggtmaagaagctgcagaagaaaagtttgaagctagcagtagttagttcatgagatttaagaacagaagccatcttggctggacacagtggctcacgcctgtaatcctagcactttgggaggccaaggtgggaggatcacctgaggccaggagtttaagaccagcctggccgacatgctgaaactgtctctactaaaaatacagaaagttagctgggcatggtggtgggtgtctgtaatcccagctacttgggaggctgaggtaggagaaccgcttgaacctgggaagcagaggttgcagtgagccaagatcgcgcaactgcactccagcctgggcaacagagcgagactccatctcaaaaaaaaaaaaaaaaaaaaaaaaaagaaaaagaaaagaagccatctccatgacataaaagtgcaagataaagcactaagtactgatgtagaaggtagaaggtgtagcaagttagctaggaaataaccagtgaagctggctaaacaacacacagatttccaatggagatgaaatagccttatattggaagaagatgccatgtaggagttacatagctagagaggagaagtcagtgcctggctttaaatcttcagaggagaggctgacattattgttagagggggctaatgcagctgatgactttaagttgaagccaatgcccatttcccattccgaaaatctgagggcccgtaagaattatgctagatcttctttgcatgagctctataaatggaacaacaaagcctggataacggcacatctgtttacagtatggtttactgagtattttaagcccatttttgagacctactgccccaaaagaaaaagactcaaagtattactgttcattgacaatgcatgaattcacccaagagctctgatggagatatataagaagattaatcttgtttttttttgagacggagtcttgttctatcacccaggctggagtgtagtgactcgatctcagctcactgcaagctctgcctcccaggttcatgccattctcctgcctcagcctcccaagtagctgggactacaggtgcctgccaccacacctggctaattttttgtatttttagtagagatggggtttcaccgtgttagccagggtggtctggatctcctgacctggtgatccgcctgccttggcctcccaaagtgctgggattacaggcgtgagccaccatgcccagccgattaatcttgtttttatgcctgttaacacaggatctgttctgtagcccgtgatggatcaaggagtaatttcgactttacagtcttaaatgtgttatttaagaaatgcatttcataaggctatggatgtcatagatagtgattcgtctgatgcatctgggcaaagtagattgaaaaccttctggaaatgggctgggcgcggtggctcacgcctgtaatcctagcatcttgggaggccaaggtgggcggatcacaaggtcaggagatcaagaccatcctggctaacatggtgaaaccccatctctactaaaaatacaaagaattagccaggtgtggtggcaggtgcctgtagtctcagctacttgggaggctgaggcaggagaatggcgtgaacctgggaggcggagcttgcagtgagctgagatctagccgctgcactccagcctgggcgacagagcaagactctgtctcaaaaaaaaaaaagaaaaaagaaaaccttctggaaatgattcaccattctgcctgtcgtgaagaacatttataattcatgggaggtcagaatatcaacattaacaggagtttggaagaagctgattccaaccttaatggatgacttggagagaggttcaagatttcaatggaggaattaactgcaaatacagtggtagtagcaaactagaattagaagtggagccagaaggtgtaactgagttgctacagtctcttgataaaacttgatcagataaggagttgcttcttatggtggacgaccagagaaagtggtttcttgagatggaatctactgtgaacattgttgaaaaaggattttgaatattccataaacttagttgataaagcagtagcaaggtttgagagcattgcctccaatatcgaaggatgttctgctgtgtgtaaaatgctatcaaacaatatcatgtactccagagaaatttttcataaaaggaagaatcagtcgatacggcaaactttattactgtcttattttaggaaattttcacagctaccccagccttcagcaaccactaccttgatcagtcagcaggcatccttattgaggcaaggccctccagccagagaaaagattatgacttactcatgatttcgatgatggcttgttagtgtttttttaacaataaagtattttttgtgggggatggagtcttgctctgtcacccaggctgaagtgcagtggtgtgatcttggctcacttgcaacttccgcctcctgggttcaagtgattgtcctgcctcagcctcccgagtagctgggactacaggcacccgccaccacacccagctaatttttgtatttttagtagagatggggtttcaccatattggccaggctggtcttgaactcctgaccttgtgatccacccgcctcggcccctcaaagtgctgggataacaggtgtgagctaccacgcccggccatttttgtatttttttagtagagacgagatttcatcatgttgaccagggtggtatcraactcttgatctcagatgatccctccaccttggcctcccaaagtgttgggattacaggcatgagccaccactcctggcctacaataaagtattttttaaggcacccaatttttttttttttttttttttttttgagatggagtttcgctcttgttgccctggctggaatgcaatggtgtgatctcggctcaccacaacctctgcctcccggtttcaagcgattctcctgcctcagcctccgagtagctgggattataggcatgtgccaccatgccyggctaatttttgtatttttagtagcgatggggtttcactatgttggtcaggctggtcttgaactcctgacctcaggtgatccacccaccttggcctcccaaagtgctgggattacaggtgcgagccaccatgcctggcaaggcacccattttttaaaaagacataatgctattgcacacttaatagactgtaatacagtgtaaacataacttctatatgcactgggaaaccaaaaattttgtgtgacttgcttcattgtggtgtttgctttgttgtgttggtctggaacagaacttgcaatatctctgagggatgcttgtaaaatctgcctgttcaaaacttccatttggaaagctaatagtctctcaacttaattagtccaaaatgaaactcttggtttcctcctcagacctgatttccccagtctttcccgtttctactaataacactcccatttaccctgttgcatttacacaaaacccaaggagtcatccttgattcttctttttccttaaagtcctatatccaattctgttcgttttatttatacacacatatatatatatatattttttttttttttttggagacagtgtcttgccctgtagcccaggctggagtgcggtggtgttattacagctcattgcagcctcaatctcctgggctcaagtgattcttccaccaaagcctccagagtagctgggactacaggcctgcttcaccacacctaatttttttgtagagatggggttttgtcatgttgcccaggctagtcttgaattcctggcctcaaacaatctgcctgcctctgctttccaaagtgctaggattacaggtatgagccactgcttctggccagttttatcttcaaaatatatcaagaatgtgatcatttcttgttatctcaattgctccctgtgaagtccgaaccaccattatttcttgtttaaactactacagtagcctttgattttgcccctccatttccactcatgctgctctgatgttcttttaccacagggcagccagagtgattttttctttgttattttttgagacggaggctttttctgttgcccaggctggagtgcagtggcaccatcctggctcactgcaacctcggcctcctgagttcaagcaattctcattcctcagcctcccaagtagctgggactacaggcatgcaccaccacacccagctaattttcttcgtatttttttagtagagatgggatttcagcacgtcgctcaggctggccttgaactcacgacctaaggtgatctgcctgcctcggcctcccaaagtgttgagattacaggtgtgagtcactgcgcccggcctaatttttgtatttttagtggagaccgggtttcamcatgttggtcaggctggtctcaaactcctgacctcaagagatccacctaccttggcctcccagagtgctgggattatgggcatgagccactgtgttcagccctggccagatttttaaaaatgtctgttcatgtcgcttccttgctcacaatcctgaactgacttccccattgcattgtaaatagattctgaacctcatccagccttacaaagtccctcatttcttaccttcttcctcgtttatcatcaatactcggtcacattggcttttcttctgttcctgaaacatgtcaagcttgttttgagtctgtatacttgctgccctctgcctagagtattcttgccccagatcttagcatgtttggttcattctcataattcagatctttgctcaaataacaccttagagaaaactttatttatttatttgtttttattttttgagatggagtttcactcttgttgcccaggctggagtgcaatggcgtgatctcggctcaccgcaacctccgtttcctgggttcaaacgattctcctgcctcagcctcccgaktagctgggattactggcatgcgccaccacgcccagctaatttttgtatttttagtagaggcggggtttgtccatgttggtcaggctggtctcgaactcctgacctcaggtgatctacccgtctcggcctcccaaagtgttgggattataggtgtgagccactatgcctggccaagaaaagtttctactcttttccaaactgtttctcttccaagtcacttaatgtcttatttctctggctttattttcttcatggcactttatctgaagttacttatttagcttatttatcttttatctttctctttgtagaatataaggtatattttctttcttttcttttcttttcttttttttttttttttgaggcagtgtctcgccctgtcgcctagacagtagtgcagtggtgcgatctctgctcactgcaacctcygcttcccagttcaagcaattctcctgcctcagcctcccaagtagctgggactacaggcacatgccaccacgcccggctaattttttgtatttttagtagagacagggtttcaccgtgttagccaggatggtcttgatctcctgacctcatgatccgtctgccttggcctccctaagtgttgggattacaggcgtgagccactgcrcccggccaatataaggtatgttttcatacagggaccttttctattttgtttactgtttttttttttktttttttttttaagatggagtctagctttgtttcccaggctggagtgcaatggcgtgatctcggctcactgcaagctctgcctcccgggttcacgccattctcctgcctcagcctgccgagtagctgggactacaggcgcccaccaccactcctggctaattttttgtatttttagtagagacaggatttcaccgtgttagccaggatggtcttgatctcctgacctcgtgatcctcctgccttggcctctcaaagtgctgggattacaggcgtgagccactgcgcctggctctgttttgtttactgttatatccagggtctgaaaagtacctgacaatagatgtccacaaaatatttgctgaatagatgagtatttttatataggcatttaggatgaggaagcctcttcaaagttagctcttcagagtgatagtcattattttgcttcaggtataatgaatactttggacatgaaggaagggagaagacccaccttccaatatacatcaacataatatatacatttttaagtcaatagagttttagattaaacatgatttacaattgctgtattaaatgtgtgtgaataattgtgagctaattgcctaattatttttttcaaaatgagttttcagaattttcattggtaaattgtgaatattttataaaattgaggcggattgctatttccgatgcttagtatgcatcaggttattaacagtgaatgagatggtgatgtatgacttcacacctccaactgaagtaattacagtttaacagttatttaatttcttaagccttatgccattcattatatccattagtaatttcgtaagctgcttagtcaagacccaagaaattcttttttttttttaaaggctggtcaagtgaagcagtgataatagagaaggaaggaataaatttgtaactggttttgatcgattagttgtaaacaccactgcactcagaccagccaaggcccaagaacttttgatctaccgtgtttattttaggttacacactaggaatataagttaaaaatcttattcccatagctgagtgctgtggccacatctacttaggaaggctgagatgggaggattgcttagctcaggttttcaagtctatcccgggcaacatagcaagactcctgtcttcaagaaatcttatttccagtgaacttagttccaaataaattgtcatttttaagaatatgtcraattttctactttttgacagaaacaggtttttcataaactaggcttgtgagctccataatgtgctggtattattagggaatatggctagctttgatttgtttccaaatttgtagagatttggaatgttcaggaaataccagtctctcttattaatcttggctttaatgatcttggactgaagctcataaaagttagctataaagttgaaaatatgtttattatatgtaaaatgccattataattaatgggtccttttattaataaccttttacaggttgtcacttacattctgtaaggattttgttttaattgttctcacatagacattgacttttaatataggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggtaagtgactatatggtgtttaaatgtgtgcttacctcaggtttcatgtacttaaataggttttctccccgttttgtgttatagtgttttacttttctatttgtgggaattgcctgcttttttctctgttaattaccttgacaataacttttgactgtatatgcaaagcacagagaaataacattggttgagatccagagatcttttaaaattttttctgagaaatcttggcagttaagtactaacatttatgagcctgtaaaaattaagttctcagcctgggcaatgtggcgaaaccctgtgtctgctaaaaatacaaaaaattagctgggattggtggcgcgtgcctgtagtcccagctacttaggagactgaggtgagaggatcgcataagcccaggaggcagaggttgcagtgagtcgagattgtgccactgcactccagcctgggtgacagagtgagacacatctaaacaaaaanagagaaaaacttaagttctctatttgagtcgtacaatcttttatttaaggtatataatctattatttatagaatcaaacaaaaagcacatatattgtgcttctggcttcagtgcactgatttactggcaaatccataataatgcaaatggaagaagtacttccgtcttacatgctgagagttttgatattatagatactttagctgtcttgcactagcggtcatttaggtcttcagagatgatagaacagttcttggtttcagaggatatagaacaattatttttaagattgcacggaattaaaatgtagggaattgatagaagattctagtgctgaggcaggatccttttttgcctagttagcaaagtgtaattagtgcagtatctacttagtggagatcttgtgagaactgagaatctgtaatctatacacaaaatattttgagttctctggcagactgttccttgcattttgtaagaaatattttatctgccagttttttatgtagtgcacaggcatttctgggaaagtatcttgagaatctacagatatttgcttgttttttcttagaatccttttcagattagtttktttttttttttttttgatcctgcactttttaaaggataggataaattttcaggatggagtcttgggtaaataatatggtactcaatatttggttaaattttgaacctcagttgtcacaagctaatggaaagtgaattacctcaagagaatagtttactgtgtaccattatttataaccgtactgcatataccttattttagagtttgttttctttttagtattaagggaacaggctgggagaacacttaatacatgtccttttgtgtgtgttcaatggctttgacagattatataatgtaaaacctgaagtgtttgaggcttgaaatatgagcttatggcttcattactattgcctctggaaaacaagaattatatgtgatttattgtcttttctttcatgccatttattttattatcttccatgttaaatttgtttcctttagaactgttgaggccctgtatcaataagtctttcctcttcctgaactttgacagttttaataaatgctcaaagttacactgtgtagggcaagtttctttcctggtttttaaatacaggtgttcttttttactcctagaaccagcagacaaaaacatatttgtctgtctttgataatgaggaacagactttagcctggttagagtacttaaaaatgtgtctttgtctgaaaactattaagtaaactatgttcaattttagaacaaaatacagaatttaagcaaaatattataatgggaaatgttatataaataattatatacaattgaaaacattttttaggcatgagtcccttagaaaatggtatttggagttagatatgggacagtaacagaatacactgccytgcgtcactgccaaaggtcttgttcctgactactcatactggctgccacattctctttgcataaaataaagcttgtttcaccaatcttttaaggttctttcttatttgaactataaatgttcataaaattgttgaaacagatcttgcattttttccatgatacccctgattgtacaaatactttgtgttataatttttttagtgagggttacctggaaccagttgcccatgttctaatttgatgtcgaagggacttgactttatgacagtgaatgaatgaaaacaataaccacccatcttacttcagaagcaatttaagggagtctttctgaatctattcaggtttggggagctatcctttaaaagaaaaagtaattcaaatttattatctaaataattgaaaaatatcaataacgtcaacacataagcatacagattaaaataattaagacaatttgtttaccatcagtggagtacaaccactattaatattttggtatattctattttgaaatataataactccaattctgtagggttagttcagggagttgaaaagttagtcctggaaaatttatacagacagaaaatttttattattaaatatccagagcatttgtaaaatttttgaaaacaaatatgggtgtataactatgnatgtatccaggacaatgcctgcattttccagcattaagaaacatcatattattttattaaaaggaatgtcataatttggaaaagttttcttacgataagcttttaataagcattataatattcggttattatgatttggtgaaattagataacatgaattaggatgtataatgaaatagtatgatagaccaattgatgcaataatataatttttatttctgtttttgaaacggtctgtctctctctctgttgcccaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagtaagtgaccttccagctttatttattttttaaaagcaaaataatataacattttatttcatagtttaggaaaacactacattaccttatttggatctttacaaaatcacagtgaatttgatggcgtggggtggcgcattggcgttagtagcttaaggctgggattagaggcctgagccattgcacccggccagtatacatcacttaaaacatttttttctgtttataagagttatttgagctcaaagcatgaaaatttagaaaaatacagaaccccacccctgcctcaagaaaaaaatattccaaaactaataggtccatcaatgagggaaaaccttgattggcgttttattttactttaattttaaaatttattttgagacagagtctggctctgttgcccaggctggagtgcagtgggataatctyggcttaccacagcctccatcatccaggcatctcccacttcagcctcccaagtagctgggactacaggcgcacaggcacaggccaccacaacggcttatttttgtatttttttagagatggggtttcgccatgttgccccggctggtcttgaatacctagccttaagtgatagaaagtgcatagaaatcaggatcatggtagaggtaacttgacagcctgtctcatttagtaagtrctgaagctgagacttcacctaggattttagattccaagttaattttttgaacctaggatttgaacctaggattttagackccaagttaattttttttaaaccatactgtgatgctttgaaagttactagttccttgtcttccaggccctttattagttcgtttagtttgagtcttcatctttgttataaattactgtttttaattctgctgaaatacacataacataccattttataaccatttttaagtgtatacttatgtggtattaagtacatttacatttttttgtgcaattgtcatcactacccttctccagaactttttcatcttctacaaattcatttatatttccaagttattttgcctttctgtattaagtgctttaatatgtgtggtgtgaattaattagattactacatatgaagcactcaaaataatgcctggcgcttagcaagaactcaacacagggccaggcgatgttgctcacgcctgtaatcctagcactttgggaggctgaggtgggtggatcacttgagatcaggcgttccagaccagcctggccaacatggcgaaaccctgtctctactaaaatatgaaaaattagccgggtgtggtggtgcataactgtaattctagctacttgggaggctgaagtgagaatcgcttgaactctggaggcagaggttgcagtgagctgagcttgtgccactgcactccagcctcggtgatggagtgagactccgtctcaaaaagcaaacaaacaaacaaaaaaactygacacatgctagctgcttcctacaaaccaggtgatagaggctaacagagatacagctttgcagagatgacaaacaggaagtggaggaaatgggaggtggatggaaagcctgttttttccaawttgtttttggtcttgtcttttccttgttaaattcaaagtgattttggaggagcatacatatgctgtacatacatagtagaattgaaaaatcatgaagtgaaattcagcacaatttagagtttggaatcatagttttacaaagggttcaatggtacagtgttaatgcatgcatataaatacatgtaagtatgagactcaattcttaataaaagtatttaaattttgtctgacaggatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatsaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttcttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgygtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataagtacaaattgtccttgaatgatttttttcccattgtagtagcactgaattttccttttttcttcatctgtggtacgcatgcaatcttctgggttttgtttttttgttttttttttgaagaaataagggagctaagtatatacaaaagacttttagtctttttatgaatcatgtgcttcagtggacttacttattttaaaatttctatgatactgtaatgtggtactgtatgttgacctcaattcacatttatccagagtataatagaaacctcaatttttaaggaacttatattagtagttaagtttcttatggccttgaaataattttcttcaaattggtatacaaagaaatagtgtatccctgctatgttaatgactttcgtctatgttcttttaagtaattttattttacgaattgtgtgtgtgtatgtgtgtgtgtctctgtctggtagcctacaatgaaaatctgtacaaatgtgaacagtttgtctccaggggagagccctggggtttgatttcctgtttttggctctgtaagctaacgtgtatgtgctcctggacagccctctgctttgagagtatgagaccaagtgtcttgtgttccacagtagtaacctctttagctaatgtcgtgtgtgtgtgtgtgtgtgtgtgtgtgtgtgtggagggagtgttgatgggctctgaaagaagtcttgtctcgtacatttcactgaatgaaggctgcccatgacctagagcttgattgtgggaggtgaagagcatatatggctgaaagacaattgcatagtggggaaaaaaattaggaaatccttacatttctcttggttaggcaggaaacagagatgtccatagaagaagagggagctcatcagcatgttttattaacagttaatggaagaaaattaatgctaatttattcttcatatacaccatgcaatttgttagaaaagtaaaagaatagtttgaaattctttggtcaattgatggattcctatgttcagggcatagaaatgaaactcaacatcaagcagacaaatacccaagcccacaggctacataaatgctgaataaaaccagctctacaatggaactctgaaaagcgacgggtaagaagcctaatgaatgattgaatatgaccttagcaaaatccctggagtgttgttgaacgatcattcatttccagcttagatgtcaagatgggctccagtaaccaggaaaaaagagagcttgagtcagtacttactgagttttaaaaatcttttgcaacacagtgtattagactgatcattaaaaggacttctctagctgaattttgagctgtcactatagtttaggcccagggaaataaacttaaaaagataggaataattcctaagacatgaatgtatcaatatcctatcctgcttttctggagtaggacttcaaaaactgaaatgtataggctggcagaatgtacttttgtcatgctgataccactgtaaaagagacttaaactaggagatcagttgagccctaaagtatttgcaaattacttgcctagcttgttagaagaagaaataaaaagccaaaatctacatttttgttttcaaaagaaatgatttctttgtttcctgaagagatgagaaaagataaattcttccatgttatatttttacgtacgtatttttattactgtactgtatcaacaaatgataagtattttaatgagtgatctttattgttcatagtagctggaagcatcttaagaaaagcaaatctaatacatctgttttcccaaatatgtaaaaatttacacatgttccagcaattagcatatcgtgtatatttctgagtagcttaggaaaaaatatgaaaacactctggttgaataaggggactgtgaactgtatttctcatttttcattaatatattacagatcaggcagcttatcattgatgatagcagaatcgaaatggcattgggatggctgtagttccccagctttgcctgccttactgctgcaaagaggagagaactgttgggaggaagaggctaaatgtagaagagtgtgggtgctgtcagttcacattttcctcctaacccttctgctaataggaaaatgtcaggcctttgttcccatctaattttagtacatcctggctaaaaaaatgttaggatgaaaaaatgttaggatgatttccaaccatggaactttgaggggtggggtaggggaaggaagaatggaggaaagcgcagtttatactccatatccgtctgcctttctgcaacagcagctagcccctactctgttgatttgggtaatgaaataaatttagatgcattgaagcagtgataattaggttttccttctatcttctcagtaagaagcctagttggtttctgaatggggaaagtcataatatggtatttaatgaaacatacctggcaaaattaaagagctgtacgcaagctttggaagaaaggcctgaaattgtgagtgcaaactacatgtggtgctatgtataaatagaacctttgagatgcatttgtatttcagggaagctgcttttatactgttattttgaatgagagtaatattttgatttttaagaatcagtcataagcaaggcacacaaggctgagctgtttatcccctctgtaaacccaacaggcctagagggaaagcccagattcagtgagagagccagttggatcaaacaattgataatatagtttgttcaagagataggacagaattattggctttgtagttgaaactaccaactgttgtggttgttatttaattaaaaagtaattaactgaattaaactaaaagggcaattctgaatactggagctcactacgaaataagctgtcttcccccagtattcagttagtgagctaaggtatcctgttggaatttgtatgatgaagacattatgtagcagaagtgagatcatttcattatttgcaatgaattaagcagattattttctgaacttgaaattcagwtgaatttattttggttcctttcattttataacagcaggtaatttgttaaaatctattaagcaatagaatagatgtcaaacaaatgatttttaaaaatatttaattttggagaaaaaatgattagacctagccaagttacttttcttttctggtcttcagtttttctctccataaaacaggggcacttagtgatatttaacattctgtatccttgttagctcatgttgccataataaaataccatgaacttggtggcttaaacaacagaaatttatttctagaaagttagttctggaggctggaattccaagatcatcgtgctggcaaggtatgttttattttaaggcctcttctctaggcttgtaggtggctgacatctatgtgtgtctgcatgacttctttgtgtgcaatggggttggaggagagagagcgcataagctctctggtgtctcttcttataaagagcactaaccccggccgggcatggtggctcacgtctgtaatcccagtactttgggaggccagggagggcagattaccataggtcagtagttcaaaccagcctggccaacatggtgaaaccccgtgtctactaaaaatacaaaaattagccgggcctggtggcacacacctgtaatcccagctactcgggaggctgaggcaggagaattgcttgaaccttggaggtggaggttgcagtgagccaagatacaccacggcactccagcctgggtgacagagcgagactccatctcaaaaaaaacaaacaaaaacaaagtaaagagcactaaccccatcctgagggcctcactctcatggcctcatctaaccctaattatttcacaaaggccctatctccaaatatcatcacattgsgggtagggggtcagggcttcaatatgtggattgtaggggaaaccagcatttagtccataatactcctgaaatcaattaaggcttagaaaaagccctacaaaataggcttctagaatagctgtcccttggtatgcacgagggatactgggaccacctgcttataaccaaatctatacataggtgagttttgcatcccaagaatattggattatccatctgagtttggttgaaaaaagccaagtataagtggacccgcatagttcaaacccatgttgttcaagggtcgactgtatagatggggagattaaataccccgtttgctaactctcagttgttaggtaacttgatggttcttttaaaccaaggtatctgtactcatatatacatatgtacataaaatatttgaagcagtcagatgagtattcaatctaaaaaaaacctttgtccatgttttcttaaactttgtatttgagtattgtcactgatatctatttgataagtttgtatacatttgagcaaagggtttttttttttttctttgagacagagtctcactctgtcgcccaggttggagtgcaatggcacaatcttggctcactgcaagctctgtctcccgggttcaagcgattctcctgcctcagcctcctgagtagctgggactacaggcgcctgccaccacccctggctaattttttgtatttttggtagagacggggtttcaccatgttagccaggatggtctcgatctcctgacctcgtgatccacccgcctcggcctcccaaagtgctgggattacaggcgtgagccaccgcgcctggcctattttttttttttttagataggttctctctctgtcacccagtcacccaggctggagtacagtggtgtgatcatgactcactgcagccttgacctcccaggcttaagtgatcctcctgtctcagcctccctagcagctggggctacaggtgcatgccaccatgtcaggccaattttcctattttttgtagagatggggtctcactatgttgcctaggctggtcttgaactcctgagctcaagtgatcctcctgcctcagcctctcagagtgttgagattaccaacgtgagctaccgtgcctggcctagagatatccaggaaatttaggaatttacatcttattgtttagtccacttccatttttatatatagagatcaagactgggccttaggaaaattgtgataatttgaggaatctccccaatatggttcttttttgacacaagacacaaactacacacagattacctaatttgccactctaagatgagtatagtatatgggtatagtatatgggtctgcccttctttttttttttttttttttttgagatggagtctygctctgtcgcccaggctggagtgcagtggcgcgatctcggctcactgcaagcttcgtctcctgggttcacgccattctcctgcctcagcctcctgagtagctgggactacaggtgcctgccaccatgcccggctactttttttgtatttttttttagtagagacggggtttcaccatgttagccaggatggtcttgatctcctgacctcgtgagccacccgcctcggcctcccaaagtgctgggattacaggcgtgagccaccgtgcccagcccttgcccttcttatatatagtatgctgtatatactacagtgtatatagtatatgggtctgcccttcttatacatagtatgctgtatatactacagtatatatagtatatgggtctgcccttcttatatatagtatgctgtatatactacagtatatatagtatatgagtctgcccttcttatgccctgtgtctctccaggctactgtcagtttgtctctgtaactgcttatttccccagtgaaacagaagtatgttaaaggtgatagcaaagtaccttctgtatagtaggtacttaaggttggtttcccttccctacatttctttgaaacagcttggagagagaagcagtggtttagaccctgcatattaggaatgtgaatattaagtgagaaatgtaaagcagcttagcgggattgctggcacacaccaaggctaaatcagtgttctttcctccaaggacccttcttcccatggagytaatatgtttaattgtttgagattttacccctcagtgccacagttttagtatattcagttccattgtaggcatttgtgttctaggagtgattaaatgagtgaagagaggcggagtgctagacaagtgagagggaaagtttaggtaggcctttcagaacttcttagaaatcatactgtgtagcttcttccttaatctctagctagcgctggtgctgaagcacttatttatttttttgacagaccaagtctcactgtattgcttggctggagtcagactcctggcctcaagcagtccttctgcctcaacgtcttaagtagctgggactcctgagcggtacactgtgctgggcttgaagtacttttttttttttttttcagtcatttaagaaatgaggatcacatattggccgggcgcggtggctcacgcctgtaatcccagcactttaggaggccgagacgggcgcatcacgaggtcaggagatcgagaccatcctggctaacatggtgaaaccctgtctctactaaaaatacaaaaaaatcagccaggggtggtggcaggcgcctgtagtcccagctaccgggaggctgaggcaggagaatggcatgaacccgggaggcggagcttgcagtgagctgagatagtgccactgcactccagcctgggcgactgagcgagaccccatctcaaaaaaaaaaaaaagaaatgaggaccagatattataatgccagattttcatgaaatgtcctttatgatgtgtcagcagagactaagaatacccctcggatttagatcgttacctgttttaagtggtaattttttttttttttttttttggagacagggtctcactatgtcacccaggttggagtagggtggtgcaatcatggctcattgcaacctcaacctcctgggctcaagtgatcctccaacctcagcctccatagtaggtgggaccacaggcacgtgccaccacacccagctattttttgtaatttttgtagagacaaggtttcgccatgttacccaggctggwctcgaactcctggcctcaagcagtcctcccgccttggcctcccaaagtgctgggattataggtgtgagccaccgcatccggccccagtaattattcactaagaaatgtgggtatggtgggggaaaatgtaaatgtgggtgcatttgaattgaaaccaaatggacaaggatatggtataccttccttcattaggtctgagtgccaaggcattattccaagtgatatcagacaaaggaaccaagagcatatccctgtaggatcatgcatcaggaagctggtagaactggatttaatgaaagtgttgaattggatttgggtcttggccatttaggaagcagtggcctgagattttataattgatttttactttgcatcatccagatttgatatccttgatcagtgattcaggtttatttcctttgctgtaagttaacagtgccattcacggtgacattttcgtttgatgttgagtaatactttagtttatctgatttgtccttagtttatactagaattgacagtgtagtgtgtaaaaagtatggtgaatcagttatttatgctactctagaaaacatttggtttggcccggctcggtggctcacacctgtaatcgtagcactttgggaggctgaggcgggcagattacttgagctcaggagttcaagatcagccttggcaacatggtgaaaccccatctctactaaaatacaaaaaattagccgggagtggcggcatgcacctgtagtcccagctactcaagaggccaaggcaggaggattgcttgaagccggaaggcggaggttgcagtgagctgagatcacgccactgcactccagcctgggtgacagagtgagactctgtctccaaaaaaaaccaaacaaacaaacaaaagaaaacatttggtttttcaggtttgtttatttctttaacctttttattggtggttatatgactatctcaatgtctagaatgcttagtatgactatagacatgttggccagagccatattgctttctctagttaatcctagagggctttagtcttttaaccattttaagaaagttctacagagttgaggtcaatatgatatgatgtacctctttaggacagaacagaatcaaagcttcagttctttatgttaggtagtttaagagtacagtggttgactaacctggttttgatcaaggtgtttttttttgctttttgtcccttgtaaaagttaagagaagctgtaactagtaattaaaatagtaagccagcttctcattcatgtcaattctttcatattataggtacagttaaacctatagctgcaggttacgcacatacaaaatcggcaaggctagtcttctcttagaacagtcatgggtatgaattcaaacaaaagatctttgcttttggttaatataatagattgacaaactgctgaggagagttaagaaattcacaggctagtatgtaggctaaatgttcttttcgtactgctcccaggaatgttctgccttttagaactagaggctgatttcttttcttganattttaaatccaaaggattcagcctttagattgggtttttaagctctgtgaaatcaccaactgtatctagttttagtttcctttctacctaatgaaaatgaaatttactcagtttcatttttagggggaaaggcaggagagcagtagctttgagcatatcactagggatgaattcaaaatcgatttttcttgaggcagtgacttatggcagatagttgacaagagaaaaattaagttttgagcttatatctcaaatactgaatgtgaattccactaaagaatatttaagaaaaaaagttgaaatggtttcatttaaagatggtaacataaacatttagcctggtctacagttgaaatattttctagattaaatgcaatttataatatagcaatatgaaaatactgtaatttgtttttagatatgtttttggtggggtaactgaagcaaactagggaactcaccatgttataatgataataattagcatctacttcatgtaagatcataaacagatgcttttgaaccttagtattaggataataaaataggcttaataagttttacttatgccatttactttgattgtagatagtgaaaagcctttcttacacttttttaaagctttttatttaccatacataaacttttaaatgtttgttattcatgcttgtgttttcttgtagcacataataccagtagttactattaactttgaaaaaaaaatatgaagttgaaataagttttaactgttgctctgttctttttagcttactttaccagaactcttccctccagtgagttgcaagcgtgacatttgctgtgttttcagcacctgccaacttggaaagcagggtttgtgttcaggacttaggctcacaacccatactttgtggtgcacaatgctggcccagctggcatgctttcgtacctcaatggtgctagacagtcagttacaaagctgtgtggcttcacatgcgctgatctcaatagtcactcctcttcaagctgctttcaactcttattttgtatcaaaggagtgggattggtattattaaactcattgctgaggttatttttcagtgaaaataaattgttttatttagttcttggatcaaagagtaattttgtcctcagcaaccaaatacctctttaaaaaggtgtgtgtgtatatatatgtatcattcatgtatgtatgtatgtatgtatatacacacatgcatgattccagccagagctataattcatttcttattttcatcagtggataaaaagaacagacaggaaagaacagagggattaatgtgtcatgtgatccctacatgctaatgtaggtagggttactagttgtagctggacaaagatgtgggaaaatttacagaacttttttttctgagtaagacgtgaaaattgcccccatgataggttcagattttttatttccatctgtaaccagaaacttcttatattttccaaagaagtatattttgctaacatatttccagtcacctatctttttgaaaatacttaaggtggacttggtgatrtctgtcttctcataatttattataagcaattttaaaaaggttctgcttttaaaaagatcttttcaaatgtagaaagaacagtgtgaaatgtgaatgactggcttttaatacaagggttgtgacaaagaggcagtggcttttggaagccaaataaaggggtgaatacacgtgcatctgcatactgctgttggatccagtgtataacgtttggcgtttgtttagttcacttgttagtctaaaaaggatagtatgttattctctcaaaccagtttataattttttagtggtaagctctttttacaaccatacctacagatagatttgatgggaaaaactgaacatttgctggtacttgttcaagcctcaaagctcagctctttgtttgaacgtcacatttatctggttctaaaggcataaaaataaaacacccactaactacctaagacactccttagtgcatatcaaaacccaacctttaccctcgtctgcacaaatgtgcttaggtgaatacttttattagcttgttgatacaagttatagtaggttacacccttaataaaacacacccttattgtcatcctgttgcttaagagctttaaacttgtaataggggagctctctaatatagaatgatactcaatttctatctcccaggcagttttgagtggaaatgtgttgcataccttacacacaagtgtgcctctatttggtagtcctcctttgggagaactaggattgctgtgttttatccctggctttcatatattttttgtttgtttgtttgtttgttttttgagatggagtctttttctgtcacccaggctggagtgcagtggtgcgatcttggctcactgcaacctctgcctctcaggttcaagcgattctcctgcctcatactcctgagtagctgggattacaggtgtctgccaccatgcctggctaatttttgtatttttaatagagatgaggtttcaccatgttggccaggctagtctcaaactcctgacctcaagtgatccgcccgccttgacctcctaaagtgctgggattacaggcgtgagccactgtgccgggccgtcatatattggtcttgatgtaaaagactgcaagtaatccctgcattttatatttcccagggtgttctccggcttaatcaggttagcgttggttggtgataatggaaaagttacaagtaatagtttttagattatttatggatttattcctaaattggcctatgaatttgcatttaggtgtctggttgtgtgcaaaatctggttttgaccattttggattgaacaaagatagacagtttagctccatgtccccaccccattgcagcttttacatagctttaaatctagagttctacatttttagctactcttctgaattgagcagaactctaatataacaacaaccttttgggtagaattttttcttagtaaagaactatggagctgagcactaagaagtgaggatgttttataatatagctgtaggattattatatcatgtgggaagaacctatagtatggaaggttaagtgtgacacaggtcttaatgtatgcatatctttttagcctttggagatacaaatctagaaaatgagaagtaactatttattggttaatagcataacttcttaagcaagtatattctagacagcctcaagaaagcctcagaaccagaaaaacaggctgctttaggttggaaaggaggtgttacagcagaggaactggccatgaccaccatccttggaatgtgaaacgcaaatcatcctgaaagcaacaagaataatggttgtaataattgtttccaggcctgggaccctgcatcttgttttttaagttgacctgatgaactagtaattgtaggaataaactgaatgtttgccagcaggagtcactctaggcttcctaataaaacgttagtaaattaaactctgtccttaaagctctgaaaggctgaggtgattgtgtgatatcagatggctttagggaaacactgactcttttcgttaagcatagcagcattcttagattattccttgggccttcttttgttcaccatcggttcttggatcttgttcctttcaagattggtccttaatgcatttttaaaaagcaacgtatatgggtaaggatatcaatatcttagtatgctgtattctgtatgttagctcattttggctttctaggatgaactgactctatcccacatcatgtaacttgaaatgaatagactcatatcctttccactgattgctgtccattctaatcatgcagcagaactcagtggagcgagctgtagtgtgaaaggagatgtcagttcatgcttttctgaaaagaatgggtccggtgtgatgatattctgaaatatttcagcaatagccatgaaatataatagtttcccaagcacacaaagctcaagaagttaattgttcatttatgtttgatactgggattgaaacattggattaaaaccaattaaatgttcctagaagcaacagaaaaagtttccttatttatgaatagaaccattcaaatggcgcagacacaatccatgtaaagtaatgaggtgttttgtttttttggcaaaggagaacacaaaacaggcatagggagttttaaaaaaacttctctttaaaaatcgctttttggatacaaggtcaataaaataacatacaccagtaggaaggagtaatgsgaaatctagggcttcacaaggaaaacaatccccctcccccaggtgagcagcacaatgaaaatactctgcttattctatcagggttacattcctgaacttaagtcaacatcctaagttacagaactaaacatgctctgcctctgcttagcaaccacaaatccttccttcgccagttgcatgtattttggatgtggcttctgaagtacacagtcacagcgccccgagttaggaaatttgcgctttattttcccaaagtgtgacaacactttaaggtcccccctccccgaccccacccgcccgctgtcctgcacgccactgaagtgatcgtttcttttgaacctcggcatctaacaacccggaagctggacgcctgaagcctatgcggcccagcgttttcatcccggctcgtgctgggggcggggagagaagcccgtagggcctctggcgcggggcccgggcagccgcggtggcgcggcccaggcccggggccacttcccgcgtcccggggcctcgcaggcgcgagcgcggcgagcggcgcgcggctgagcccgcaggacgccctctagccccgccggcggcgcgccgcgagtccctcactccccgcccatcggcggctgcgcgcactgcacactcgcctgccgccgccgccgcacgccgcctgcctcctgcacgccgccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacagtaagcgacccggggccgggcggcggcggcggtggccggggggctggccccgagcgaggtccgggccgtgtgcgtcccggccgctggctggagggagcccggctcgcgtgcgcaatgggcttgccttttttttttcttttttcctaatgttgctggtttcctttttttctgccttgtttcgcctttgggttgggtcgggcggtttctccgggcgctcggtctcgcccctgatgcaggcgtgagacttgtcagagcacaggcatggggaagaacaagcctggctgcggcggaaaagtctgcgctccccaggccagggcgggcgggcgcggggactgctgcgcccgggggtgtcctctccgcgtctcaacttgagccctgactagccgctgcggaggaggcgcggagtctcgggagccgggcggccccattcgccccgaagttcccgcatcgtttgcagacaactcttttgttcgcggaagtttgcacccgccacccccggggtgcgggagcgaggcggcgggctccgctgctgctggactgtccggggcggtcaggatgggggtgagggggcattctgtcccgggcgggggaagcccgcggggaggccaccgctggggcttgcggagtgggggcgtccgcgccggcgtggcttttgcacatggcgagaagggccgtccggcacaggcacactggtcgagtcacatttttgctagtcttggattttgcaagcccgtgggagtcaggttccccgctcagggtttctcttggggcagagacgaaagaaacgaggacacccagaatccggggagggtttgcggtttgtgttgtcccaagtgtgttctcgctccccccgcccccccaccttgtcccccagcccccagctctccacccccattttcggacttggggaacaatgcttgtagtacgggccggggcgccgcagcagcgacgaaccgcgcggacaggtttgcccgggtccctcgcgttcggacgccccctgaagccgagctccttccatctgaccgcccgggctcattaacacgtactgtacttaggacgatggtgaacaaagaaaagctctttgcagcgtttgatgaatgggattctgcctcctataggccacactccgagtcttccatacggtacaatctccggactcggtggtgttaggaaagtggcccccggaatggcttgcattccgggtctgggatcctggggtgggcatttgtgccgtcgccttcgccgccgcgctcgccttgcaggagcgggtgcagatggagccaggctgacggttgttcaasaggaacaaatgtttgttcaattgttggatggtggagaaaagggactgtttcctattgactgctgcaggagttggaatggcattgtttattggcctgggaagccaggcaagcgtcttgtgctgcttacaacatattagcagacttccaaatgacatgctagcatatgtgttcccagcagtccccaccggctggcagggagattcctccttgctccagatcctggactcgtttaaaagatgccacctggtttgaggacttgggaaggaatggagtcagccgaccaggtgaaactcactgttccttattaggccaggtttttgtttcattttaatttatctatttaagagtaacttgtgtcagttacagttttgatattgaattgcaggtctacagggtcccctcccccgcctctagctgtggactacagaaacagctacttgtcccagttgatagtcccattcagtgggagaaggtttggctcaggattggtagcccttgactctgtgtctgcacttggctgtcacccatcatgcgacctgggagtctgccgatccagcttccaggygctttttcaggttaaaaagctaaggagaggcgtggggaaggcctgtatttttttcttccaaacgttccttcagagaacgaggcgatttaaattcaaataatgttgcccaacgacttcctattttcttctgagaaggtgagattcatgtgcagtcattttgatatcaaagacaagtttttaaatagaaactagcaacctcactgctgcagaagtggacttgaatgttccagtcttctcaggacaaagtagagagcattccactgtcttggttcataatgttttaaatcagtttccctcttctcttttcaacgtggggtatgttgcacatagcattttgaaagtacgcaaagttcttttggaaagagctttatgataccttattgtcaccgtggtggttacgcttaattgacattttatgggaagtcctggtattatttcctgggctctttctgtttccatcttttagtctttctctttccccttatatattctctcactgccccgctagcctctccatcctctctacagaagcctagtgggcttgggttcctttaagcgggtccagtgagcaggcgcctgacccttgattgaagctcaggaagggccagcctgctctcctccccttttggaggccagagaggagagagctgtgtttaaatattaggagctggcagcaggggacgctgcggagctcttttaaaaagcacactcttctcacccaccgctcgatgccttgggccctgaagactgagttctgggcccaccttcagattgttcagttgatgttttatttgggcagcgtgactttctgcagttaaattgcgcattgtatggaaaactcttctgttcttgtccttaaataaaaagactgaaataagcaaatactcagatcggcacaacccccatcattaccaccaccacgcacacctctctgatgtgtaataaaagaaacctgcaggcataatttgttatgtaatatgctgataatacaagtttcggttttcgatggaaaccagatgtggagggactctctttaattgatccagcaaggggaagactaatagatgaactagtccttgcaaaccccagtggtgttttgatttaactttaggggagaatcccgagctcagggctttggagaggtttttaccctcagcttctgctttgctgcagctgtcctttttgtcagactcttcctcttttgaaagaaccggttcgttgccaacacaaagcacatggccggagctggcggggctcagcgaagcttagctctgctggactctcctcctccttgcctcgtccggctgctaccctcccctccacgccacaaaacagggtctggccaggggacttgggtgctgggaggagtgttgattgttctccctcaactccttrctgaaatgtcagtctgatcatccagggagagtttctgtttaaacttgtccaacggatacactttccaaaaatcattgactctctttctctgattaatttgtttgtttcctgcctaagtttgagggttttttctggatggctgagtcacctttattatggctcaaggttggggacggcactgtaatagctgaccccattaacagcagtttcattgcctgcctggatgtgaactttggaaacaaacccagaggcttagatatgctgatgtaccctgagacttgcttagaaaatttttgttgtagcgcagtttacattaacatgattaatgactgcgccactgaaaagtccatattcaaaagcaatttaccgttccctagggttcttcttacagtgaagtatttttctttgccaaacaactttgttttaaggtaacttctttgatgcttaatccaaacctcctgtgcacagcgttttggggcaagatttgggcttcgtgtattgcgggttgtggttttggtggtgcctgtcttaacctcaccgaacttaggtcagggagaactcggattcttatctaagaaagttctctgagatcctgagcaacagagtgctgtgctggctaggatgggaggaaatcttccagaggaaacttggcttctgggtgtcttggagtgatgcgaggaggctggagctgaagattttattttctttcccctyacagtgattggagatacttgagcttttctgaaaaatagagacgtccttgggtttttcttgtcgttttttttgtttgtttgtttttttgttaaatgtgggttgattgagagggggaaatgctgatgggtggatctgaaagcagccttaggaacccgagaaaataaaaacacgtttgaaggactctggaagattttgcatttcaaagggtctaccttgtagaatttcacatcacgtcaggggttacagaggagtgtgacaggcacccccgctttaatggttctccgtctctcctgctgtgggggctgcacggggaagctggcttttgcatgggggatgggggacagcttggccagaccacgctggactatcatggagaccacattgcctcttgggcatctgtaagtctcgggaaggacttttttcacggtgccastctcaggagggtgaaagcaaatcatgttsgtaaacagcccatttgacctcagaacgcagtggcaggctaactcctgacttctccactcactctttttgttctcttgttaaacaaagaaacagattcttcccctgcgctagtataatatgattcccaaggatttagctgaaatgggtgcagattgttcaaagaataatggcagcacccactggttgttgaaggcccaccctgggccctgggctttgtatacactctctaattctcaaagcaaacctgcagttacagctgaggctcagagaggccaagtaactggcccaaggccacatagccggaaggcagaaagccaggaaggagctctattccttcagagcctggttgctttccatatgccctgctgtgtgttcatatgatagaggcactgggttctgttttatctcaaagcagaaattttgtttagtcttgttaacaccacagagaaacctagaacttttaactgccttttcccctcctctcccctctgctatggctgtgtgtttttttgttttttgtttttttttttttgttttttggagtgattggaatctgtatgtactgtaggaccaaaggcagtgagtgccatagtttgggaggctgagatgttttgcttcaatctcagaaaaggcagattcacaagaaaacatttccagtgaccttctgggggaaacaggaagtaaacctggcagcccactggaaacaccaccatttattcagattccattttccattcagagagattcttaaaagtgtttccaacttttttttctttttgcatttgtaattcagatgtctcaaagtaaattatgatgtggtggttgccactccaggtctgtacaatatcatattttgtttacgtgcctaaagtaatcaagtaactgaacacaattgtatatcctccagtgtgactgaacttggtacgccccagccagggctgggcagcggccctgcattctgtctcagacagatggttctttgcaggttgcttctcgggggggtgtgagtgtgcgtgtgttttgaaggaagaataaggagacccatctctagcaaggcctgcctggccaggcatgctgtcctttctgcccctgaagagtttgtaggagmgtgctggggcccctgtgctctgaacttctagaagctagagtaaagtaatggttctgaatattggctgcacattagagtcacctgggaaggttggaaaaaaaaaaaaatccagatgcccaggctgcattcaggcccaattacatcacaatcttggagaggggggcagcaacccarcattggtatctttaaagttcctgagtcgattctcttgtgcatccaagactgaggagtgagggctgtaatagaccccatgcatacctacgggtcggttccttagtttccctattccttagcaggagattgggggctttcgtattcgggagcggagcaaacctattggcatttgctgctgctgctgctgctctgtcttggtgaagtggcatctgaagggcacccatccctaggggaagtgtctgctgtgggcatcatcgaggtcatttctgtttctgctgggccaagattcagcacagtccctttgaaccaccttctttccagattgaagggggcagattttactcaggctgtggtttcagggcagttctcatgcaggccctgcctccccacygtcctagtggtcttgttctttctggggatttggcataccgtgtgcccctggggctcaggggaggaaagatgcagttaggttccagggcatatcctggcaactcccagtgagtggtgagtctttttcacccaggtttgcagtgaatgtcactctgtcagctcagagcctgtcttcctgtgaacatactcaggattacatttcatagaattgtgtttagaatggccagggggcttggagagtgagagcttcttgggcctgctgatgtaaccttctggaagagaagtccgatccttaagaggtgaggtgactctcccagggtcgcgtagccagttgtcaaaggtgcagactctgtctcctgagtccctgccctactgctgtgttctcatgacgtggaaccttaattcctgcttgcaagacagcctgctttagcgtagaccagcaggtgaacttgatcattgctcacagagttcattagccaagtkaaacatgctacccatcccccgtccccaccccccagtcccaatggaaggtgctgaaaccttgtaaaggtgagcttgctgaaaaaggttttggcctctttgccaaaagtgtgtcagtctgccyggctgtgttgtggtggtggtgagtagtgaataagggctcttccccctgtggggagttgggtttgggccgagtgaagggagaagaggagaattgctatttttctcagggctgcaatttccacattcatttagcagacattgattggacatctgctgggtgtccagtgtggagccgggcactttgcttcattagttcatttaatcctcagcacaacctgtggctcagggactagcccgatttcattgctgaagacatgctgcctgcagaaatcactcaccccaggttgggatttgaacttggcccagctgacctcagccctgtattctttstaccacaccctgctgcttttccatccagtgctcaccaggggaggagagttcctgctgtaagacacgtgcattgcccagtgggcgttccctggcaactcctgcctgggtgccatgctgcagcttctaggagggggcgtgggtgggccctcgagctcctggatagctgggtttgtacaggtcctgtctggggccgctgtgtgtcctggcagctggactgtgccttgtgcaggagaggcggcttatgcaggttccagttgctgctgcctgcccccaccccgtggaggccaccctccctcccaggctgccctctggctgaagcctgaagcaccctgacagacaaagcccagctgggagaggcctcggccctgcctggaattccccttgctctggcattggccttggccatgggcctgggagcagagggaggttctgtccgctggctgggagcagcttctctgcatgtttggaagtggaaagactaagttctctgcagctgggtgtctccatgatctgggtgaggagaaggagcctggctcctgagcccgggggaaaagaggtctgtggttttgagtctccagaaggagtgcaggatgcggggaagcccctctgtggcatgatcctggggaccgggccgtaggaaccgctctcccctgtaatccctttggcagtcaaacgattcagtttcctggctggaaggtagtgggcacagactgcctacttgctggacctaatttgccctgtaaccctcactgggcctctgatttctcaccttgctggtcctgcctcccagcgtttttaggaagatcagtttagagcttgtttgagaagccccttgcaatgggcgtagtgccttgcagagcagtgccaggtaggagatgagtgtgactgggcaggcaggggttctgctgcaaagcccatggtcggctgcatgccacctaggtgcttcttgtggctgcaggaagaatgggactgtttggcgtcacagaggaactttgggcagagtctaggtgaaacccaattctgtatcatcgagggcaaaagtagcattcagctttggaatcagaagcctgggttcaaatcctaggtctgccctttgcccgccatgccatgtgcctttgagcaggcgactgtctctctggcccccattccttcttctggagtatggcagtgctgacagcacccccagccagcccataggttcggggccctgagtgagaccacacctgaggacacttagagcccaccagacattagtgagtatctcacgcagcctgtggcaagcgcgtgctgttgcgaggactgaagggaggctggaaggacatgagtcaggcaggttgccctgaggaggtcagtcagtgatgacaagatacaggacagagcagaggggacttcaactggarttgggcttggctggacgggtcaggctggggcggatagagccttttctcctccagcatcttcctctctcagatagcgtagggtttttttcgggaggaaaagttgaaagtatgcattacagtttagtttgcagtgtgtctgttaccaagagttgagactggtgaaatctaagttttctctctaggaaacgaaatctttttttaccaaaagtgatttacttttgctcctaagcatagaacgttaaatgcatgtatgggtcatgatgtggcctcaccgtcttggctctgctgccaccgacacttctgtgaatgaattctttggaaaccaaggaattaatggctgcatacctacctagactgagagtgaggggcccacttaccaccttctggattctctttaggtgctttgcagtgggcatctttgttttttgttnttcctctcacgttgggggagctgccttggacacctggagtcagcgtcttccgggtgcgggttatgtggttgcagctggagcgcctgcccccagctcggcctgcggtgtgattccggctgcttctagatccctttgccacctgaacctgacctcagtctgcaggagcaagagctcatctaagcttgctgaagctttgaaaggagcccttggcttggaggacagagggaagggtccaggctgtgccgcttggcttctgttggtgcaggcctctgactcctgacacgcctattccctgggtctggtgagcatcgcgcctcatgagtctggggctggctggcatcctgtggggtgaacaggatggacagtcttgactcatgagatttcctgctgcactttgggtagctttgagggacacccctttgtatggagtgtgaagactcatgctgttcactaggttctgggagggggccctgactccagactgtgacagcccctcccctctggtgctggccctagagcgtcctttccagaggacccaccaaggtggctgggcatgggtggccttgaagcagacctgctaggacaatgagatcctgaagctttgtgagcgagggctgcataagggaggtctctgaggtgtctcggctgcctctggtctcatggatgtgacagaactcatctgccaggtggagcgtgtcatcctcacccactgtgtcctccttgggtgtgtcactgttcctgtgatgagcacaaaacatacctgccatggtggtggcccccaggctcagtgcagttcaatcaatgtggagtaacagctactatgtgtgtcagacaagtcgtcaggccctgaggaattcagagatggatctaccgaatgtctgattttagggagctcatagctcgtattatggacagtcagactgcaggtttttattgaggttctactatgtgctagacacagtgtaataaatgaatgaaagtgtgtttacacaaggtactggtgagttacaccgtcctctggaagtcatagaaagtctctctaactgagctgaagagaggagggcagggaaggcttcctggagggggtgacagctgacctgagtcttgaagaatgagcaggagtttagacagatgaagaacggggaggaggagacattcgagaccaggagagcaggtgtccccagtcacagcaccatgggactgtgtcagggaatctgggagacctggagcctgagtgagacgagtgtagatttcagaggggagcggagctgatctaggtcaggatggcagtaaagggaagggcgaagggctgggagaaagcccaccttcggggtgacactgcccaggggcccagccttttgaccttggagtgaccttcctggagaagcatgagactagcctctgagaattttcatcaagtgccgccttggccagagtgatgtggtctttgtttatttttagacaaaactctcgcatttagcaggcgcccttgggattcccaagagcttccagaacttcttgtctgtgctgcgctggaactaaagaagtcaaagttctggcgttgtgtgagttgaaacagtctgattcagtgtaaaactaccttttttttttctttaaagggaaaaacaggcacctaaccgtgttggtgcgatggaagagggagcttcggtgccccctgggctctgtcatagcctgttctcactagtgttctcaaaggcagggggaagctgctgacacagacactcgagaatggcgggcctgagtcacctgactcttggcggccagtgcgcctgaggcctccaccgccctcagatgccagcccagattccaggccccgttgactgtgtggcatgtgacctgggcccagaagaggagaattaagaaaaatactgaacctgtgcagaggtggaggcggaactgcagttagcagcccatcttagctttggggggtgtgttttccaaggctggtagggttttgctcatctgcatttactcctaagggaagaagaaagtgagtaagttagccacagatggttttgattttaacagtaaacctctctgttcatctcattcccggggaggttagcacatgccttcacctgttagaaaagaaagtaaaagaggatctggcctggctgcgtccgcataggccaaaagttgagcagcaaactggagtgaaagagcgttatgaccagaagtaggagcagagaggagatcagacaccttgggctcaggagagtacgtgatagtccacaggtaaatgagttctaacttgctttggggaaaaaaagatttttttttttttttgtgatggagtctcactctgtcacccaggctggagtgcagcagtggcgtgatctctgctcagtgcaacctcagcctcccaagtagctgggactatgggcgtgtgccactatgcccagctaatttttgtatttttagtagagacggggtttcaccatgttggccagactggtcttgaactccggacctcaggtgatgcccccgcctgggcctcccaaagtgctgggattacaggtgtgagccactgcccctggccaaaaaacaatttttaaaagcatgtgtgaggttcaggtgagtccttatatgttacacatgatttcaggaagtcattgttctgagacatggcgtggtggcgtgctcctctgccatggaggagcgtggccagggtggtgtccgtctgctcacctgaggagctccctgggtctgccagcttcctgcctggccaagcccttcccctgcacttgtaagacgacgactgagcgtggctgatcctgcccggtttctgggtggatagtggaacctgggggaaccagggtagaatcccttatgggaggcagccattggcctggccaggctttgggcgctgttggagacagggctgaatttttagccctgagtgtaggcacaggcgagagctggagcccaggcacttgttccctgtgtggctggctgctcatctctgatttagctttggctcaatttttgtcctaccccctgattgctactggagccagcatggtggtcacagccactggtgtcttagggccctggaagagaagacagcaatcccaggttgccctctcctctgctcagggctgatcctggcagacatggaggaggagataggcaggaggagatagggagaagacttgggagggagctgggtcttcatgccaaatgcaggaagaaacaagccatcgttcagttcatgtttgagctgcgtcagcccatgtgaaggcccccacacctctgggaagaactgcagggagcatctctctggtccccgtctccaaggtcggggaagcattttacagttttggaggtgatgcggggaagggccacagccaaaacttcatgtggcagtctagcatgccacacctcactggaatcccgcacgctagaagggagccgccttgtgagaggtgttccagtgaagtggaaccccaccagtaggtggtgggatgggctccagaacagtgtctggaacaggaactagtagagctcaacgtcttagattccttaaaaaaaaaaaaaaaggttgattttgtgtgtcttaataatttcctttataaatggagcctcttatagtacaaggcagtacagatgagcccagacagttgggcagaatgttgggtagggctgatgtcagttagaaaagcctgagagaagaaagagtagggcacagaaccagtgaaaaggatccctgggttctagtgctgccacttgatggcttttgacttcggttcagccacttcacttctctgagctgtgattttctcatctgtggactgggaataatagtgcctacttaacagagcaggaggaataaacaggatagtgcragtccaagcacccagttctttcccgttttcattcacccaacaagtactttttgaatgccactgtgcgttaggcttcgccgttaattcatataaccacsctgagaagtgagtgctgttattattccctttttatagatgaagaatatagggttctgtgaggtaaagtgcccaaggtcatttagctcatgggcagtagttctggcgtttgaactcccaactttaggattggcaaactatagcctggtgactaaatctggcccactgcctacatttgtaaataaagttttattgggacacagccacatccgtttgtgtaggtaatgtctgtggctaccttcacaccacagcagcagaatttatagaccacagggtctacaaagcctaaaatatttattgcctggccctttacagaaaaaaaaatgtgctgacctcttctccacatgaatactctgcactycggacctgggctgttcagtatgttagctgtagcctcatgtggcaatttaaattaaatctaaatgaaacgaagacttcagttctttggttgcactagccacgtgtcacatgcttaatagctgcatgcggtggtcacctctcacgttggacagcacagacccagaacgttgctgtcattgcagagtgttccatcaggtaggagcacacgagactgtgtcccagtgtggggagnatccaaatctgggagaaccaaaagtgcagaggaggtattctgctgaaagaaaagacactggaccttcctgctcccaaaacacagaattgaaaattagtttgttgactctgaagtgatggagaaatgtctgctgtggcagagggaacctgggcctggagtgaagaggctgtccctaaatcctatgaccattggcaggcccccaccatgcccctctgcagcctgtaacctcagctcctggttcactggggccgttggcctcatcaactctgccatgtccagtgccccatgtgtgtttgcatgctgggtcctgcagaaatcccatttttatgtattcatacctgttctgttctgggccatttgggcctgatggrttataccattgttcctaccatgctggaatgggaaatacatggtctgatgaaatgaccatgttttccatgggcatcagataaagaactacttcattcattcaaaatgatggctactgtgtggcatgaggaaggaaggtgagttccaggtacctcagctagctagtatcacgtgacttactccttaaaatgctgtccactgccaacactgatgccgtgtgttgagtagcttggaattgggctgaactgtagctcttgtcttgcttggtccataaatgctctgaataggaatctctttggaagctaactaggggcagagtcattctgaggggtgaaggcaaatatggagggcgtagatctccagttcatcagacccaggcataaatgcatcagtgctggacccatctcccccacatttgtgcatgctgatagactctgagtgtggagaagagctgtgtggctggttgtagtccacgctgtctacattggagtctctgaaatgcattgtacagtcaggagtccagtccattgctcctgttaggaatggctggcttttccatgtttggtttacatggttacagtctgcacaaatcttcacaccttaaacaatgcccactccctctgtaatcaggatggaaacctttataaaatgcaagaatgacataccaggaggacttttcaggaccttgggcaagagtgaaaaaagaagaaaaccagataagtaagcctgatgaacttagctctagaatagttgcatgaaggaagtgcctggtaaggaggaagttgtgtttaagaggtcgtacgtggaaaattttttccccacatgctttaaaagggaaaagaatagccttgaaaggccagccttgattaygtgtccccctcccatcccactgccacctttgacactgtgcttgcctctagccagccactcctggaatggtgtcctgtgtcttccttcttcagccagtggaggggtgagatcattcgagattaggctctgccctaagtttctcactgctgtcccagccctcagggagactaattgcatgtgcccaaaagaacccgggcacaaatacctttataatggaaattatctgtttttagagtgctggcgttttctgagcacctactgtgtgccaagcactctgcatatgttctctcatcgtctgctcattgcacagccagctgggggtgactagccccgctgggcaggagctgagcttcagccatgtccctgagagagtgtggcttgtgatgggctagagcctggcttgaaaatccaggtccctctgctccaaagccagtttctcctcaccacctagttttgtccccaattgtgcacatgttgctgtttcaaagagaaatctcttgctcctctgcatgggttccctgatgacatttttatcactgcctgtgggcagagaagtaggttgctcactgtggggtgacatttaagaaaaccaactccatcaagctttccctttgaatgtgttgttatggtacaagaagtcttcgtttgtcctgggctattttgaaataaaaggcaggaaactcccctcttgtttctatatcttgcatagaagtcatcaaaacagaatcctctgttctgtgcggtagtcgtgattgaggaagcagctgttctcttcatgatgacccaaccaaagccagcagtctggaggcgtcagggatccagaattgtctcttccatctgctgggtttacttgcgtgtgttagaagtatttggcatggaaactctttccctaccccacctcgtgggcgaggccagaagggagctctcctggtgggggcagggcagaccccaggctctgctgtacttcagataatgccacggtttcctccatagaatgggtgccacagcctcccatggggccaggctgagtgaacgaaccagatcaactgtctctccaagtccatgggtgggaaggcaggcctctcctgtctgtgattgggagttgtatgggtctgctttgttgtgcatggaatttcacacagtctgagctgtctaggcattttcaggcctccagctaactcaccgagtgagccagggagtggtgccgatgagaatgtgtgactggatcgcgaagccaagcgagtccatggagatcttcaaaccaagatgaaacttagtcgtttgagtgttttcaggggtctgaatcgtcagcatcatttagactggagtttgcactctggtggtctgggtctgggggccagatgtggtcctcagacatgatttgtttgtctcatatgatgctttacaagtttttaaatttcttgggaacataaaaaggagattgtgcaaagaagtcctgactttcagtttctcttaacaagtcaggaggtaaattttaatagtagcctggatcttctttcccaaacagcccaccacagttagctgtagccagagccgtccacggtgggccaggcatgttctctgcacatcatctcggttcctatgcagcatgcttctctcatttgtgtttcctgcttggccctggaaggcatttgagtttgagatccctggagtggataagacattgggaaggcagattcagattttctggctctccaggttattggcacagggagaacgatggtgaatggcagtgactagtagaaatgcccaggatgtttgcagtgctcaaggtcattgccatcataatcctgctacctcgtgttccacctgctagtaaacttgcaaagataagccagtactccgggcactaataaaaactctgaaagtacaaatatgtcccttaaatcttggaagctagtctcaggccaggggcccttctaccctgtgaatggccctgtgatactgggtgacctggggattcattttgtacccccgcaccccccccccccacaatcactcaggtgcttcacctagtgtaatcttcttatctacaagtgccttcctgaggctgaggcaggcagatcgcttgagcccaggagtttgagaccagcctrgtcaacgtagagaaaacccatctctactaaaaatacaaaaattagccgggtgttatggcatgcacctgtggtcccagcaactgggaggctgagacgggaggatcgcttgagcctgggaggcggacgttgcagtgagccaagatcgtgccactgcactccagcctgggtgacagagtgagaccctgtctccaaatataaataagtaactaaataaataaaaagtgccttctggattttaatagatattgcaagggaatttttacaaataaagatgtaatttttaaattctcatgacaggcagcctagctgctgtgtaccaagtagataacttctggtgttagacggaaatttcttagggtagatgaaacatgtatctcagctctttcttttgacagagactcaatacagcaagtagaagtaaagcaaagatttgccagatggtaattagtatttttcaaagaattgaggtgttctcttcgtatttcttcaaatatctaatagcaatccctcctatcatttatctttttcactcaaccctgtttttatctcttcgtatggcagctgttctgtgactttttgtttccttctgattctcacacgtatttcaccgcatagtcaacctttgggattcttagtgtcattccaaatggtttgctgaatttgagaaatgtagcttgtcaatccattgcctgaaagcccttcccatgcctttcctttgcagcagaaacatggcatcctcatctgcctctttctcacctactggtcagggcattgtgcacctgggtggttggttcagcctctgattctgctaggccaaggctctgacgatgccactgttctccttcagtgcattctagggactgttggagctcctgaaggccaaggatcatcttgacctagatttagatttccagggcctggccagaggacatgctgggggtgggtagtaggccacccatccaattctgacctcatggcttttgcaagaaactcaacttttatggatcctgattttctcatgtgcaaaattgtcctcccagttactagggttctaggtaccaaatccactaaaaatgtgtttttcaaactttaggaaccaccggactcaacctggagggcttactagacacagctgctgggtcccaccctcatgcagtttgtctggggtcggggactgaaactttgccttcctaatgagttctcaggcaattctctactgatccgggtccacgcttggagaaccagtgcacattgctgaagcaggtgccaggtaccccagtgttccccccagcaaggatgtgggttggcctgtgtgggtcttggctgcctggcatatgaggctygtctttcctttcattttcccactgcatcttattttctgggaaacttgagactagattcccggagatgttttgttttccgttcagccatcttcatggaagctgtcctcacactctcaccgtgatagttggagacacatttatttcctacctttaggtaattctatcactaacacacaccatccactgtccatctcggtttccaccctccacctggaacccagatactaacggaggcagccttggcgattttgagttttgagcttttggtttcccagataggttgattttacccgttctcaccaaagacaggccgcatttgggtcgagctgacagagctgtcatggacacagcaggttaccctgtactcgggaatgcttcatgaagcttcccactcactgccgtcagtccaaggctgggcgccctttgtttcaggtgccctgaaatcagtgtctccgtgcagtggtgggaaatagagtgcttaaccatgtccagaatcaactgctgtaccctttctttcccttccctgatgacacctgagcccagccggggctgctggaggtgagagaccctgggacccatctggggaagcaggtgcagagccaggaaatggtgcgttgaagtccatacagtcagccatgctcacatctaagtgcttagtggtggtttcctctcatttgggggttttagttgtccagagtgaacctgaaatcactgctgggtcttgtgtctttagctccagatgtagtcactgggaggtgacgggcaggctttggctttgcctggccttgaagttttcctcacagttttgttttgtcaaggagtgttcccccttctactctcgctcctcagaaacaaggggacactaactcagtcatggctttgaatggagcgtttctgtgtggttttctccttgtcccagtactctgccttctgcagctcccagcccccagcagctgggcacattggcccttgtgctttcatatccacgaaaacacgtgggaagcgcgtgcccagcacatgccttgatcacatatttgtaactcgggagtctgagatgatcgtgacattctcgtatggggctgtgtgtggccactcccattccccaagggagaacacaattactgtattgtctgtgggcattctgggcgagctgcttgggtcacggctggggctgttggtatattgggggatggaaataaccgttttgcagcttcctacctttatgctgccatttacaaaagagggaggtttgggacgacctcttagaatcccctgggtcacctggctttgttcagctgagtaaaccaccagcctgtgcccccctaccccgcccccatagctcagcttgtttgcctgctattcaggcaggacagctctgggagggcagacctctgagaggtggagagaagcagagtgatgggaggcagagagcagggtggcggcttgtggctgtccggtgcrcagagctccccctgcctgggccttgtgagggcgctggcgctggcactggccgatgttgtggcagctgacctgtctgggcatcctgaggctccttccaccaaaagctgggaaggggccctccactcccagccccgtccccctagcttgctggagtgtcagacatgtcatttagcagcatcctaatagaataccctcaccccatctctggcattgaactcctgcccaacactcatgccgcttcctctaggaaatctccccagatctttacctccctacttggaattccaggctcacttctctgcccttgtggatttattatcgtatgacacactatgccttgtgggaaacctaattgaacacttgctgtttgcgtgaacttagttatgtatcacctgccttcttccctcagtccctagcacagccagcctagtgcgtgttggacttgggacgagactgataccgggaggaaataatgcccagagagaagcacaacacagggagtacatgagatttgcyggttcaactacagtcacctagaaatactttttgtttctgagtaaaagtctgttctaaggagcgcagcgtcacatgtgtatataatcttcccattgacccattttgctctctgtggaggctcccaggaccttggccctccctgtcccactggggttcctgcagaggcctgggctgtccaggctctgcctggcccagggccggccctgcaagtgctgcccgcctcacatcaggccctgactgcagcaagactcttcctcctaaaagcagaacacagaaaacaaagctgttagggcagggccctgggctctcagttttcccatgattgggtgtgagagggctgctggccaccctcccgcccacagaaactctgatgagtgttttcaggttcctgaggaggtgtgagtatgatcagatacaggggtttttgtgctggtcactgtgtttttctgttatgctctgctactgtggaacccagaaaacttttgagcccagcccctccgtgaatcaggaggtgctgtgctttgaattagtgttaacaacattttgatagytatcggaaaccccctgcaagcaagacagatttcagtatctctggcaccaagaatgttgagacttgacttaacgtggtgattgtgttctttgtttcagcagacatttcctgagcagctctttgtgccaggttctggggactcaggggactgaggctgggctcatgccctccagaagcacacagtctgtaggggtggcagcttgctggttcatttcatggccctgtgattcaagctctgcattctgcacagaggcagagggcgtgacctgactcagtgtggagtgtggaggtcttcctggaggtggtgacacctgagctgagtctaaaagatgaggttagagagtctggaggctgagagggcagcagggagcaggggaagtgggtggcaagttctagcctgagagaccagcatgagcagaggtctggaggcaggaaactgcatgtggtatttggagaactccagaatgttttaagaataggcagtacatgcatgtgtacaaactcagcagtgaaaagcagtttcctcatccctgtccccagctacacgtctccctccttcctggggggagctcctgttgtcattttcttgtttgtcctcccagagatattccatatgcatgtgcaagaatatgcagatatatacacacacaaatgtgtgtataaaaatacagtattttttatatttttgattttagaaagtattacctatttcttgtgaaagtcaatatctcgtttggttcaaaattgaaaacatacaaaaagccatttcttgaagagtcttctctcatctctgttcccggctacccatttccgctccctgaagacaggttttatgttaagtttcctttgtatccttccaggacttctgtattattggcacaattatttatttagtttcacccaaatgggagcttaatatacccactgttctgatctttgcttttctacttagcactatacctgaagatggtttcctctttggatgtgttgggctcccaaagccttcttttttttaatttttaaaattaaaatttaaattgacacataattgtacttatttatggggtacatagtgatgttgcaacacatataatgtatgatgatcggctcagggtgattarcatttccaacatctcaaacgtttatcatttctttgtgtcaggagtgttcaatatctttcttctaactatttgaaactacataatattgttaactctagtcatcctacagtgctatagaacactagaacgtactccttctatctggctgtaattttgtatcctttaacaaatctcttcctgttccccgccttccscctacccttcccagcctctagtctcctctgttctgctttttacttctatgagatcaaaattttttaagcttccacatattctcgtagcctcttagaaagctgcgtttcgtcctttgcatggtgttgcagtgtgtatttatcctgtccttcctgttaggcggttaggccacttcccatcttggctgtgcctaacgatacgatatgtactattttgctcatgagtaggacagtctgcagggcaggctgatttggcactcacacacgtgttcacagggagagtgagtaaggaggatagaaccgcacgaggacacaggcaggttatgttttacgctcatctctctagaggttgacttgttcccccttgtgaaaggcaagtgactttaagttggattctgctgagtcttgaggaagctgtcttactcctttactgtctcccataagtaagctctgcaaaaggagacctggcccagtgtggtctctggaagcaaggttcgcccaggggtgtggttggcgtcgcttggggagactcccttacagactgtgaccttcaggccataccctgcaggacaaggtcagctagaactgaagcctgcagtgcggctctgccagccttgtttgctggggccttgtggatgtggatgccacctccggcacttgctagacttgggcctcgtgaacatcacagttctagtcagtagtttgttgatttattaataattgaagcgagtaagagtctgtccaggcaggggacctgccaggatgtgggagggagagactgcagggtgactttgcacccatcccatgaaggttgtgatgcagatttctgaactttattttttgagatggattcttactctgtcccccaggctggactgcagcggcatgatccagactcactgcaacctccgcttctcggactcaagcgatcttcccaccccaacctcccgagtagctgggtccacaggcatgcaccaccatgcccagctaatttttttgtatttttggtagagatgggattttgccatgtttcccaggctggttttgaactcctgagctcaagccatccgcccgtcttggcctcccaaagtgctgggatgacaggtgtgagccaccgcacccggcccagatttctgaactttagcggtcccagttattttatcatgctatttttatcaagatattttaataataccctctgccttttagtgcattttaatttagtttttatttcactcatccatcagttgttaatagttttcacttccatgggaggggactgtggcttatgtatgttcatgtcttcagcccctaccatcatcccagcagtcacaaagtagtcactcagtaagggtttgttgaatgaatgagtacagttgcctgccacgcaggcttttgtcaggactggtggcatgctgttaactgttcatccagcacactggaaactgggttttggtgcttcaatgtcaacctctgaccagtacttgttaaatttcatcaattctgatcccatccagttattcagtcggatagggtttctttttttgtttttacattttatgacttaaaaaaaaattattttcgaagctaggacctcactttattgcccaggctggaggcagtggtgtgatcatggctgactgcagccttggcttgcctaagtgattctcttgcttccgcctcctgagtatctggggctgcaggcacatgccaccatgcctggctaatttatttttttgtcaagmcgaggtctcactatattgcctaggctggtattattattatttttaagtctgagaacatatctatgccacctcccttgggtctgctcctgatsgaggtggccagtgttggtggtttgtttgtttttttttttttttttagatgaagtctctcttttgtcacccaggctggagtgcaatggcgcgatctcggctcactgcaacctccacctcccaggttcaagcaattctcctgcctcagcctcccaagtagctgggattacaggcgcccgccaccacaccctgctaatttttgtatttttagtagagacagggtttcaccatattggccaggctggtctcgaactccttacctcaggtgatctgcctgccttggcctcccaaagtgctgggattacaggcgtgagccactgtgcccggccgtgttggttttttgatgtgtaacttttccttctcctgcacatttttgaactccatccagatgacactggggaagaacccctttccacagcgaggtgaaggccagtccacatttggtttgggaggtgcatggaggagtgctcagaggcctggctttagagttttgctgctgacttagtgaatgagcttcctgagagcaagggaagtacaaccaagcctggttcagatggctccactagggggacagtgacagctatagccgcagctggtgtacttggcagtctttcaagcattttggggtgtgckgcggacaaacaatagaatgaatctttgtttctggagcctgggccatttctaacgaggaagatgattactcatttttggaagttgggttaactcttccagagtcttttgactctcgcttagatctgtaacgaaaagccgagaagagttcaccttggcatcccaaggtgtttgctttaaagccgggtgactctggttggctgtgtcatttcctctttaacacccctccacccaggtctttgccctaagtcaggaggcctgattgtcatatccagagtgcttagaaggaagtggggcaagtgtttgcaaatgaggtgcccctttcttctcctgttcccccacccccatggcatgccaaaaaataaagaaggagctcaagacccgttgagcagctgttcctccaaacttcttagattaattccgtggccagttctaagtaatttaaagccaaatgcctggacttagctttgaattaggacttcatgaagcctttcttcgtcttcttccttctttcttcttcttctttttttttattttttttgtgagacaggatctttctctgtcacttaagctgtagtgaagtgttgctatcatagctcactgcagccttgaccttcctggctccctactcagcctcctgtgtagctgggaccacaggtgtatgccaccatacctggctattttttaaattttttatagagatggggatttctccatgttgcccagctggtcttgaactsttgggctcaagcatttcacctgcgtcagcctgcccaagtgcagggattataggcgtgagccactgcgcctggcggtgaagcccttctttgcagaaatctctttctctgccttaagaggcaagaatctggtgctattttgatctgtgaatagacagatggctgttgttacacatgcagcggctcccccgccattgtgctgtggctggtggtgggagtagtcttactagaatttatcctgccctccagaaccctcccctgcagtaggagtcaggtagatagctttggctgtttgacctgagaggtgccacagagctcgggtatacttgtcatgtgacagacccgcctggcagcttagagtccctccagttttgttttggcagatgatggcattctcgaatgtgtggtggagcttgcagcgcgatgtgggggtagaagggagaaggcggaaggcttaccatgtgattgatgagcctgtctgattaatttctacaacagaccctgtaggttggtagatatgactcagtcagatcaggaagggggaagtcctgaagtgtgagctgaggttaggatgtgacctctgatgagtgggtggcacatgggcaacctggtgcctctcgtgcctatagcagttcttacagagcttgttgggaccttcttgcatcacctgtcatgtcccagtgtgatatagtcttagaccggtgtgttggggctaccagcctgcaggcctcctagataaagagatcactgccctcgcagctgtgttccaaggcccagctgctgagagattaccttccctctgtgcagtgtctttgggggttctgtgagagctgtagacaccaacaggaatgcttctccctgcctgctgagtgactggagctgcaccggtaggaaagctgtgtctgtagcctgggctgggggtggattgtcctgcaggagagggagagtccgagagctcataaacattttgtaaaggaaaaggagattcttgtcctgagagttgtcctagaagatgaagatgtcaaaactggtcactggctaacttcctggctctccaagaaactcctctaaatcaggttgttgttagcgtcactgaaagacaccaagatgcccctgtatgcataaggattgagcttggaaaatgcaatcacgcatacatccccatcctcaccccatggatatgtaagagaggggcaggttctgcaacaccacctccccgctacctcggtcccacccattggaagagtccctgtggcctgctccgactctgctttatgggaggtcatagccagggcactttgatggcagcaagtaaggatttggcctttgcctttgtccagtttcctgggaccttgaactgcaggtcaggtctgagtaggactggaaaggccagcatagcagttgttccaggacaggcatcatcagcttactgtcctttcttatagttcattcagtaccttcaaatctattgattttcatgctctctccagagttgccatttgcctgtgacacgtgaggaaactgaggcccagagagtcataaagacctggctgaagccacacagstgatacgtgactacagttagagtctcactagtcagaaacggagcttatctggcccagcatcctatttgactcatgagggaactgaggctccgaggagggaaataacttggcaaactgggcagagccagtaagtggcactgtcaagcccagagcccccatcccctaagtcctgcttgatccacctaggccacacagccttttgtttgggtctttccatttttgtttttaaatcttttttttccacccctcttctgttggtttttagtcatggtttgagtaaattcagtatacttataaataggtccgactgaagaacaggtcatggttgtcttaggctaagtggcttaacatgatagtagattatctttggggcccgctgcggtcccctcattgtcctctggttctcttcccattctttcccttcccccggtttggagcagaaggcggcatctagctctgtggccactcggtaagtgtgagttctcctctctccgtgcctcttgtccctcgtctccttccttttgagtgtgtcaagcagcttccagtctatagcaagctcttctttcatagtgtttgtgggttaaaaggacatgagcggtcgtgagaattaygggagtgcctataggaagctcgtccatcagttatttttcattgataaatggactcttgacaagtcatgcatgcagttggcttcagtttcaagaaacaacatgggctgtctcattcccatgttgagatttgttttggctttttggatcccagcacttttatgtccctgaataatgtcattcctccccctcctcttgaaatgttatttgctttaaaaagcagaaaatccctacaacattgaaaagtccaggagaacagagttccgatttggttcagcagctcagtttactgttttgtcttgttttgtttttcccccttccattaaggagacacataggcgagcctgggccactttgttcagccaggggcccaggtcaagtctctttcaagctgtgtagtgtgactcccagtccttccccaagtgtggccttcggtggcctttgattacctgaaggactagatcagggaatatgttttagccccagttactgaagaaagcacctctgaggacacaccttcctgtggagggagggatgaggaaggggtgagtatgccctctctgtctaaggacagcaggtgcttcatgcgtacagccagccactctcacttgccctgctgaatgtccaccagcccagttgcaggagcaaggtgcttggaggactcaaaaacatattcttggcccctagaagctaatgctgtagctgtgaagacgagatgcttttatccaatttatgagcatttaataagggcctatgccctgctaggaattgtgcctacctagggatttcagtgtttctagggatatttttgtagtgcccccacctacagggcgttacctccttaacttatagctgaggcgggcagcacaagggtaacgtcttacatgttacaaaggcagaaagctgagcaaagttgcagagcttagccagggccctgcagctcctctgggactgagctgggctgagcgtggactcaagttcagtgctcttgctgtgatactgacttagcagatagacatcagtcaggttgctgctgtgggcaggctctgtgctgaggccacaggatgactgagggagggcaacacctaggctgcacaygtggagggggggctccccacaaacaacctggaaatgaactttgagagaaggacagggtggcagtgggggaggcataggcaggaggcacaggacctgaggagatagggacagatggatacaggttccagctggggttgcaagaagccattgtgactccctgcaggcccaggagcaccctgagcttcctggaagacacttcaccctctgcaggttacccaccatgtctgcacatccatgcagttaaggagggaaagtgatggcttcctgtcccgcttctaccctctccaagatactcgtcatctgcccatttttcttgcttacagtggaacccctaataccatgtttcaacatcagttccagaaggttgatgtttggctgggacacctcaggatgggctgtattagagagtgtgtgtattgcaaaattagtgtctgctttggcatttgatcatttagctgacaaatcaagtacttaaaggataattaacaatgaaacttacaggtcttggagtagtggggtccaggggttaagacagactttggagttctgtagatgtgggttgagtctttgtgccttgttcacaactaggtgaccttagacctgggcctcactttccccctctgtaaaatgggataacagtagtaccctctgatagggatactctgaggttgcagtaagcacagggcctggcactgttgctttggctaatattttcctcatgctgctttaaaaggtaggctctgtgtcacctgttacttctgcactagcaaagtactgatgaaagaggttttctttktttttttttttttttttgaggtggagtctcgctctgtcacccaggctggagtgcagtggcacgatcttggctcactgcaagctctgcctcccgggttcccgccattctcctgcctcagcctcccgagtagctgggactacaggcgtgcgccaccacacccggctaattctttgtatttttagtagagaggggtttcaccgtgttagccaggatggtctcgatctcctgaccttgtgatccgcctgcctcagcctcccaaagtgctgggattacaggcgtgagccaccacgcccggcaagaggttttctttgcctctttttttctgtgtgttgagggtggtgctggcaggattgttagttgtttctcagcaggacctgaagacatgggaaccctggctgtgggagtcgttgaaatgttcactatagtatagaagctgcacattcgtgggtcctgaactctggttgaaacaccagactctctttccagtatcaacttggtctgggaaagtagaggccctggataaagttcttaggcagctttcaacttttatcctttagactcagatgacttagttagtatataaaatcagcaagcagaagcgtccccaagcagattaaatccctttgtcttggcggatatgaagcttgactgcagcattcggctcccctcggaacccttctcgcactttagggttgtcacagaatttggcaggagacaacgtgacccactaagcaacacccttccccaaatgttcatatacttgcttctggattctgcccacagattgcttttgtcacaccaacaactgaagctacgaaagtttcaaagtgcacaaagaccttgtggaattgctgtcttcccctcctatttcctttgcttaatgggagggggaaatggaagctctgagagcaatgacttccgggagccaccaggaaaatcactgtcagtggctgagttctcatgtttaggttttgatctgagtcctgtttttaaggcggtaaaattaactgtgaaactaatgtgtgcaagtagtakgtacaggctaaataaagacactaaaagaaggaaaagcttgtcttgctgatttccagtttcttttaagggatagcccttcaaaatgcattacagagcatttggtaaacttctaatcttcttaagatttatataggattgtagagtttgcaacactttcttgtatgtattaattcattagcatgcaatcctcttttgaagtggatgagccaggtggggctcccacttgctggaagctgakagtcccaggccacagtgatatcagatagctgtgttcagcggttgcaaacaaatgaagacacattgaagactgtagaacaaaagcaagaaaatttcatgttagcaaggkcttgtgtgagagcaaagctgtcccccctgtttctgtggtgtcagagacagagtggcctggggaggaaggcctgggtttgaatcctggtcttgcccctgctagatgtatgatattgggcaaatgacttgatttcttttcttggagcctcagtcttcccatctggaaaargtgcatactaccaaccataatgcctgttcataggaacgtgagaggattagctgagaaggacccagcctctggtggatgcccagggagatgggaatggaggtgagggtggagggctgtggctggaagtgtggctgtgtggggcacatgggggtggagatgggctctgggcatggggcgtcttgctgaccacggcagcagccacctgtgtgtgtgccctcccacccataggccttgctttgggcacaatgctggcaagtttggggccgttcttgggcagatgcactcttggggtgaggacttgggaggtgggcaggggccccctgccaccgtgtctgcacccagggagcataaacatggatcaatgggaagtctgaccttgccttttgctcttttcagtggaaatcctggtgaagatgagtcattgagtaggggctcctggggttgagtcagagagcactgtgtctccatgatcaggttggggtgccagccaaggggagaccctcacctagccctcctttggcagatattgggtagccctagctgtgtatggaagcaggctggaggcccactatcatgagcactgcccagggagtcacaggagagaggtgggaggtgaatgtggggactgggaagtgacaatacaagacttaaatacagggcaaggaaaactgcagccgagatgcaaggatggtgcccgatgagagtgcggcccacgattgctacttgtgcaaaggggaatggacaccaatgcctggccttctctgtgccgagcttttttatatgtgttttcttatttaaatcttacagcagccccagggcaaaggtattatcctcattgtgtttaattacttaataataataattattttttgagacagggtattgctctgtggcccaggctggagtacagtggtgtaatctcggctcactgcagcctctgtctcccaggttcaagtgtttcctgcgcctcagcctcctgagtagctgggatcacaggcatgcaccaccatgccaagctaatttttgcattttttagtagagttggggtttcaccgtgttggccaggctggtcttgaactcctgacttcaagtgatccactgacgtcagtctcccgtagtgctgggattacaggcatgacccactgcacccagcttaattatttcttttgatataaggtctccctctatcaccaggctggagtgcagtagcatgatcatagctcatttcaacttcaaactcctgggctcaagccatcttgcctcagacttctgagtacctgcgactacaggcatacactcccacgcctggctattttttttttttagtttttattttttgtagagatggagtcttgctgtgttgcctaggctggtcttgaactcctggtctcaagcagtccttttgcctcaacctctcaaatgctgggatcactggtgcragccactgtgaccagcctcagccccattttaaagatgaggaaactgaagtcgagtgatttcatggcgaaggccagggccgctaaattccacacacacgttcctccccttcccgcgcacacggtctccctggtataatcagtgggctttaaaaaaagttttaaaaacttatatatagcataatacactcttttggtggttagtgctatgaattttgataaatgcatagattgggatttatttaaaattttttttttgagatcatttacactcatgcagttacaggaaataatacagagaaatctcgcatatcccttactcgctgtcccctaatggtaaatcctaccaaactaatgcagcatcacaagcagaaaattgtcacggatacagtcaagacacagaacatgtctgtctccaaggatccctcccgctgtcttttcatagccacgcccatttccctcctgctcccacgccccatccccaacccctgacagccattcatctcttcactaattctataattttgccattttaagaaagggatataaatggactcctagaatagtgagcctttggggactggctctttcactctgcatgagtctctggaggctcatccaggttgtggcgtgtgtctctggttggttccttcttattgccgagtagtattccacagtgtggctgtgccctgccacattttgtctaattgttcacccagcaaagcgtctgtggagtatttcctggttttggctgttatgaataaagggctgttacaaacatttgtgtgtgaacgtaaatcttaatctctctggaataaatgctaaggagaactcttgctggtagttgtttgaatgggcatttgaaggggttttttaggggatggagaggtgaggcatggtgggaagtgcagtcctgaatgctggcccaccagggttcaaatcccagctttgaacccggaccctgggtgagttgctgtatatggctgtaaaatggggataattcaatctggcttgtggctaatgtgtgtaaagcgcctggtacctagtaggtgctcagtagatagaagtgattcttgatataggttaagagaaaacccactagaccatggcagggtgtgtgccccagaggtggcctgtgggagggctttgcgaggcttccacctcgcgccctgtgggatcacccagttattgtctttttctkggccatgcccccggcttctctttgagaagaccctgaccctgtttgcagactgggctcgaagtctccggcctggtcctggcattccccagtgaagttggccgggccagggcccacgggtcataggaatcccaggaaattccagatcgtgctgggctctgctggtctggattcgcctcacaaattctgagaacgtgcccagatcatttcacatgttgctgtaatttagctggattctggaaatgtgtattgagctgctagggtatgtgagggatygtggtaggtgttgcaaagggttcagaaaaaattgctctcccaacagatcaaagcagccagctccagcttctaacctcctttgggagcccccacagctgcagtgataaggtctccattgagtatggcattcagagccctgggtctggtttgagtctctctctagctcccatcctgctgctgtgccctctgcgtgccctgtgtgccagccaccagcacgctcaccgttcccatactccaagtccgacccggcggccacgccttgcttacacccttccctctgcctgggtgccctgcccttcctgatgaaatcttgcctgttttttaagaactaaaagtaccatgggcaggcgtgggatggaatattcaaacctcacatagggttggacgtggttcctctccggaactgtcattcccttctccaggcaaccactgtgtgggaccatgctggactccttctatttttttttttttttctttttttgaggcagagactcactctgtcactcaggctagtggactcgctcttcttgcctttgtcactttataggatttcttggagattgtttcatatctgtacagtttgaactggctcattaaaatatttttgaaggccacatggtattcccttatgtaacaacaccgtaatgtatttaaccagtttgccctgcttgtaggcagctaggttgtccccactcttgggctcttacagtgcaaaggagtcactttaaggcctacctccgatgaatgtccccctttctgcctgcctctgaaatgtgttggctgggtcactgcactctctgtgagaccccccagggcagggattgtgctacacctgccttctcctttccatgcctgccacgtgtgctgaccacccagttacccaggcgcttttggtgcttctgctgcctctctgagccctggccccttgtcnggactctgctggggatggagctagagagagctggggtgccccgtctttgcctcgttctggcttcctgcttcatgcagagctgtgtctggatgggctaatgtgttcccatggcgacagacttccacagtttcattctactggccncctcctacttcaccagagggatgggccatcatatagccaggcccttgttaatggaatttagcttgtttccctttaaacacatttgagaggatggccgcttgggygtccattgccgagaggaggatctggactcccagcctcccccatgaaactgctagcagtagctgctgctgattgagcactctcctggatgagcgagacactgggcaaaggacttgggctctgttttcatcagatacagtaaccttgtgaggcaagcactgttttccctgttgtayagagagggaaactgaggctctgagagtaacttggcaaaggccactcaaacaatgtatttcaagagctgggattccaactcagttgtgcttgactcaggacctgagcctctgtagctactgagcccacctggcttcctagagagaggctggaaatgggggaggagggaacaggcagctcacctctcaggccttgtgccgacggctggctgccgtagagctgaattggggctcacacacagaaacatgacggctgccattaggcttccaccactgaggaggcacaaaaggcccctttgaaaggcgagtccaggagcacctctctggcctgctcctgagctaagcctgcagtgggggctgacaggcatttctggctcagctgcctggccagaacttgcaggagtggtctgaaattctttccttgaacagatcacacttggtcagaacatgtcacttctagatcgatgtggtattgaacctgtgcatcaggtctctcaatgcgacctgggaatcttcaggctccccggggctcccttcctgaacatgtattgatttccctcctccccttccctgcttttgcactttggatgaaccttgttttcgaagaacagtagaaggtaattttcctgtgcttgccagctggcctgtaattgagcaatttcagtaacacccactgtaaagtctaattgaagtaaacaggaaaacatgatttacaatctggacagcaagtaaataccagggtgcaattaatttttacacagagcagcagattctaaaacattttcctgtgttgagcagtttgtttctrattacagattggaagctgcttttctatttaatactgttatcatgattattttttactttttgatggtgatcttcaggttccttgtatctgtgtgactttctttgaaggtttagccacatggggaaatagaatcagagacatgagtttataaggagggatttttcaaacctgaactgaaggccgcactctttcttcatttgtttggtgggaaatgatcgtgggttatcggagaggggctgcggataggctgtgcagaatggcgatgctgagtgggtcccatcactgctggaagctcagtttagttcattctggggaagatgacaaaactgtgaaggcctccagtgttgcaaagatgttgatgttgaaatgtggcacttccaaggaccagaaatgtatgcctttttttgggggcggggtggggacggagtttcactcttgttgccccaacctggagtgccgtggtgcaatcttggctcactgcaacctctgcctcccaggttcaagcgattctcctgcctcagccttacatgtagctgcaattataggtgcacgccaccaagcccagctaattttttgtatttttagtagagatggggtttcaccatgttgaccgggctggtctcgaactcctgacctcaggtgatccacctgcmtaagcttcctgaagtgctgggattacaggcatgagccaccgtgcctggccaaatgtatgcctttttaaatggaccctactgattgttccattagcttctgttcataactggttggagaagggagccagcatgctgactgctggtcccttgctgccagttggctgcctgagggccgacccctttggtgttggatgcggggctgaggcatgttctgacccttggcctactttaatgtatcctggtgtgtgctgaagctgcctgtagagccagcttagtggtaagatgtcacatgacttgagtatgctgcagggacagcagattgttagccacccagaccctgagatagatcttaaaggtatcatgcggctggaccccaatttgttgttstatccaccaggccattttacaagtgaggcagcccaaggctggcatggcaggggtgggcggggggactctgagaaggtaactctgggccttggtgactctcccagagtgcatctcctttagcagagaggtggttccagtcccctgggatttccagtactgtgggaggggtgactctcagggccctcgtctttcttagtcctgaatctttttgcttttcttttgtctttccagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactggtgaggacctggcaggcttcctgctttccatgaccatttctgaggcctgatgtacagacagggctgtggactgagcacctangcttagcaaatcgagtccagagtccccaagagcaaagctctgtgaggcgtcccgggctggggcaacagggcacaggagcagagcttgactgagaacttgctggaaggaaggaactcagctcagatttgaggtcatctggtgaatgaggaggggaggccatcccctggtaaataacagcaagtgtgattctgccgcctgccaagccaggattgacattccttctgtctccacccattaagggggggtggtttccagagggggttggtgccctgaatgggggcccagataagcctgtccctctgaagggtggtgctgcctcaggaacgtcgagagtgggagatgatggggaaagaaggtgtggtgagctatggcaacagccaccctctgccaaaggtggttcaccctggaccaccctggaccacttggtggactagcgcagagaggtagctaactcggccttcttagactacgagcaaaacaacctccagtagctgaaccctgtcagcagacctgtccttccaagcccagttcctcagatgtgagtgcaggctgctcccctgtggagggagcgagaagccacactcagtcataagcagtcttgtggagatgggcaagtcctcagaactctctgcagcttccgtgatcaggaaggggccaactgcccagggtcaccttgcccaggacccctcctggcgcccttcacggctcctcgtgaggacccacgccaagcctccttggtgggccccttcccctagctcatgccagtgaaaccagaccttgagcagatagacctaggtctctggctgtggcaggagcttgggaaagccaccgagatctgtattctttccgcaggcctcacagagcgccttccgtgtgttgggcaccaggctggaggagttcagggaacaggatgagctggagccaggccctgtactcctcacccttgagaagctcgtggtctagagggagggtgtctggagagctgtgaatacagtgacacttgaggatcccatgactaagaactcgcagctgaagcccatgggaagcccagggcttgtagaggagcagggccagcctggctgtagcacgccagggaaagccttgcggagcagggatacttgatttggccttgaagggtgagaagaagtggcttagaaaccgttgggtccagcctccttgttttacaaatgaggcagctgcaacctggagcaggcagtaactgcctcactggctccgcctccgccttccctcctgcccctctagccccacttcctgggcctgcattcaggcctctgcctgctgcctggtgtctggacgccagtcttggtggccctccctcagtcaggtctcttcagcccttaccagatgtgacactggtgccactctgctcatgggcctcagcctgtgaggtctccatggggtgtcacccccagctgcaaggatagggactcagctttgctcctccccatgtccccagcactactgaggcagggcagacagcaggcacctgaggtgtgtttgctcgatggcagccttggtcactgcagcgaggagtagagctgctgtgaccattcagctcttctgctaccaccccatcctttccagttcacatttgctgtgtgatgtgattacttctcaccagccccgctgccaccaccctggttccacctgctgttctctcgcaaggattcttgtggtaactggtcccctgcctctggctctttttaacctgttctccacccagcagccagagagaatcccagtcagagctgtccttctctgtgtagcagcttccactggctttacactgaatgcttagcaaacacccagcccttactaggatgtacatggccccatatattcttgtccatgtgactgctttgacctcatctctgccactctgccccctctgctcggtccccactggcctccctattccaatatgccaagcgtgagcctgcctcaggcctttgcactttttccttggcctggagccctctccccacagtaggacacactccctccctccttccttctctggctactcaacctacagttcagtcccagcgccagcgcccaccccttacccccaccacactttctctcctcttttcctttttccctcttgggcacttagcacttttaaacatgtccctatggatcttgaccgagtccttatactagaatgggagctttgagaaagcagaggatgtctctcttacttgttgttgaatgcacggggcccagcccgtggcaggtgctcagtggatgtttgtggatggatgagcttgcaggttcctgtcacctggcctcttctcattcaccattgtcttactctctctctggctgctgctccagttcacgactgagtgggtgcgactagagtagctctgaccaaaaagaagggacctcaagggtgaggagccatctggaggtcccgagggaggagccctacccgggtccagctgtgcagttggctgcagtggccgcctctgtgcttggtcccttctcagggtgggactgcctggtgttggcttcagagttggttccaggacatgtgggcccaaggtcagctgagctgctcttccaagaggtgtggcctgagcccctgccaggaggagcacggcctcccagccctggccagggaaggaaaactcatctcagaaagggaaagcagtcaggggagagcaggcggctttgctggaagggattctaccatgtgttctcttgtggccacacagattagaatctgtgctttcttcctgaactctccttgctttgttggaaagtatccttctttctgctgctttttgttactggcctgtccgggcccagaaccacccagtgtgcagtgctttgggtccatctgtggtcttcctcctcctcttctctccccttggctccagatgagaggtctgttgtggggagcagccctgttggagatgggctttctcattgctcagtttgcttatgcgcccagaacacattgactgggcgtcagtgcctggcccggcctggctcagcgctgcctgcgctatagcgtgggccagcaggaaggtgttggaggtgcagctacactgagggtcttgggaagtgtgttagttcatatcatgttgctatgaggaatacctgaggctgggtaatttataaagaaaagagatttacttggcttatggttctgcaggctgtataagaagtatggcaccggccaggcatggtggctcacgccggtaatcccagcactttgggaggctgaagagggcggatcacgaggtcaggagatcaagaccatcctggctaatatggtgaaaccccgtctctgctaaaaatacaaaaaattagctgagtgtggtggcaggcgggcgcctgtagtcccagctacttgggaggctgaggcaggagaatggctcgaacctgggaggcggagcttgcagtgagccgatatcacagcactaccgcactccagcctgggcgacagagtgagactgtgtctccaaaaaaaaaagtatggcacctgcatctgtttctagtaaggcctcacgaagcttccagtcatggcagaaggtgaggggagaataagtgtgtcacgaggtgagagagggagcaagagggaagggaggaggtgccagacctgttaaactaccagccctcacatgaactagaagagcgaggactccctgatcaccatggggaggccaccaagccattcatgagggatccgctcccatgacccaaacaccccccaccaggccccgcctccagcattgggggttacatttcaacatgagatttggaggggacgaacatccaaactgtatgcccagaggtccaggtacctcctccctgtccttgagcctcatgccacctgctgaggggcaggggtgcacccatttctaccccattatacaggaaggaaactgtggctcagagagcccagggaggggctgccctggtcacagatttcaagtccaggcccttgtctgcttcccccagcaccttctcgcatgggccctgttccagaggctgtgatcgccttggagcccctccaggccttggggagagacacacgatgtaaataactgaagaaatactgaaaataatcttagtctagtgatgacatccacgggacagaatgtgagataagctgatgctagcatttgctttgaacagccagcaaaggttcagaggaagttgacggggttttgctttagcttcctaaactggtaacatcatccccgtgtaaataccatcaagataacaacaggaacgatggaaaataatttttcttttgttttctaatcagactaagaagataacaagtggaggtttaagattttaaaggaaagcatgactgtgggggaggccgggactggtatcagcataggccactttggaattatgggagcaggccccagaggcgcagctcaccctgggtccccagagtcaggccttagtcacagagcgggaaagtctcaatgtgcaagggaaagtcaccagggtcctcgcaaccctgggtgtcatgtggcactggaggaggagctcgtggccaattctgaggcctgttgaggggtgtgaggactcggtctccctcccagccttcttaggggttcatgccatggttctggttcccctgttttaaaaaactaaatgctggtgaaacaactgtctttccctcaaagaaagatgtgggaaaaagggyaaaaaaggactgaccagtgctcagcattttgcctttcccagcacagggcccacctgcctggggggagatggccctgaggctcagctgtgcccatggccctggcttcgcttgcactgccggcagccatggctgggtccagttcccctttcccccactctggccagtgccttcctctgctgagtgggctcttccttccagtgttctaacattagctgctcccctggaaggcagcccagacgtttgaccttggagcactgtgctccctcagctccttcccgcacgcccacactcaggccaagggcctgttcttttgtttccagagtgaccacctcccttggccaggcccgctcttctttctgcagcccatcctcccttaaggctgaagaccaaagggagctggtggctggctgctcctgggcagagggcagcatggagctccaggctgcctgactttccacgtaacaaccaatacttgtcctttggaggggctgatctggtagctagaacaagcacttccttctgtacttgtcagattaggatgccaaggctaaatgacttttcttacctgaggagttagtggccatgtcaggccttgcacccagttgcctgggcactggggttcttcatacttcgggccatgctaagttggcactttgagctcaacagccccagccaggatctctggcaggccccaggctggcctgaagttagaatgtgggagtgcacagggtccagggcagcctgatgcctttcaccctgggcaggcagagataccaaggggcctgcccatgctttggctaatcccagagcctcaggagtcagggccagcgtatctctatccgcatctttgagagtcttcacacaaaggtgctgttccctcctcagcttctctttcttgtctcaggcctggatctcctttttgctttcgactgccacggtctcgcggggttgcatttcggaagtgtgggtgctccactcgttcccccgcagggcatgagcgcgagcctccccctgttgctctgtggctccctgtaacaccgtgtcaggagatggaaaaggtgatttgatttctttagtggataatgtgcagagcaaagttaccaagaaccgtggttgtggcctggcattttctgcagggccagttcctcatttggagccttaattgtgtctttatttaagccagggctgctttctttagtcagacagatggccctgaagcctccatttgatttccagcttttgcctttcctacgaggatctaattccaaaaaccttctctcgtgatctgaggagtctcacagagacgaggccctgccccggcgtgggctcgggaacagaggcttcacggtgggagaagcacaaaggggaaatgtgctctggtcttatttcactgcagacctcagctagggctcgggtgctcgcagagtgcagacactgagtgtcttgtgaaacctcagagggccgaggggttccctcggmctggtggggcctccacaccgtgattggctcattcttcccactgtgggtgcaggaggttcaaagtgttggaaaggccgtgtgtataggaatggtaaataccagtgggaatgttagcatatactgggaagcctggggaaaaaaaggccctggccaacctagagccaagcaggaactctgctggtttgcccatgtggagttggaccagggaaacctgccagcggtcagggtacactggggcctggcaccctggaaagctgtcagtacatgacattctggcctggccgccactggcttagcctcacggatggggctcagaaagcaagatgggccgtgatctggtcttgaggtcaagcacgaaatcagtcagggttcctcctttgtcagcaccagaggccatctccagctaactcaccccgaaagagaactccctgaagcacagggcgagctcgcagggctggagaggagggggccagtcgggcctcagaaagggcagggtgggagcagctgggaggactttagaagcaggtgctcacgggcaggctgagggcctccttcctgggcggatcagccccagctctgtggttcaggagtcagccatggaaccagtgtctggtcagccaggcttgagttctgggcctagcctggggccaggggaggtggaggcaccttggttgacagtcccactaagacatgatccagtgacgatgaaggtatcccaattcagaattggggtgctgctgacagaagaagggggccgcaccactgggctgcgcggtttcatctgttcagtgaggagcaagcagtggcttgcccggggtggggaaatggagaagtcgttctttcgagttagaaaatcatagtgtgcaccattgctggttcatgggaacccttaggtagagtgttggagaccggcatgaggaggccaggctagcctgcagggcggctctgacactcaggctggcctctcagcccttccccactgaggtttgactttgcgtgaggccagcgattttgggagacagtgacttctgcccagtgaaaatccacttccgttgcctgacatccactgggtgtgtggctgcaggagtgggacaggctggcgctgacaggtggctgtagccatggtgcctgctgtcagctgggatgttggaaccaagacagccctcctttctcaagaagcttccgttcccatggagcagagaatcagtacaggaacagatgttctgatacctgccatgttcattaaatgaggcgatgggagagagaaaagcaggtgggaggcaccgctttagccaggatggtccggcaaggccactgaggaggccacagggcaggaacagtgcaaagcctgctgcgtgaagatcccggcacaaagcccctgagatggtagtgactggcctggccccactgggtggtgtgagtgaggaggggagggccagagcaaggttgggggtactcaggttggctcatatggggccctgtaggctgtggaggagaggtagtggccgggatttgattctggttgtggtgggaagttgttggaacagaatgacgtggtctgatctctgctttaagaagatggctctgggttctggatggagggtggggaatgggggccgagggtacaggctgtaagagcggttaggaggggcgttcactggggctggcagtggctgggatcagggccaatggtggggtggtgaggagtcagttttccaggttagaaatggcaggccactctggggacctgctgcagatgctgataagtcctcattgaatgaatgaatgagcaagttgagtgaatgtatgaacgagtgcctggggtgctctgtgtgctggcccagtgctgcctctgtgggcagacagaccccagcatctctggcagtgttccttgcgaaggcctgggtcaggagggccctgaggtcccccttggtctagaacatgccagcttggtgagaggcggccagcaagcactgttctgctggccaggcaggggcggctcactacgtggcttcctgctttggtgtggaaagccccaagccctcctgcatgcatgccagtgaagcacgcggggtgcttcagtgttcctgttcaattctgctctccccagcccccatcctggtgtggcctctctggcctcccaccctgggttaccttctcccacctggcaggcacgggctgggggccggggttccccagggggtaatttccttgtgcccaggtgttcccttagtgctgggagctgccttccttggcaagcaagaccctggcctgacttccctctctgagcctgcaaactgggcgcctgcctggcgtccacaggctgagctctcngctgtgcaggcagtgcagccccagcagcagtgctctcatgcgcttgtcatccacttgccattggatgacttcggtgtgttctcagctgcacctctcagctgggattgtgttgggggatgggaggaagcaggtgcagccattttgaattcttcccagatatttccacagatggcggtagaggggatggttacatcactgtggaatccaggagggtgactgagcctgatgatactgttaggatcattttaaactgaggagggcaacctgtaggaggactgccccgttccccttccgccctagaagctcctgtggtcctcatcaagtgtctaagcatcccccccaggaggctgccccgacctccaccctcatcccagcacacttgccctggacatcccctccagccctgatctccctgtggtttgtctgtgaccgtcttccatgaagagtgagccctccttcacctctgtgtccccaggttggtcagcatggacccttagtaaccccgtgggatgaacacggcgttgaccttgtgcagaggtccctggattgggtggatggggatgaagtgagggagctggtgccaggtgcttgccgccttcttacctggaggggccaggcgttcctagtcagccccatcctcctgccaggccttaaagagccagaacctgggcccttgtccacttaccagcctggaagtcttgtctgtttgtgtcattttgatatggggagtgttcagggttccttttagaagtcagagccttctgtgacaggctcatttctctggggctaagagctcctttcatcattgcatgatcaacccccagcacagcccgcctaggaagaatcaccagcccgtgcccactgagcgagtgggcgagtgagtgaggaagccttggagcacttgaggcagagctccttcctggggctctggctgggtagtctctgctcatgagaggaccgagcgagcctcttgacctgggtatcacctagcatgaggaacccccagaatattccacacccagcttactgtgtagccatggagcaagtgccctggatttggggttcttctaggcctcgttggcctattctgcctggtggccatagcattcagttgagggtaggcggggggcatcagggaagctgtagaatgtttgcagtggaaagggaaaccattgtggaaatacagggccaaggagttcaaaagccatagctgttatgttgagaccaaatataacccttgagtttctgtttcagttcagagaaaatgcctcaaggggactcgatgtagccacaaaacagtctgcagagcagacgccagcccttccgagctctccccatgcttctcaccagagcgggagagctgttctccctggatctggaagggaggggtctcggagtcggacctggggccctctgctccctacttgaggttcttcgtgtccccagggaggtcccctcctctcttggtctcttctcagcccagctcagggaagcttgttccactgtttaccatccatcctgcccccgggccgcctccacatcacttatgtggaaaaatcccctcgtgtcagaagtcgtggggctttctgtgtgttttcaaagcccattaactcgatggactccataactcactagagacttgggacaaaaaatctgggcctaattttrtgcagatgttttctctttgaataccttttcctcctttccctgatctgacattggcaaaggacagtcacccttttattgtgactttagaagggatcagtagagtcagtgcaaacatgcttcctatgatttgaagagtgaatagcttttctggttgttttcagcacacgccaaagaagatgagtcaaggacctacacttttctcttgtggaattatgggtaagtactcaaggccatcctggaagctgtcctcctagtccttccagccagggtctgagtcctccaggtgagacactcaaagcactttctggacacaagttcaaaaagagcagcccygggactcttctgtgtgttttaactattttggtcccctacggtgcctgagtgaagggacaggcactggtgtgtggtttacaactccaacattgagaatttctgtctgatgattaaagtaattcatgttgatttttttcattcagaaaatgcacaatagtgtaaagtatgcaataaaaatctctcgtagccccaatgcccagggagagttactgttgatatttttgtgtatgtttatgttcttagcattttttatatagcccattccacgatgaacatataattatgtaaaactatatttgtttgcttttttcacttggagtagttaccatcatcttcccacagcattaaaattgttcattccatgcattttaatggtctacagtaccgcattgggtggtaaatgtatcagaatgtctttagtgatgtaactacatctaggctgttgggtcaagaggctgttttatttgctgttgtgatgaacagtggctaggtaagtgcctaattctttgtctgcctttgtgatgatttgctaggatagtttccaggagtggaatagacaggctggagggcagggacatttttaaggctcttgattcattttgctgacatgccttcmagagaagattgccttgatcttctgtttctgtgcaagtgtgaattactgttttttataggcggtaaaaaagatgaccattgattacttgatgcttcagatgattgggcattgtttgacctctcagtgtctctctgtgrctctccttgcccacctttggggacgtcttgccggatgagtttctgtaacgtctgcgtggactcagaaaccactctcagatgatagatgatgatgactgtgggctttcagattcaaaggttactttggtcagacctcagagtctcccttgcctttccttctcggtcctccctccatgtgcggtgttttgtttttcttcttcagatacagttgccatagatgaggtgatgtgtcagattgagcactgtgccaggctccttacatgctgggccccgctggctctgccagtggcatcattcacatacgggagaactgaggtctagtgaggtggccctctgcaaggtccctcagtaagcggagttggactcaggtgggtgacgaagggagactgttttcttctcaaccacctgccatggctctgggacacctggcggtgctcttgatgctgccactgaagaagatggagacagggagatcagctggccctggttttccntgtgacatacttgggaggcccgtccccacaggattgaatacctccccggtggtttacagctttcagcaaaccctcagggccccagacacatagctcagaagcctgcctcctcgcctgcttcctgggacaacctcacctttgcrcttccttcctgcgtcatgctgggaaagagagaggccccggcatgcccagcccctcaaccctgcctaggctttagctgtcaaccgggccagaccagtaaactgggttgtggagatgttggtctttatttcaakgatttctagtctttgcactgtgtaagttataataaggtggaagtctggtgggtttgtgatgacagagagagtcgcccttgtagggccaggtcttgaggcccagagaccaaggcagaggccccggagaagggaggtgtgtgggaaaaagtccagatggcccaggagagtctatcggaggctgcagagcccagcaacctgctttctaccggggaggccatggtttccaggagggactacgctgtgtctgcagactcctgtttacagagtggctctttaggaagtgctggctgggtcccaatgcctccgtcccaggctcttctcctcttcagcagggtcctgtcttccttctgctctgtgggacagtgccagggcactgccaggcagcagagggagaagcggggagctattgtactggtgggaggtctgtggagtccccttgttctcctctgctgctctctctccatgggtctcatctttctgttggtcggcccctccctaattcaggaaaaccctgacctgcatggctgtgcatcactgacgtgtttcactgactgcagtttgttttcattttcagtggcttgctgtcatagatatgacttgagcacctgctgtgtgtcaggcacctggtgagggatagagtgaatcagaccctgccccttctctcagggagctttctgtctggtggaggagaaagatcaacgaacagtgaattctgcactgcttaggccaactcccgtgagatgtggaggcccttgagctatggggataccaccccatcttcccggctaggtttcctcagtttgcaagttgtggggatttaaggagacggccacacactagcacacatcctccctcccacctctatccctttcctgcgcttgctggagcggagcgggtgtcagcagtcaggagccttaccccgtgcactctgtctagtggaagctcaggttacctctccagtcctccgtgtgctccatgaactgggagtgcactccacccaggcagcgagatttcatctgaggtgtgcctgcttttcttttttttttttttttgagacagagtctcactgtcgccaggctggagggcagtggtgtgatcttggcccacggcaacgtccgcctcccaggttcaagcaattctcctgcctcagcctcctaagtagctgggattacaagcgtgtgccaccacgcccagctaatttttgtatttttagtagagacggggtttcaccatgttggccaggatggtcttgatttcctgacctcgtgatccgcctgcctcagcctcacaaagtgctgggattacaggcgtgagccaccgcgcccggcgtgcctgcttttcaacagtggggaagagaatactctgaggggccggctagacttttcaagagggttttgggcccttccagcgctggacaatgctgtgcgaagataaaacaccaaattatcataatcaccaacccccagcctgtctcctgaagataaaggactcatgttctggtgctgatcagtggaattctcccatgagagctggggacagttggccctgtgactcaggattttttcctcctgagcccccatgccagggtcctcgctgggagccagtatgagttcaagtttcacaaatgttctgcagaaaatctgggcaagtgcagtagagcaaggagcacagcaccctggtcactttttaaaatgccaccctttcaagtagctcagcctcctctgcacccacttagataaaacacataactaatataaattgagtgttcacaacaatgcctttttttttttttttttttttttttgagatggagtatcgctctgtctcctaggctggagtgcagtggcgcattcttgtctcagggcaacctccgcctcctgggttcaagcgattcttctgcctcagcctcccgagtagctggaattataggtgtctgccaccatgcccggctaatttttgtatttttagtagagatggggtttcaccatgttggtcaggctggtctcgaactcttgacctcaggtgatccacccgcctcagcctcccaaagtgctgggattacaggcatgagccaccgcgcctggcctatgctttttatttatttatttatttattttaattaaaagcacttcacgccctgtgattgcaagctggataccgggcccctccccactcttgtcccctaccccagtttaggaacttgatacagataagtggttttgttcttctcagtgtggaagagagaacaaagccagcgtgaagcgtgggtgggagaagcagatagggtagagctgagtgctgcccagccagccctgcaccagggctcagtgccccttattagggtgccagctcagccgccaccacagggctcctgccagcggaggctgttttgactcttggcttcctttctcatcttccagagcatccccagtccaccttctttgctgaaatggaatttcctctacaaagcttctctgggaaagagccatttatatgactggttcttgtgctctcgacacaggaaacatgggtcaggtggcagctccgtggtgcggcccaccccctggtcagccggctgggtgagggagccagcccttgctcctggctctcatttctagtgggtacaaagaggggcctgggctgtggctgagagtcatcctgtgtggggagaagcggggccacgcgtggactctcagtcaaggctccctccacatcttctcccacttgcagtgggggacccagggtcacaygtgtactagtttgatcttttttggtgaaacagggcaagtggagtgagcgcagtctccattcaccacccttggctaattgcagccattcagtgcatttgtattgcagggacaatggacaccacacattccattttcctcagcactcaggcgaggaggagacctggaaatcacatcatatgtaagaaagcgaaggcaataccaattattttaaaaaggctactaggaaaagtcttgtaaatacaagtcaatggacagaacaaaacaattcatatgctaaaaaaaattggatggaaacccataattactttaggagttatggtaataaattatttattaatgtaaattatttcacaggcaaagaacatacaggaaacttgagcagaaggatcatacattatgtataaaaaggaattgtaaaaatattatagcagccctccttgtgccgccccagttcaggtttgtccgcattttaattataagcccttactttcagggtttaattacttggctgttaaagtctactctgtacataaaagggttgttccctggggcactctctgtattaatttctacagggtaaaccagttggctgtgttgagctggggaggactaagagattttgctttgagatttggtagcttttggtctttaaactcagccactgtttgtcatggaaagtggaaaatgattgcgcattgcaggaaaagcgtggccctcagagcttgagtgcttttgattcttagaacaaataaacgaagaatcaaaatgagtgacagcaataacaaaatcagagcttctcaggcccaatttttggtctctgccactttttctcttttgcagagacagccattttgaatgtgatctttgggccaggtcctccagtaagagactgctcattaaccagtgtaggctagaatgagatttgttttcattgaaaaaaaattacatccatatgtaagtatgtatatatatatgactttttagggtttgctttattatttttatttttattatggtcatatgtgtgatttttaaaaatctctaaaatagtttgtccataaagggtatgtaaattcttccttgtaccattcattggtttcaggcagtttttcaggaataataaagcacagaatggaagtagatgtaaaatgtggttggcacatggtaactgttgccagtgacgagtgaagacagagcttcccagggctgccttcttacccaggttgggctcacctgatggggaggggaccacaatagtgccagaggacagggaatggccactgccagcctgtctgggtgccatgccttccacatgaagaaatggtcaagttaggcagcctggcccaactgcaagagcatgaccttgggtctacagactaggttgacgtctgggctctgtcatttgctggatgtgtgtccatgggggagatgtgacatcgttctgaagcccagtttcccccatcagtcagatggagattgctgtgacaacccatgagatgagtcacgtgcttgggatgcacattcatgctctttctcagcttcagcaaggaccctattggagtgttagctgattaacagtaaatatgcatttattgacagtttcgtgaaaagctctgcctgtcgccagttccctcgtcggtttaatggcgccccgctttgctgtgtacatcagttaagagatgcatcaccagcagctgcccgtttcacttgctctgtgcacacccacaatcaggatggaaatccagaggagatggaccaaactgaccttgttgtcccttcagagttcttgttgccagtgcaaatactagctgttccctgtacatttatgaacgcctgtgggagctgaggggtagaataggaagtcctggtcagacccaaaagggctgtcacaagaccctagtctacccagccttgtgcagatggtgagattgwggcccctcttcccagtgccccatctggtgtggtttttaactgtgaggatctcactgggcatctttttgtaagagcaaagacttcccagaagcagtggcagctgccatgggccaccccaactctgctggtaagggcagggccctggtaatggctctgaaccccgatctttgtccttagtagcttctttgtcacctcccagagtcctgcagacccgcctgccttcttccttggatgtggggcctgatggtgcattacctctagccatcggaatcccttgttccttgtgccttgtgtgaggaacttggtgtcctgtgttgctgtccccgaatccaagacacagctgccattttacagtccatcccaggtgcgtgggcaggacctgaagctgaggcctggcaggcaaagcccgaggactttttgttcctgacactgctctgaactgagtctccttctggtcatacaggcaaagagactctccagggagccagaggctctaaagtccatttaaaaacagatgagacgattgtgggggagctcatgtcattgccctgcttgtgtccccccsacccccatgttcttttcgtaagatcagtttagcaaaaccgccttcagaaagacacctcggctctcttgattttcccattgatgggttggtgagcttctccccaaaccaagcatagaatctttgtggccctgaggccaagttagcacaacccaacccacagggcaggggagagatactcattgtcagcacaagtagataggtgtgaaatgtaagaatgagtcagctggttgtgatctgacagcaggcttgctaatcggggcatttcgtatcttggtctgtacttgaggtgcttaaccttttctggaaaccacattctgtacttatgtgaccataaggcaccatcgaaaacatagcacagagctctctagggctataaagctcctctatcttttgaaaatatgaaggtttatagtcccccaagaatctggagccctgggaattttccttcaaatttaagggtaggaatggaaataagaacatttgaggtcaaatgccattcgtattcctctgagtgtttttcttgcttcaagctctaggatctgtgcacacagcagtcttctgcccttcttagtcaaacggtggcaggaccagagccttgtgagtgcgaatttgggaatttgagtccttgtctctgcatatgtaggcaactcattctcctgttctttgtggcatagtcaaaagtcagaaactgcaagctcagtcatcaaacctcagctttggaagagaccttgcttacctagtctgtccaagactgtgagagaactgggcccagggatgcttgtgtgttcaccctcccatctgcaggcaaaggctcttgtgtgtttacgctacacacaaatgcacacgctctcgtgtgtatcatttcagacttgtgaagataatgctcagtggggacgtggagaagctttacatgccctaaaggctaaagcaacaggcgcagcatagaactgaatgggctggtgccatgctctcaggctgtgggccatcgcgctctgctcaggtctgccaggggcttggtgtcaggctgcagatggatggggggcccttctgcgtatctttaggacacagctgatgggcccttgcgtgttctcagggagaaagtgggaggcttcacactcatcttgttcataggagtgagttagcttctaaggcctttgctagwggctgtccatcaagagcatgttgtgtagcttgagaaggaagccctgagggtccccatcctgtcctgtgaaacctctgatgggtgaagtgatccttctccatacttcttcctggaattagcccaaaccaaaacataaacaccaactttcagtgttgttatgaattcaaatttgtagagaccagaattgtcaaccctcctgaagcttctgggcagtggtgctggatggtctggatgggccgccattcggacagatgtttgagaactcagttctccatgtcatctgctttccagaacagcatttctcaacatttttgcattgaaataacctggggagcttattaagatgcaaatgcctacccagagagactctgatttaccaagtcagagacggggtctagaaacctgcattttaacaaacacccccaaaggatgctcctgtaggtggcccagaagtcacactttgagaaatcctagtcagagaagccaggtttccattccagccggattccacagaggctggcaccctgttgcagctctggctgagtcaagcctcagctaggagagcgttttccagtaccgttaattatccttatgatgactgctgtttttgagagcctactctatgccctgtatgagatgcctatttaattctcataatagctacgaggaactgagtaacttacagagctgaggtttgaacccaggtccttgccctttccactacaccaagtgactgttgctcagtagactcctacatccatgacaattgtgacttgaaagagttatagttgtttgtgcagaagtgatattgaatggagggggcgggggcaccctgtatcctcttctcggaggcctaccgaggccctttgtatggtgtgacgtcagggcctagcgcttggggcagtttgccatgaaaaattagcttctattcctgtttcttttgtctggtgatctgacccaacaaatcgctttctgttccctgagcgaatggggaaaacacagggctaaacatagccttgattgtttttacttttctcgtattgtacttctcaaagcgataaagatagaaasaattacaatattatctgcctgcagactgagcaagtggtcacctggctggtgttgatacacaatagcagtgctttgcttttccaaagtattttagacgtgactctgtcaaccccatctccttgctgagtcacacatggccacatggcccaggtagggcagacggttcagggcacagtcctggttggacttacctggccaaggaagactcacctttgccaaggacaaaagacaggtgagtcccagagaacaccgcatcctcttgtagcttttatctgcagtttgcaatccactacctcattcatgcaccaccaactaaggtctgctgtgtgccctgctctgtgctaggcactggggagccacactggggctatgcttgagagtctgtggcttaggaggagaagtagatgtgtakgcagatcagtaattaaagttcaggtacatacgtgctgtacgatcacagagctaggagaaaggtgtatcttcagaggagctttgagttggctttttaaatgaggagactcttggtgaaaggaagataaaggcaggaaaagaacggtccaggcctttgcaaaggtgtggaatgttctttgcaaaggagtgaaagagctgatgtttgggggaagctgcaacttctcttcacagttaaaaactgactcttcgaatcttccctacgacaaagaaatcttataggccttagaggcttactctgtaacacagaaggagtaggtcctgtaggaattcatcacccagctctgatgcccctgggttttggtagttacctcaaggcccagcaagctggacttccagcctttctgcatatagatcttatctgtgcttgttcctgcagtctagttattaaactttagttttataaagaatcgctggtgcataagaattacccttttgggttgtctacacaaagctggggggaggagttgtactttgtgggctggttcaggaattcttcaaggatggttttgactctatatgattcttttctgacctccactgtcgtaggaggtttgatacctggagtgtagggtttgttgtggggaatgatgtggagatgggcccgggtgccagtctgaaatgcttgtcttctttcccggaaacagtggctgacagctgaagcgaatgggccacaataggtgggggcttcagaaagttctctagaggcrgtgaggaggtaggcctggagtagggaggccctgaggggtcccttcaagaagcaccaagatcgcaggctggccatgggaaaggaaggcagatgggagggatggtgtgttcctatttagctggctcccgattccccttttggaagtgatttccctagagatggggaagattccaggccagtggtgcaaaaatggaacagaaaatggtatcctctgagagtgggatcaactccttttcatgtcacgggtttccccgaggcctggcggagacgcagtctgtagtatgtctcaggctccgtgagcaccggccaccctcgctgctctgtgccaagcccattggtttcttcctcagccggccacattcctggcccatctggtgcctcagtgccttgtctcaaaagagaagttagtggccagcattttgtatggcaacttcctgaaaacccagaggagccaacccagcagagggcgggctgtgggcccccgctccgaccctggctcacttcctgagttaagcaagggcacagcacctgtgggcttggcagtcacatcccccacatattcgataatacattttttctcataggacatttggagactatagaagaacaaaagagaaaaaataaattaaccaaccagctgtctgccaatccactattaacatttcggtttatttctttcttacctttacatacaacagacatattttgctaaataggaatcacaccctctatacagttttatatcctgtttcttcatgctcagctttatattgttagcatttccccacatcatttaatattctttgaaactctgcttcttcatgctccatgttattccttgataatttatttaaccggcccctactgtaagacgttttaactatgtttaccattttgctgtcactcatcattttgatgaacatcatcatacataaatcttcacttttttcttaggataactttctgttttcttttaaatcagataactgggatagttgtgactgtgtcaacaagagtttctatttcctttaattttactttatagctggtcacggtggctcatgcctgtaatcccagcactttgggaggccaaggtgggtggatcacttgaggccagragtttgagaccagcctggccaacatggtgaaaccccatgtctacaaaaaatacaaaaattagctgggcgtgtggtacatgcctgtaatcccagctacttaggaggctgaggcaccagaatagcttgaatctgggaggtggaggttgcagtgagctgagattatgccactgtactccagcctgggccacagaggcaggtcctgtctcaaaaaaaaatttttttttactgtatattagtttattggactttcaactgctgaccagtgtcaagttgaaactgatttaatagaatggtgaatacccaaagggaatggtttccttggtggtgaagcatgtttgaacaacctaaagcaacttgcaggaagaggtactttggatgatttttggacgtaattgatccaatccagttggaggagcagatattgagacctgctgtgttcaggccctgggaaatttcagagatgagatgaacgatgtatgatgaagaaattggatgtttagcgacagtcttgctttgttgcagctggcttgcctgggcttttggaaggtttctctcctgcatcttcagcttctgaggccctctatgaatacagcctctggacagttctaccagtgtcccctgtcagggtccccagcccctcagtttgtatctcatgaccttggcaggatgcccaagaggaaggagtaccaccgttagctctgctgaccttggcaggatgcccaagaggaaggagaaccaccattagctctgcctcggctttttctctgggctcctggccctccctttggtctgcacaggtcattcccgttgagtcaatcaagtagctgctgcttgtgacgctcagctggggtatgtctcttggtgccctttgaggagtggccactggtagtggagataggtttgtagtccttgctgcctcgagcactcatgggttaaatctcagttttctgcacctgagcccatcttgcctgacccataaactccttagggccagggccagagtcaggctcacccacagtccacctcagcgctgcagtgtagtgaaaagggcctgcgctctggggcctgactaagctgggtttacatcctgtctggtgttagctgtgtggccttgggctagttgcttagtgtcccccaagccttggtctcctgatctggtccaggatggtacatgcactcagggggctgtgtggattacacagcccagctgaatgctcagtgagtgatctgcattgctgagagacccggcgtgcatttaaatacctaccaaatatcatttcaggtttcacttctattcttctcttgactgactcaagccattcacatgtgcatgatttataaatatatataggctcragaaaatagtactaacaggttgttccctgatatcatggcatattttgtaactttgcttttatactgtaaacttgaatacaagaactatgtcaaatttatctttgcatctcctaaaattcccagcacggtgcctgattccatagtagaaaaacaataaatagttcttgaatatttcacaaaataaaggttcgtgtgcaaatgtagcatttcatagcagggttggttatttatttgtgtattcaagtaaagacctgaatacataagtttaagtggttcccttaagtctgtgaagcccaagacttgttcttagagattttaattgctttaagtgaaaaatcgagtgaacacagagaaagtgctgtgattggcagccattggtgacgctgatgttgagcattttgacggaggtgacctaaatcagtacaagttccagcttctattatcagcaaaggctttcaaggtggaattggggtgaactaacctggcagtgccccagccatcttttggccttggccatccgagctgttgagacatctttggttgtggtcttctgccagggcatcgagtcccagtcctgagagctgcagagaacctggtggcacttaacagatgtcttgtcccgactctctcatcagccaggggcagggttcagggcaagtcgatttcccacccataagatgagaaacattttggatgaaaaatattgctttggattctcctgggaggcagtgtggtacactggaaagaaaaccatatcaggagtcccaggggtatatctggattctaggccctgctctgcttccaacttccaactcaaagccttgggattcacttctcctctctcagcctcaatttctcatctgtaaaatgaggttggactggatggtttctaagggccttttggctctaagatactgtgtttgaaacgggctgttggtgtggagataataaagggctggagtgaaggtcttctcaaatcctgttttctccttgtcatttatgaaccagaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaagatggcacaggtaagagccccagcagcctggagtcaccttggtgctcactggagcctctgctggttctgggccgtcctagacaagcatagattgccagtttcagaaatacccaggagtnggttaatttccttgtttttttaaatcctattcaaagaaagattatttccagttggtttttaaaaagcgtttatttctatttacaagcaaatattccctttcactgtgagctcagtgctaggggtacaagggcaggtggatggtgagaggcggggtgttggtgggcagactcactggaccaaacactggtaatcccctccggcccttcactggagccgtctctcccaggaagccacccctgcagctgctgcaagagatatacacacacactggggttcagtgtcccttggattatgctgatcctgagatcagggttgtgggtaatggtttccaagagctagcgattggggggacttattcctttgattatactgttgaaacatgaggccatcaggatgttgtgatcaatatcctctgagctgcctctgcaatcatccttgcccttcactgtagaagaagtatctggccacacgcccctgtcacttggactttatcctctttgtcttggagctctgccttgtgctaacactgatcttggatattgatttgaatgagatgaacttggagttaatactctgtcatcaggagcgtctctgagcccgagagttggctgcatctggttctggctggggatgaggaagtggtgctggcccttgtgacctctgactcaaggatgggcggatgtgatgggacacaacactgttggttctgtgttcatccaggaggccatcggttgcttaatgccacggtctgaccatcatcttttctggacttatttatataaacattggtctcgctgggtttcaaggggtaaagatcttcttgttgacgaagatggtttcagaggggttggttggaggggatggccttggtcactcagcattatggccagatccacggcaggcaggcttatcacgctcgctgcgtttcaggtgggcatagctgacttccttccaagcccagtgttgttctctcagttgggtcttctttccttttacaaagaacatgcagtttctcttcatggggttttgctcttctctcctttagttcctactcccaacatagaggtctacccagaaaagaagaggtgcaggtgtcttaagtctaaagcatacctggccccagagtccaaactttctggccacctttgttcaagagcctgggcactggctggggcattatgggagggcaagatggtggtatgcttgtgcctcccctgtgtcagtgggatccgcttgggggagagcctgaaggggtgtggggcagagctcttgcctcttctcagctagtttccatttcttccattgtggctctaggcgtgtgccaatctttttgctgtgtagtggaacgtttttgactttactagctggacagggattgaacacatttattggacaccaagaggaatttcccttctccagaaaaatttaaataggttaaaagtctggaaaggtgacagatttgggtgacttctgaggaaaaccaagagccccgagttctgggtatgataatggcttcagctaaatttttaatactgagcatattttattacctaatcagctagataggtaacaaaaacaacatgcatgttattatattttactagccacagttggaataacaccactggcatcattggagacatttcttgacctcgtttggttagaaactatttaaaaatacattgctcagtggggctgcrcccagttgtatagatggcttcatcagccccaggcaggcctcccagatctgggaaggtgtgcggagcctgaggaggctgctctggttcagcctgtctgtccttggccgcctgcttggcagtgggtctcgggcacagggaaagtagagaggggcctctggaaagtgtgtgtgcccaaggcctatggccagagccctgaggctgggcccgyggacgctgagccatgcccccaccaagagtctagaccctsgtcagccctctctccatggggctctgcctgctttggctctgccatcagatgatttctagcctggggaggtggaccttgcttttctgtggggccctgagaacgaggcctagggtatccctgtgtatttatcaagagccctggcgagtgcacrgccttgtgcgtgggaacctgatgagctgggcatgttgctggtgtacaaggactaacgtgttgccagatggccagtgaggtgagaccactggccacagaccccagcctctgcgtgctgtggcttcactcaacatttgggaccactgagaaggggttggggtctgctctgcatgcccatggaagcaaggcttggagttgggctttctgtatctttggaagggtaggctggtacccaggtgtggcccacgcttccttccgctgggctctggcttctctttcgtgggccttttgatcttggtttacacattcgcctttgggggtgagagctccacttgtgcattcttgtaaaggcgcccttcgtgtgtgggttctgaggccaggtgtgtgagagcctcgggttaaagctgcagagggccttttcagttagacctttggagcagctggccattctgaaaagctgcagctcccctagaggtcccgactggggcctagagcagatcttgagggtgtgtgtgagcacacgggggcttccctctggccatcattcggtgtggccagatagactgtggttagctggagcccctccaatccgccagcaggaaagggtccagggagagaacccgagagagtaagagggcaggaagctctgaggtccaaggccctgccctcatctgtatccacagttgagttcagcaggagcaagtgccctggggtgtagactctgctagaagcagaggatatcaggagatgtgacctcagagcttgtccattccagtctctcttgaggaaactgaagwtctcttggtccctgtgcccatcagagtttttctgggcatggtgttcacttttggatctgcatttagaaggtgacattgacaaaccagaaggcctccagaggtggggccagagactggaagccctaggcaaattgcctgacatgtctgtgcagcagatgccaccaccgccacaggactgtgggaggagcaagggaaacaacatgtgtggataatgcactatccatatgggtgtgtgtttatrtatgtgtatgtgtccacatctgttgatatgcgtgtgtgtgtatctgtatctgtatgtacacacactccccycagtgcattggctggcacaggccgggtgctgacagatacttatgatcatcgtcacagtcgcaggacttggagggagggtgtgggctgtttctgggtgtctccagaggcagaagtaggagcagagggtggacattcctgggaggtgccctcagtctgctgtaagaatgcctgtttttctttgtttgtccagtgttttccctgtgtttccatcctcccttttctgttcacgccactttctttgtcttgtttgttcatcttcttgcctctttgcttttcttttgtaaatgggaaggaggcctgccctgcagctcagctcagcctgtagtcaactcggtgttcagagcccagggttatgaaatggtgacaattggattcacccccccttgtcagagggagttcgccgtgtgtgagcattctcctgtctgttgcccttgaaactagggtggaaatatcctgggggcctgctggccaccctgccccttcctagccacgtccctggggcacagctgtccagttaatggcagtgggggctcttgtctgtcggggatgagacacacagggtggggtgtagatattgctttcagattgtctttgctcatgtcttctgaaaaccccagtgccaagagagcaggcagagatgctgaatgaggctgcaggtgagccggccatctggatcctgagtcggggaggctgactgtagcgaggaaagccctaatgggggaaatgacgcaaggacctagtccagcagtggccgccctccctgtacttgtaattacaaccacttggttccacagagcaggttgtccaaaggcagctcagaggactggctatgctgcgatccctgcgnaagcccggccccgtgggcctcctgcacagctttcctccttacgtggtgtttttggccctcctggctggtgttctctgtgaggctgcagccttccttttgcacaatgacaatgtctgccattgaaggcagggcccagcctgagggtgtgagttgtttattagcaggacttttgctgacattttccttactgcttttttgagacctggtttgaccacccagcattggttggctcccagcaagacttgagccatacgcggccatttagacatggatcacgtgtrtgtgagcaaagatttcagaaaaaagcaacaattaaaaagttcacccattgaatgcagtccccctaggtgtcatagtccctgctgtatttttaactccaagctggtcagcttgaaagagcaacaaattgtacttctcaacagtgcttcaaacagaagcaagatgtttgtggggaggggtcgggatgtcgaaacagaggtttgattgattgcggctgcccacacactgagtccccgaacctccctgagcaggcctcagaacaggcagcaactgttgtgttagcagatgtttgagggaccgtgaaagctggccaggggcagtttggggtagaaaagaagcatgagagaaaccagcatgccagcacgtctttgggaagcctctgagagccgtattcctgggggtgagtccaggagagctgggtgggcggggccgcagggactgggcaggatgaggggttgctgcaggaagttgggagagcttgtgcgtatgctcatcagtgactcgcagctctttgctggacaggtcctccccaggtgaagccccccagccagcttccactttccatcttttgtgctggtggggccgcctttgagggacagtggcccttsttggtcgccatggggttggctacatgacttcttgcgctggcacccccagcagctgcaggccagctgtgcctttccttggccaagttcctgtgcggcaggcccagcttgcctgcacctttgtgacttttcctgtccatcctgccagtggctgttcaccttcagctgcttagggttcccaccgccctgcaccctcagcacccttcctctcagggtgggaagctgtgctgacggcaagtagaggaattcagaggtggagcaccccttataacacagactgcagacagtgtgaagatctagtgagagaggtaggcatggaaagccctagaaagcccattgcaatgaaagaaatgctaaatacaagtaaaggcaaaaacttttgtgggcaggcacacgagagtagttgcttctgacttagagatagttaggataggcttgaacaaaggaagagagcctgtaagacctgggctgtcagagtttagggatgtcaagggggcagctttggatgctgaactagcactcctccttccgtgctcttgacagacattgctaatcaatcacggcagccttttcaggtgaacttagtggaggtcttagaatcctcctcttggcagtcttggcagccattgctaattgatgggtaattgaacgtcatccaccatctctgttctaatcccctcacttgaggatgaagcctctagagtacaggaagagttggggccttgcccaaagtcacatggtgaggcacctcggaaggtgggaaccctgacctcttgaccccaggctcagtgctcccactgctgtgcttggtcctgggtgaggaccaatcagctggcccttccagaggactgatgcacatggggcatagagagtgtggcagtgagaagtgggagcttcggagtcagataactgggggtgtgtccccattctgccacttttgagctgtgtgccccaggcctcatgtctgtgtctgtaaaatgggaatggcagtgcctgttgctcatgagtgtgggaggaatcatgtcgcatggatctggcacacggttggcactcagcaaatgccagctttgatgaacaaagaaagcccgggcctgctgcagcctttcttctgttgctcccatggtagctcgccccacaccctctgctgctctgggcagtgtcctgggctctccactcttggtgggccgggatcctgccagctgtggcgcatgctggcatcaggcttccaggagactagtttcagctctagtcctcatcttccctgcttcccttccttcctttccctccctttstttcctttcttttgacggagtgttgctctgtcacccaggctggagtgcagtggtgagatctcgactcactgcarcctccgcctggatccctcctttctgtctctagtcacagccctcaggttgcacaagcaatctgcttaaggtcactgggatcggggccgagtgttgccacaatagctttgatctcctggggaagaggagttcatctggggactgctaaggaggcagcttttagtgccacttggtgatttccacgcttcaattgagagccatcctgagcagagaatgtttgagaagctatgagactctgggaggccccggctctctgaagtaggggccctttcctaagccagccgctcagatgagagccccggccatgctgggagtgctcttggcttgccaggccctgctctggtgctggcaaagaggcttgggaggccctagcaggcgctgcccttgggaggccacagcctatgggccagagggagaacaaggccttaccagctgaggcctcaccacatctgaggacatcgccagtcttgcttcatggaagccagagtaagaaaggcttgtgggtcagctggctcttgcccctttgactggttcaactccaagggcccacagaggagggtttagagaaaccctaatgtcgttcccaggcttctgaaggagaagcagggagcgtgggctgagacgaggagacagagggctggtgggagagcagggcctcagcctggagccctgcccatggagtgagccccatcctcatcctggacaactgatggaacctcttcatggttcattttccccatcctcgaggaagggtggcgacaccctctctcactgtgttaaatgtctcattaaatgaattcatttgtatgaagcgcttggagcttagttctgtgtgcccaggacacgtgctcagtaaaagttggctgccatattgggagtcacactttaggagtaaggggagaaatttggcaaaaggaggggcctgctgctcatccagtgtgaactgtcctcccctcaggaattctttgtctctgcagcgctgaggtgctctgccgcatccctgctccccagaagaaggcctcacctgagggcgcagctgagttgttgagcggtgctgctggggtatgagtcccgggctctgtaactctgagggcagggttttgccttattgccacstggtagaggcctctcatatcctaagggaaagagaggtgcactgtcgttggaacacagctgctgttggagtcagaagagctgggtttgagaggcactctgccacctggctgtgtggtgactgtgagcccgttgccctgcttctctgagccttgggtttctgaccatgcatgcatctgcccaggtgtagccatgggcgtcaggttatctgggaagccaacacactgcaggttcctagacgttgtccaagagagtctgaattagcaggtctggggcagagccccagtacctcggggtcccagaagctccctakgtgagtctggggcttgtgggggcagcagagatgggcacattcctagcccagtgactccacagatgcccagggactagttttgtgtcatatggagatggcattgagagttcaggtccctcagtcaggaggtaccagctcagcctggattaggaagggcctgacctggaggagggatccaggtcctagggcgagtgcccactgagctgctgtacccagcagagcaatggtgtccccgcctgccaatgaaacttcccatgcaggagggctcggggttaacttatgctgagtcgagtacaaggcgctgcttcagaaatgtctggaaagcctgttctagtatatagggttgaacgtttccgaggcaagttctcatgggtgggttgttaagggcaagttccacaccctgtttgatatcctgccttgtgtgcaacggcagagtgaatgaatgacaggaaccctgagtgcagagtagaagcattagagggttttaagcaggggagcaatagcaccccttaaaaagctcctttgggacaacagtgagcagcatggactgtaggttctgggggaggtggggaggccaggcaggaggctattggcaaacatgaaggtgggctagacaagggtgggggcagtggaagtggtgataggcataaggggctcaagaaatgttctcgaggtgaaagcagcagggctggcttccaactcaccctagtcataggcctcactgggcagagaatcaattatcctaatccccaaaggtggcaactttctttaagctaccctgtttagtgtgtgctcattgtaagtccctcttgttatttaacctgcagccctcactttgactgtatttcttcttgatctgttctcagtagaactgaaatccagtggatcaccatgacctattttgtctctgtatgaaggtatctatgggactgtcttaccccccagtccttgcacatctgtgatttgctagcccagctgctccttgccactggggaggccccattccttaccctttcctgtcagccctcagtttgcaaacctctgactcctttgcccaagcttctctgttcttgtccatttgaaagtggctgcgcattctgaactctgggctggagaagggctgggggcagcttagggccacaggaggattctttcatggtttctagcgcttgtcacgctggatcttgtctcagctgtgccacatctggtcagtttacaacagctgggacagcagctccgggaaacaaggggcctgtgatggcctcctcgattctcctaatgaagcctagtaatccccagctgggcctcagaggatgcagcgaaagggaggcctggccaaccccaggaggatttcggcattccctgccttattcctgcttcctgatccgggacatcaggagaacgcctcgtgggaagcccctcccagcccgaggttagcatggtgcctgcgggctgttgagagcccagtgagggccagagcaggaagcacaaataggtgcatcacggagatgggtgtgggatggagacggagctgtgcccagagcccagcacggctggtgcctgaccgggccttttcccgacaccatgcaggctgctgccctttgtgggtccatcagtgtgaagcctttactttagcccacttcgcctttggcagcatgagcctctgtcgccccaggcactgcatcagtagagaatttctcctgctgacaggagcccatttatgtaccatttttgtggtatcagccatcyggaattaccactctttcttgcaacttcaagccacagtcaagaaatcagaaagcaaatgccacacgaagaacaaaccctttgctgcaatccccatgctggcgggaacttggtttgactagactcagagtgggtgttaattgcctatttatggccaaaagattaacaatgcctcctttgaaagttagacatagtagagctcttggataattcctttttgggagggggaggagtggcttaaaaaaaaaaactcttggaaaacaaaagcaacagttggttgcaaaatataatgcaaccaccagaggcttagtttgtgagcagtaacgcgagctcacatcagtaatgtgtcaccagaggtcatcaggcaccccaccctctccctgaagggccacagactgcatttactcctcatggagtagtggtggcggtatggaggcccccgctgtttccctgctggagctctgtgggtggagtgggtgaggcaggcctcctggatcagccagggcctgttggggacagaaaccagcccgttagatccaggtgaattcactgtgagcaatggttagctaggtttctgaaaatctgaaaagccaagaagagaaaacgaagtattaatatcatgcagaagcagctacaggaagctgctccccaccttgggctaggggaccccagggcagagactgcacttctgaaagcttggcagcgtggagtccattggccgcacagggctggggcaagacctgagaggcaggggcgccggctagctggtcccgcagaaagggaaggtgatgaaattggttctgtgaatgttggaaatgcagcaaatgggaagcaactgctgtgaatggagcagattgctcctgcaggtcacgcggcatggctgggtgacggtgacagcacaggaagcagacggggagatgtacggctgcctctgtcccccagcctggctctgctcagcatccttcagttaagcgctgtctaacgttctccagcggggcgggagatctcttctagcgcgcatcgcagctccgtcctagttcttcactcagcagatccttgcctggagtgtgctggccacctggcattcagctaggccctggggatgtttctgcaatgcagaaagggggatggatgtcattcaggcctacaacaggcaggcagggccctttctgatggcaatatttgtgctaatgagaatccagcaggccagcgtggtttggatcaccaggcaggatgagaggaggtggaatgggaagtggccagctttagattggagggacagggaggccttgttgaggaggtgacattggcacaaagtcacagatgatgagatgtgttcagctttgcaaagataatcagggagaatgtcctgagtagagggaaggcaagccccagaggtgggagtgggtgtggtgagtgcagggcatggcgaggctgcggtgactggggtcggagtgggcgtggtgagcgcagggcacagtgaagctggggngacaggttcctgagtcgggggtgcaagggatgcttgagatgtcggcagggccatcacggttggccttgcaggctggggtgaggagcgggctttttgcctggagcgcagggttggaatgccatcagggctctggggccaggatctgatgggatactcagtcacctgccttacctgactgctatgcttatcttccaccttgggggttcgaccgcagacggccccagggaaaccggttcaaggaggtcacggcaagaaggcacatgagggtgaaagcataccagagagatgcttaggcagggccccagtgtcggggacaggctcagaggaagttagtcaggcacctctgcaagtgcctctcatggtgatgagtgtcaccgcccgccctctgttgctggacagtggcagcgagtggcctgaggctcacaggggtgtctgagttctcccctcccatatctgcacacacatcagcctcaccctggctctgggaagtgggtcactaactcctaatccacgggccggtgtttgcagggcgtcctccctcgggtgtgtggtcctcacccaccctgtaatcctcacccaccctgtaatcctcacccaccctgtaatcctcacccaccctatggtccttacccaccctgtaatcctcacccaccctgtggtcctcacccaccctgtgaggggctcctyctgttctactttccagggaagaaaagggagtgccgaggccatgtacttgctggctgcgtggcagagcggtgagtgggatccactcactctttggccccgacagcccgtgggcccccatgtctccatagggctcccttcctggggtgagctccccaccacttgtgaagcacagggccccgggaagtctgggatttgccctaggctttgggttccctgacggtcaggtagggatggtgacrtcctcacgtggggctgctcccagcctttggcccaggacctggtgctcaggtggtgctcagaatgtgtggctgttacttaccacatcctccgggcccatcamctgatggatcagtgaatccccggtggccctgacttctcctcccagcccttgagcagactctgcatttcttgagctatgagcaggctggtaargccgggcacggggctcatagagaggctctgtggccagcaccatggcctctctggaagagcgctttagttctgcctggcactgcggttcagctgtcctgttgtataagtccgggacacgagggagaagggcccagtgatctggtgctctgccacactgagcggaggtgtgtggacagtgcgcgttacatccctcaagtggacacatccagaatgtgaaataatcctcttactgcccaaagcagaacgtttgtgaaccatttttttggtgactttgctgaagacctctgagcccttggccactgccttctaccccctacaccccccaaaatggcttgtcttgaatggcggggaggaggtccaagccagccctgcactttccccaggccaggggcctggctggcctccgctctcgggcctcttggcagctgctccggaggcagcaccggatgccctccactcacttccctccgtgagaggcgcctttggcacatcaggccttgggaaggagtggcaggaaaacctggcattctgtgtcccagaaggaaaaggcctatcagtgcccatacttgaaacttggcacacaaggggaaggtggtttgagggcacactgtaacggtggctgtgccgtrccgtgctccgccaggcctgttctgtgcacacttgctgggcccactcagcctccatgaggtcccctcttgcctcatgacccctggccccacttatcagctgcctctttgctcttgtgcctccctaggaagatgagacaaggagagcacccttgtgggttgcctgggtcttgtcgtgcctttctggctctgtaccttgtgtccccttgtggaaggacaggtcctgcctggcatgggcacagtgctgtgctcttgtctgccaggcagttctaactgaaagtgcattgcccgtatcccccttgctagttggtagccagctttaaacaagcctgattcacctagagagtttccatctcactgtaatctagaacagtcttgggcaacagaattttctgagaattgatggcaaataaacatgggaataaataccctgcggcaggggagccggtggctagaaacaccctgctgtgggggctgtggtcctgctcagaaacagcttaggccaaggggcgagntggccgtgtgtttggggagagcatttccgcagatgttggctgattatgcagcattaactgtttggcaagaaaaaatatctcatctgaaatggtgtgaggttaattgtcactcagcagagacaccagatcttcagcttgattcacgcagggaaaactacgaacaaatatgcatgccggcatctgctccaaacctaggacagcaggaaatggaaggcagtgtctggcctgggctcccctgctaggaggaatctgggctccagagataggtgggcctggtgtggggcttggtgtgcccctcaccagccgagtagccctgagcaagtcgctgcccctccctgggcctcagtgtcctcctccccatgtcgtgggagtgaagcagcctgatgagggagagctcctacagcaggcagctgtgcagtaccccctggagaggctcagcaccagcatggtgttcttgatcttattttgttgctgcttgtgatcttccagaagggtctctgcttcttatgaaatcttccatttgaggcatttctggaggcattattctcattagcttgagggcagtccagtgagggagagagcagccctctgccctgtgaccccgggcggggctgggaggctgtagtgcgagaatggggagagtcaggtgcctcgcaccccaggcaccaggaacaggagcctctcccagccctgcccggtcctcctcagccctgtggatgtggaggctcagagggcagcctctgaccacacaggtggagtgccaggccacagctgtgggctgctgactgttggcaggtgaggtgggggatgatttgcagaagaaactcacctgttgtattttctcctccagatagccccatgaggaaggcacatcgttatccattttacaggcggtggctgagtcttagaggaagcagtccagtgaaaccagaactcaagccacatatataatttaaaattcctagtagccagttattaagagaagaaagtgaaatgactttgaatagtatatttaacccagtatttccaaaatactatcatttccacatgtcatcgatgtaagtaaatcatgaatgcactattttatgttcttttttcttactggtttcagagatccactggtgtgtcaggtgacagcaggtctcagtttggcctggccactgctccatcattcagtractgcatgtagctttgctgagtggggctttggggtacgggtataagagtgtgggggggttgggggtcagccttggttcccacttggtgctgccatagacccttttcctctggaagggcccaatgccagctggtaaaggaggggctgggcaagaggcccctgcctgaggtgctaggtgctctgggytgtgccctctgcctcgggtatagcaggccccaggagacctgaggaccagagcgtctggtgcccacaggctgtccatggtggaactagaggttcctgggctcacctgctccaccctcctcgtggggctggtccgggaggcccggggagttcactgtttctctgagcatcctgccctgctctctgaggcctcttttctactgtacccgtgcagccctgcttagcctgctgttcctggcgtgtggccggggcagggctggggagatgggaggtggtgggagacggggtgatacaggaagacaggggcttctcatcagggggtgctgagaagacagctttgcagcatgacargccctgggccatttttccacggttgtggtcctgcatttcatgactgggctgtgcctttgtccccacatgtcccctgctcgagccactcgcgtcaggttctacacagctggccagctgcaagccccatccacagggagctcttcggggtgagcccccatctaccagcactctggaagtgagtgtgagcctggaaggttgcagtggcaggtggagggaaggccccagaatagaaggaatgtggcagaggtggccttggaccaagccgaaggttccagagctatcctgtctctggggcttggcagcctcttaaccatagttttcctggaaaattgcatttgtggctctggtttgccccacccttctgggagggattcacaggaatgtcagggcatctagcttatcagcctgggagcttcaggaacgtggccctgcccaccaggggaactttctgggccctcagagtctaggcagccaataacctgggaagctggttcaaatcagcatgcattgattgaacaccagctgtatacaactgcctgtgccagggctcagggaagactagcgtgtacaagaccccatccttacctgcaaggtaggtgcaggctacagggctggggtggagacagctgtgtctacgtagccgactataagccgagtcacagtaagatgagctagtcttgtcctctgaggatcgagattcaattctagattaatctctttgttcagccactatttatttacctagcatttgctgtgagtcaggcccttgtaggcaccagggatgcagcaatggagaggacagttagccctggcctcctggaggtcacagcaccaacaagtcatcacttagaaacgtggaaagggccatatcaccggcccacgtgaccaatgcccagggctgtatcctctgagccttggttttctcacccatctagcaggatccataatagcagttgccaggacgaaataagatgatggacacaggacctccatgtatgcatatgggattgttctaggaagccaggagtaggaagcgaggggcacgttttgagttctgcctgtcatgtgcagggcctagcactggctcctttgcaggggagctaagaagctctctagtcaggggaacaggcttgggcagcccatcagttggagtggagaggagacacaggcacatagatgttcctaagaccaggagcagacagttgggctggaactggggttgggagagccacctggagagttgaggctttattctgtgggcagygaaggatggccctgggcaggtggccagggacttgaacctcactcaggtgatagacaagtttggggcagtaagagaaggctatgcccacgcctttggtacccttcagtggagaaagggggctgtggaactgtgcagagcactggaggctgtgaactgctggggcctgaagcccttgggaatttcttgcctggttctcaatgagggtccaagagcctggtgcacacaagcgagggccactggctggggctggcctctgtagggccagtcaggtgggttctccctctaccttaccaggaggggaaagttcatcagggaaaaaggagctttgtcaggtttgtccttggggagccaacctgagtcagaaatcaggagccgagaaagccagaggcaacagtcctggatcgagcagcagcagaaagaagctttgggacttccctctggccccacgcagtgagaggatggggacttctgccctgggcagctacttaacctctctgtgcctcagtttcttggtctgaaaattgggtaaaagcagtgcctacatacagcaagtgcctaataaatcattgttttggaatacgggactatcccatttctgtggatggctggggtaaccactgagcatgagtactgagggcctggccttgggcacagccaggtcctgtcttttgccgtccttaggtgacttgctgagggccggagagttggctagctttgtgccatctgcgcagagttctaccctcagagctgtagccctgcgggttttgaagacttgggggccttgtagcccctggtagaaaggcagattgtgatggcggatctgggcttggagcccaggtctctgccttcccggcccagtgttgaagctccccaagctgacctgtttcctaaaggcgagcagcatgccagggtgcaccagccaccattggcttttggccccggaggcctgctttggctggggttttgcccacttcccatgcctggggtaagcgggccccagctctgaacctcccttcagggactccatggaggtgctggaggctgctctctggcaagtcttgtgcttgatctgctggtgtcaggcagccctgggggccagccctaggggaggtgccagtgtgtgcaagctccatcccttctcaagtggagaccggcacctgctcaccacaggtgtgtcttggccargtgaggcctgagcctcaagctcctcagtgcctggtgctgtgtgaacctggtacccaagctccctggaaagcatggaggcatccaggcagcactgaccgcagggcctggcacggtgttagctcacttaaaccttgcagtgttcatggggtacactgacgaacagggaggctgggcatacaggtgtcccgtgccaggctcgggagacctgggagatttggcccagagcctcctgggttggtgggaggaggtgaggagcagtagcatcggtctctggagacgcccgagggtagaagcacagggaatataggctgctggtaggcgccctggaacaaaatgagccctggggtaaatgaaggcccatgacgaacccttgttaaaggcccaaaatcaccatggaaagcttccagctcccagagtgcagttcaccttccggcacgaagacatcacctggcagcacgatgggacttcagaacctcggtgcccaccccagacctgccggatcagagtctgtgttttaacaagaccaccaagtacatcgcgagctccttcaatatggaaagtgctgaatatgggagatgggccctctgtgggaggccacctctggtttgtctttggtttgggcagccctcctctggctcctcttgcagctggggacggattgggcctgttctgcagaggtggggccggagccttacttggcagccgctccagtgctggcctttctctagcctctgatgttggtctcctgctcgcattgtctcttttcctaggaacgagygcagtgtggttcatgtcaggaaccttagccagagctctgtacctcctttggcctaggccccactccttggaactttggtcarcacacaaatgacagcactgatggctttggtcatgcacaggcttgcactttatgtgtgtgtcctgtctaccactgcagctctgagaggcagggatgaggctctgggaggagaagcagcctgccttgtggtcttctggggtccacactcacatgacattgaaagacaaggacaagaaggcacaggcttagatttgagacttgcccctcagtgtgcaaaggactcagtgaccgtttctcgttcctgctctgtgtgagaccctgtttcacctggtctaggcttgtagacaggtgggcattccaggcttgaggtgcggtgaccaagcagtggtgacagctggcccttgaggccagggcctgtacctgtctggttctttaactagacctctagcacctaccaaggtgtgagtggtttcccaaaaatcgattgattgacaggatcttgctctgtcacccaggctggagtactgtggtgtgatcgtagctaactataaccttgaactcctgggctcaagtgatcctcccacctcagcctcccaagtagctgggactacagatgcatgccagtatgccaggctaatttttaagtcttttaattttttgtagagacagggtcttgctatgttgcttaggctagtcttgaactcctggcctcaagccatcctcctgcctgagcctccgaaagcactgggattacagatgtgagctactgtgcccaccctctaaaaatttattgaatacatggatggatggatggatggatggatggatggatggatggatggatggatgggtgggtgggtgtgtgggtgggtggatggatggatggatggacggacgaacgaactcacaaactgaggcaggaggcctggattcttccccattgggcacatcagctcctccattgatgatacttagtaagcaaggatgacagcattgtttactggggacagtgtggcaggcactgtgctaagcgtttgtgtagctgtggattatctttattacagccctggaaagtgggtattgttgtgcttgttttacggaagaggctgaggttcagagtagcggccacggtcacaggaccagctgtggccatgaggcccatgcttgttccactccccaggagggggtctgggcagggctctgggtgccaggcccctcccatctcaggtgttgtccacaaaggggtctggtccagtgagggctagagtcatggaggtgaggggttggctaggccttcctgccttgccgtggtggacacatgaggatccctggtgtgaggcagccaagcagccgggctcaccgatcggagcccagacctgggatggcagcagggatctcacatgacgtcatctagggagcttgctctggcccctgctaggccagccgtcagagccatgtaagacagtctaagatgacagttgtcactgttgtggatgaagcaggctaagattggatcattactgaaatctgaaacttgaatttaagtggggacaacgagcagtgtccaaacgggggcagtaatggtggccttggtagagcccaggaacctgttgaaggaaccccctcgtgcttttgacagggcaccagaggtgttggggtggtggtggcagaggacagtaaaaggtcccttccctcctccccactgccctggccttgaggcctagagagacctcgcagtgcgggacagtggctgtaagattgtctcagagcccaccagctgggagaaggaaaagcacaggacaggcgcagcttttattccaggtgtcagatcctgtttgggccctttcaggaggcctggcttacaaggagagctagactctgcctttttcctctgcagttgaggtgggttagagggcagccatgggcccttctgctcctgggcctctctcaaccttctggggaccattctcatcacagcatgacctggggaacactcacagaggacagaggtcccagtgtctgttgagttctgtgtgggatgcgacacacctccgtttaatatgctaactatagatctgctgagtggacagacccctggaacctcctgattcaggggacattcactgtactcatgactccagttatggccatgtcttccaggagtggtgacagctgtcacctcagagaaggggtcagcacaccatagcccacaggccagatccttccattgcctgttttttttttttttttttttaatttcagtagcttttggggtacaggtggcctttggtttcatggctgaattgtatagtggtgaagtctgagattttagtgcacctgtcactcaagtagtgtacattgtacccaatatgtagtgattgcctgtttttataaataaagttttattggtacacagctctgcctggatacatacatgttgtctccagctgctttcatgctacaacggcagggttgtgtagtggcagggctgggtcattatgacagagcccgatagcttacagaacataaatatttactctctggctctctaagaaaagtttgctggcacctgatctagatgaccttacgtctcgatttccccatttggaaagtcactggatttgcttggcaatttctcaccaaaagctaaagctggccctcgatagggcccaggaatgtggcagggctacaaggcagctggctcggctgtctcaggctctgccgtgctcaccgttggcctcgagtgggcccttcccatgcccccccaggtgataagcaggcatgctggcgagggggctgtgggaaaggggcacttagtgctcgtgaagcttggctaactggagccttggtatcagggtgagttgtattcaacggatctcagtgcacaaaagtgtaatttttacaatgaaaatggcattactctggggcattcctctggacgtaccagctgggttgcttgtctggtcccagtgagatgtcttttccaagctgtcttgtgttgccctcatgcttgagacagtgtgggccagagcgaggatggatcgtttgctctgcgttcgtttgctgcctcaatttcctctgtctcctgaagcattttggtggggctcttccgctccatrtggtggaacgaaacccaaacgtgaacagcgagggcagcactgggcttctcgccactgaagacaaacccctagaaagttcgctctgggccaggcacagcggctcatgcctgtaatcccagaacgttggaaggccaaggcgggtgggtcacttgaggtcaggagtttgagaccagcctggccaacatggcaaaacccygtctatactacaaatacaaaaattagctgggcatggtggtgcacacctgtaatcccagctactcgggaggctgaggcgggagaattgcttgaactcgggaggcagaggttgcagtgagctgagattgtgccatggcactccagcctgggtgacaagagcgagactccgtctcaaaaaacaaaacaaaagcaaagttgactctggcctgggacccagaaaactctgtcagccagatatcttctggccccttaggtggacagccagctcagaagttgctagaggagatgagcytgtggtaatggagcttggcccggcaaggtggttttgcagccactctgtgaaaataagggtggggatggttggctcagatttaaaagcctcagctggctgtggttttatcctgtgccccacctcaaagttaggcagtggaggctgtcccagggcagatgctgccattgtctgagaaacctgcagcagccagcctggagccaggaggctgttgcrtgggctggagcatctttggggacccrgaaatgtgttagaaagttcttactgtaaccaagaccacttccaccactgctattagctctggccctagcactggcctgttttgaaactgacaatgaaaagatgaggggcaaggaggaaaagctgctgatcagttgtatctctccctttaaataaagctgctccttgtggctcctcttagtccttccttggtgagcagctctgctcagactttaggcctatcatggctgaaagcaggaaggctagaggtggagggagtcacgattctccaaagggtagtttagcttcaaaggctgtatgtgtcctgcaagtcctgtcagtgtacactgagctcccatgatgtgcaagrtgctggcagaaggggtgggtgcacgtcagccaccaaacctgcccatccccaccatcgccatcccagtatctgggacacagctactgttattgtcatgccaggttaccaccacagacacagaagcacagacctaattaaataactcacctagggccatggtgccggttctaggcaggtaagggatttgaacttgggtggtgtggctagcagtctgtgtgctgagcccgtgcagcgcagcctcagtgggggcacagggagcagggtttgaggaccagcaggctggagaagctttgacaggcggacacggggagcatgggtggaggcagggaacgtggccttggtgttccatccccaggctgtggccctttagctcactgcactgcagttgtggcctgggttgccggggtgaagtgcagggatgttgctggaggcacctggcctgctcctaggatctcagcttcctccacatgccgtgtgcaccttcctccctctctcccacggtagtttgctgttctccaggacttgtatggatggttctcaaaggtccagcaccattaaatagatctcactaaggtgacacttctccaggtctgaatatgcttgtgtctcctagaaggggtgaagaatactcctcttagcccattttgcatgtatgagtgggggccacccacttggcaaagcagcctttgagaaacaccagtaacatgtaaccagggtagggatgtggcaatgggcaggagggtcccccttgacatctattcagaggtccatagcctgggactcctgctgaggtgacctggggcgcttctggacctgaaacctccttgggtggcattgtgtatggcagcaccgaatatggccagaggcctccgcatttgccaagcgggatccctatccccaagcacaccagtgttttccttagtttcttgcgtagcaaagcccctcccctgggttcttgctcgctgcccctgtctctgccccagactgtctgctgggtgagcctgggaactgacctggttctttgactgtgggagaaaagtcaccagtcacaaccaagatgctgccaaagtgcccacccagttccntggtcttggtaatatttgtggttagtatgacctacatatcgtcacagctgctttcagtggccgcgtagaaaagcaagcaagcagaaaggaaccttcctggctgcggagaagctgtggagtaggctggctgcaagcaaggcctttggagcagatggagctggttgcggctctagctgtgggactttgagcaagtcattggatttctctgatcctgtttcctcattcgtaaaatgggcatgaaaagagggagttangtgaaatgtctgtctcatgctcagggctaacagcacacaacaaatgctcaattcatggtaaatggtaatattcttgttagtagagggcacaaacacttgtatatcagctcaggagtatgtcagtttcacattcattgacatttactgtttctactggttaaaaaaattaatgcatacttgtaaaaaagtttaaagttcagaagagaaaaaatatagtttggaaatgtaaaagaacagaaatttaaattcctctgaaatccacctacagagataatgatctttaaatatttggtgtagttccttgcagtcctttttctgagcagttataacgctgagaagtgactcttgacaccctttctagccccaggagtccatggattccacaggtgcaaatacagattttaaatcatcatttaccaatgtgtggaacaatgacaagaaatacgaatttgttgctttaaaaaggggaaagaaacatgagttaaaacaaaatatattagcttagcactggtttcttactctatccaatatgaaaagcagacacagttttttttcctttcttttaatctgtatactgccatttcttatatatatatatatatgtacatatatatatacacacatatatacacatatatatgtatatacacacatatatacacatatatatgtatatacacacatatatatacacacacacatatatacacatatatatacacayayatatayayacayatatatatacatatatacatatatatatatatttatactttaagttctagggtacatgtgcacaacgtgcaggtttgttacgtatgtatacatgtgccatgttggtgtgctgtacccattaactcgtcatttacattaggtatatctcctaatgctatccctcccctctccccccaccccacaacaggccccggtgtgtgatgttccccttcctgtgtccaagtgttgtcacagtttttaaaaaaactcctggcttgtgcaacatagaattgaattattttaggctgttcagtttcaaagactgtgaatgttgatgctcttgtatccttagtttgtaataatgctatttcctctttaacaccacagaacacactccatcagtgggagggcagcacatcacctatgatctcatcaaccctgttgtcccttcgggagggtcgtgttgtctggccttaggggctgggctggcctggccgcaccaagcacaatttgaccaactgtttccagcctgtccgtgaacaacagtcgtttccaatattggtctgtgccatggacactggagcaacggtgctgatggagcagtgccctactattagtttggttttgttcttaacaaatagtctatatgtgagttcagggggtctgtgttcactgtggcattgtacccaaaccagccctccattagggccatggcgtcggggaacacctgcgctcccactacagcagggctccctggagcctttggctctcttgatcattcagagcatgcttatcgtggggcctggggtgcctccagactgcgcctccacagtgggagtgcctgctgtaagtgagcaaacctagacgcctcttggttgtatgtccgcctcccagatcttgggccttgccctgttccagtgggcagaatccaggcctcctcctcatttcctttgtactcataaaggacccatgttcaggtttctctttgccacctgttcaatgtgtctttctgggacctactgtgtgctgggtaccgtgctggtactgtagagcaggaaaaacagaagcaatgccccattgcctgctgctggatggatcccgttctggggctagttctgtttggtacgtacctgctgtgtgcacatactgctcttggcactgaggactgtgtggagcaggatggccatgggcccttctctctggcagcttccatctagtgtagacagatagacaatattaagagcaaagcagattgtgttggacaragtaagtgctgcaaagacaaggagcatgggtagtgggacagaggcgacgagcagagaagtagaaggatcttctgcgtggaatgagagacctccaaggctggcgtgtgtgggaggagctggctgtggctggggcagagggaccccagcagagaacaggctgctggatattcatctgtgcctgctgaacccctgctgcagtcaggagccccagctctgccattaagcagtccctggatgacagtgggcgttacctggagtggccacgctcaccccaaggagaggctgtctccagagccccagtgctgggcagctcttcctcattcctcggcatcccgtgtttcctgctggtatcgtcctgagaagcttcgtgggatgagatgtcttggtggggaaagccaaggaggtagcaagttcaaggagcccctagtcttcctgttgacacccaggagggtgtggctttcagycccctccccaggccagcaggtcctgacacctgaattcatgtggaaatgctgagcctctgaatggcctcctgctgtgtgagactgggtggtgtccaggaggtagtcccagggtgtgggtggggagatgggagatgagaatgtcctgaagctagccttgtcacctgaatgtgacaggacactgtggtcagtccaccctctccagccaagagtgtccaatgtggagtgaagttatgaatgggcccctaagctgggcctgaggaggcagccccgggccctggagctcaaatctgtgttgccatcatctaaaacgggattgtccagaagcccatcacctgtgtgcccctggggctcctgtaacctgggcacgctttgggacctgtggctcactgcagtcttggctgttggcaaagcaatcattgtgcatttcctgcctgtcttgctttcaaaaggagcccgaggggcctggtgtgacttcccccatggagctccttagaccagacacagacagggcgagcagaggcacgccggggcctccttacctccttctggaaggggcctgctcacaaacccagggactcagagctgggggagcagaaggtcccaggcctcaggaaggccaaacacctacagccctacccacaacaccactcatgtccgcagagatgtcccttcctctgtagtggaagggagtgggttctgccaccacccgagctgggggtggggaccctggcacatgcctggagtcgggctttctaccctcgccctgggcagggagggccacggggagatgaatcagaggcggattctgccttccagtaactccttctttgttctgctgtaagtggaaagtcagccctcaccatctctgctgccatccccatgactgcagacctttgggaagccaaacaccacctccctgggagcgctcttccttcccatccttgccagcatggccacagaccggaagtggcccttcccagagctgatgttccagtgtggtccagtttctgtcctggtgtggagagaggaagtccgctcagacccaggggttgggagggccaggccctaggctccaggtcctttgtttgaagatttttttctgagcaccatagcgttgcatgacgatgacaatcgcacttcgcatggctgggcgcagcgtttcattcacaacatgcatttttctcacaatgcttcctaattatttcctttggcaaggataggagcctctttctttaggatagcacctgagttcccagagccacagtttttccaaataaggaggcatgtggctggtgtccagcagatcccttaatggctctgaatgcccctcctccctgcgtcctcagcaacctggcagacttcagcccaggaagggtgctgattggagctgcctggtcggcttccagaaggttaccaggtgggaccgggctcctggggctttctagctgagtttctgcacagcactggtcagtataaagaagctggagaatccagctggcatcaaccctgaactgggcagcaggtgttccagacctggccacacatggactcccccatctgtccagcaccttggaggtcccaaagtgcgttcttgcatcctgttcatttcttcctcacaggatccctctgagataggctctgcttgggccatgtggacaaggaaagcgaggctgagactgggagggtcctggccaaggttaccctgagaagatagtggttaagagagggctttgacccaagtctggctcatgagtctgaccccactgtgccagcgagacccagctgggcctctttgccctacagatgagtgccgtcagctgggccagtgtcctggcaggggcccgcagcccatcttgttcttgcaagacctcttgaaagtgtaacacggagagtgaggcctggccatccnggaccctggcagtgcctgggtattttcagctctgtgagatgcccctgttgagtccatcagggtccccacgccagagcccttctggcaagcccctgctttactccaaccctcctggcataaaggaagctggttgtcccagcctcaggcacagctcttctggaaatctggaggacattacctcctggctggccttgagcttggggctgcatctgagaaacatatccaagcctatgggcttctccccattcactgagcagggataaaaatcctatcaaaatagtttttgaagagcaaggccctaccagtgtcattggggcacatgaggtgaggcaggcagccctcaaggctctgtttaacttagttatctgcagagccctccgggacctggttgaaaaatgctgtcctggcctcaagggcacgtgggtcctacctcttagggcctggcagcacagtctcctcctggccaaggcatctgggtgcacaagggaaggtagggccattttgtctacagctcctttgattggtcgagcacacaccaacacagggcgtcgtctgcctgtgtgggctggagaggcaagaggctcctctgccctggggactagcctgagggttccagctagtagatttttgcctttctgtggtttgctcggccgttccctgggtactcttgctaccttccatattgaaggaagtggaccccgaactggagccatataggacagatggggaatgctgctgcttcaggccctccaccacaaggcttccttgtgtcattaaaatacatactgtcctttcccactacctgtgggactggtgtttgtgatagccctggaatgtgagcaccaggaaacactgaatgtcactcacctccttggaccccttgcctctgcaggtgaagccactgaggccagaggagggaagtggctggccatggtcacccagggttatcaccgtgggtgacaggctgggaccagatgtgagtgcagctgtgggccgggccccttcttctctctaaggctgtggccacagcctcctctgacacctgacaacagcatgaactcagcccatcccggtgttgcccagggcctcagtttcctgatctgtgaattgggcatgagttccttgctcayttcacccctgggcacggctggatgtgaacgtattgtgcacatggtaagaccctggctagtcctaagccctggtattatggttgacacctactgagtagaaacagttgggaattgatagcttttccctctgcgggttttcataaccattgctggacaccggcagggacaaacttgggaaagtcttgggacccaagtggaagagaggactataaatgaaaaactagaggggataattccagcctcaaaagcatgctcgtgcttatcacactttgatgttggctttgaaattctccaggtatgccctttggaaagggactcctggagggcaggggcctcgcttcctggcccctgagttcacattgctcaggagagcacctggtggaccacagatgcttcacagatgggggacaaataaaggaaccagcaagcaaaggctgtctgggttgagaaccgccctcagtcgcagttgtcctgacgctggggctggcgtgaacgttccaggcccagtcatagtagacagcaggggtggcgtgtccccgccatgtgccagtgcccagtcactgccgacctgaggcaggggctagacatctgtggggctctgctgaccttgaccctccagagcaggcaggccccagggtcggaagtcagctgacagtctccacagtgctcccctgaggaggaaatgaggaggccgctgggcctcactgtctcggaggtgggggtggcaggggagagcagcaggaggagtggggtgcatagtccaggtccctggtgccgtgtgtgggattgtgattccgtccagcggctgggctccctgctacagtgcctgcagttcagcagtgaggggccacagcatgcctttatactgcctcccctggcagccctcttagcttcatccctgcctgtcctgtgtagctgggaggacagagcagagcaggctcaggaggatgccaggcagcaccctctgctcagccgcacccctccagcctccttctgcacctttgggaaggtgcagagggaaatggaacacgagggaactgagttagggccctggggcctcagctcctggaaaaggctagcagcaaggccacaacagagcgtctgagggcaaggtggtggccacctggctctgtctccctgtggcacaaagggagaaaccgaggccggcaaggacagaaggcttggctttgcccctgtgctgagtgcagctggccctgccttgctgccacctttgctgcagtggctttggctttggggtggtttgggcaggaagtggcctctgaagggagattggggggctcccagtgtctggcgtggctaattcacatgcgtggagcctctcggtgtgactcagcgcccgtgagtcctcgcatttcttttttctttgttgtcttaggtttgttttcattctcgttgaaggcaagaggggggtttcagagtttagggcacagaaaatccactttaggatgaaccctttcttttcaaacacatctctctctcgaaacaaatggctgatggcaaaggaatattggcctcctagcagggctggggacattgtactggggaaatagtctggaaattggtcatctgcagaagtagttttccttctggaggaggaatgcctcactctgggaggcattaggtggaagaaaacagcgcctctggagtcctggggttagggttcagctctcggcttcgctgtgctctggccaggtaaactctgagctgcagcgtcctcatttgtaaagtggagatgagaagaataacttgcctcacagggttggtgtgaagatcacataggccaaagggtgtagagcgcctagcacatctggccacactgtgcgtgcttggcagatggcagctgctgtcatcaccatcatcaccataaccaccgttactttcagcgtcacaagcaccactgccaaaaccaccatcattgtcatcatccagcgtggagggtccaactggaacgcttagaagacctaggctcatgcctggttctcagattcagggtagacgacacctgtcccgcgatgacctgggcctcttttacctttggcctcctccaaccgatagagagtccttccttggagggagaggtctgcctccttagtgcttactctgggagcagggcacagcctacagtattgtaaaattatcctatacttaattatattactaagaatatcccagctccattagggagataagtcatctgatcgataattatgtcatctgtacctgtcgccagcttgtcttgttatgacgttagttttactgctagaaatatctagtagatggctggaaatctgcaggcaaagtgcagagggagtgagcctgcgaggagagggcctgggcaagtgactgccctgggccgcagagttcttatctaaaaaatgggaacagtagtgtcttcctaaaggcaccatggacttaaaatgaatggcacgtttcctgggacttatgtatatttggttgcttatggggacttacgtatatttggttgcttttggggacttatgtatatttggttgcttttggggtctgaaggagtacaaagaatcaagtgcacacttcccagtgtgtgagggagaccagggacaccgccagcctgagttctgggtagggcagctctctggcagtaagccctccatcttacagggggacactctgcatggaaggcggcctttatccagctgtgagaaagcagactgaggcttggtctggaagctcgtttagaacaggcattgtccacatccttgcagtggctgggattttggcaataccttgtgttatgcgacggagggcagacatgttgggagaaacagctgctgacttgcctggaggtggggccggccaggcctgctgtttctctttcccaccatggctttgttgcctgggccagcctgccctgtagcaccctctctaccccatcctccattctgcttggtcagatgggtggtcagagggtgccaagctggtccaacaatagcaggaaggcctctgccagggttagtttgctgccatctactgagacaacaatattttttcttggaagacatggaaacttcgaaataatccaggctggtttccttactcccaggttagaggttgaagaggtaggtgcagaaggttctagctggagcctatacgtttcagaactggaagggacctgtcattatgtacctggtgaaacaggcctagagagttgcagtcctttgccctgggtcacttagaaagttagctgatgatggggcagtgaccagacctggccttccactgctgctgttgcctgcctttggcagtctgcccagcaggcctgcagctgcttctgcaagtcagtaggatacagctctcatcccccaccagtttcatcctgtctcccgcaagtggctcgcttgttgtggcaagcactttccaccaccagtctctccagtgacgctgcacattcgttaagggctgggacggtgctttctcttctcagggcggcttcccacaattgctaatcccggccagaccccttagcagcaaaaggagccccnaacaggcgggacaggtggactagctctgagttctgtttcatctgtaggaccttgggcaagttacttaacctttctgagcctgtttgctcatctgcaaagcaaaaaagagcacctttaggggcttgttggtgcacgcaccatgcctggcccattgtgagggcatggtggagggctctgctgttgcatttctagtgggttctccctcgtgaagccccatggcaattattcttgaggtctcatggcattcctatgaggcaggcaggacgaggtcattattgccattttacagrtgggggaggctcccaaggaggggggagatgtgtgatgatgttatggcaggtggtggagagccaggccaggacacagcaggccgcagcccatcctaccccagcttcccagaccttcccctccatggagactgcaggctcgtgggcaccaggcacactgggctggaggcacccactgcccatctgtccctctccatcctggaggtttcctgcccaaggcttggccctctgccgtgcccaggcctgtggtcttgagcgtggggttttccaacagacgctcccagagccttggatcctcgatgtgtcttggtttcctcccagaagcttggctgctgcagtgttctcagagagagggttttctggaggaggcagggtgtgccattgtgccctgcagggccaagcagattttcagcatcctaggaagaaccaagaatgcagaagtctgggggtggtgaggcctcagccagccccatggcgtccccagtgcatttcctgttgactctccccgtgcccacacccacttcctttcccatccctggctccaccctgagccctctgctggctgatagctccatgtggctactgacctgcttcatgcacacggggctgttctgggctttgtaggaaacagtgaccacaggccagggtcatcccttgagctatgaagctcctcctgtgtctggtgaagccgaagacattttcctcggctcatctcaagcagccatcttgggtctgccctcaacacttcagtgaggtgccctgggggagggggtgaccccgagggagacatagccaccccaccccatggggtgacatggaaagggtacaggccttccctgccctctgctgcttcctagctgtgacactggacacatacctgcctccctgagcctcagctgccacacgagtgcattggtgacatgcatctctgctcacacttgttctgaggacagtcctgctaatggaaagctcccgcatgtggtggggtcttggcgacagctttccttttcttctcttgcctgcctgtctacagggagcttccagttcctttggaacttcaaaatgtacagatcaacactctgcttgagaccctgaaaaatctgattgtcgcagcttggggagtggggtttatgagcaagagaaacacccgaggcctggagccttggggccgctcctcagagacagggagatttgccgtggctttctgcgccattcatccaagtcacttagactcagagtccccatttatgaaatgggtctagtaataaacttgagagcttcagggcagtgatacacattaaatgagatgatattttccccacgtgcttggcagagtgcccagcacagcctgaccatcagcacatgcggccccgatgcctcgctgtgcatcccttcccagtgtgtgccgctcaccagtcctgcctcttcattgagtttgggcttctctgaggtggaggctgttctccttctgctcccagttcccatcgcctgctgcagggtctgccaagggagggcttgctacccaggaatggcccggccaggaggctggctgtgtgagattccagggatggggcctcacttagaacctggagaggtcgacacccatacacccacatttgcctgtttgcttgccttgggtgcttctgcagtgggcaagagatgccagtagttttcccagactccctggcatccatcatggctgcttccagcctccccttaaagtaatgggatgaatcaccccagtattgcaggctcatgagttagataagaagggaagtcagagttcacataagggggttggctggaggccaggtctcccagcagcaggaggagactgggcaaaagagcgtcacagggtggccatctgagctggagggcagggatactgagggagccgtaaagccctgcacctatcgggaacctcgtctcatgtattccagaggctccgggctgggagcaaaaagaccagggaggaaacagaaggcgccggcacagcaatgggagggccttggcctgtggtagatggtaacaaaacggttccgtttgttctgggattccttacacgcttggctgtagaatggcacgtttctcctcctctctcctgtcaggcattagaggcctggggaagatgtttgagcccattgcggggccagagcagatacagcccatctgtattgaagccacgatggaaacattcttgaaggcacatagcaaatgcctaaagaaagcgagctgcactcacacaggcaatcagagggagagacgctgtgatgtggagtgacatggggcttgtgggtctgtggagagctgtccttcatgggaggatccctgactccatccgctagatgctcattgttccccctcccgcagtcatgacaagtggtcctcagctgggggcaacattgctgtggtcgagaaccactgactggagtaaaaggccttgacctccctggtgtctgcagtccctgaggccctgttacctgtttggcctcagacaggaaagctgatccttctgaattgggcagtggcaaaggagacgcaccttctcggtgcccactcagctcaaatgccatgcagtgtggggtggagctgggcggcagggcatcctgttacctgtagacacagaggcctgctgcccccgggacaggctgtttacccttattggccccaggttttccatcctggctatccctgagtccaagtccctaggagctgggaaggatggtcacatgatggtttcctggcgcacttctgccagctcccgggtgatgctggggtctcctgagcccctcgaatgaggccaggcaagcaggcgttatgccagacagccgccaacagtgtgcgtcgctgctttccataagaaaaggcgcctgagacccactgccaaagcacagagccatcttgcccattaatcaggatttcaggattcttggagtgatcttagcaactgcctggcaaaatccctactcaatttaccctcacctgtctgccttcagcagaggctgggaaggctgtgggtggaatgggggtggggtggggaatgctgccggcgtgggcccatcttgggcccctagagcctgtctcaggggctgagattttgcatctctcagcagggcctgagggggcactctgaattagtgttattgttattattgctctcaatgattactgttctccattttcaattttaaaaaattaaagagaagaagggattttcccagttactgtgttgaggaagaggctgagagagcagataggcggtcttaccacagaatggcggtgatggcagggcccactctgcacctgaggcctccagggagggcccgagttgccccggctaccccatcctatgccgagggctccagccagctccttgtggccacaggtaccctgggcccttgcttgaggctaaacctggtcatgactttgctgcggtccccaaggtgacctctgcttggcgcccttgccttgtggcctggcttcagccctgcaggtgacagtcatgtggctcctccccctggcattcagggggagagcaagaggcaggcccctcagaactctggatgtggaggggccaccatcacctacttagggacagatgttcttgcagcaccgagtcctgcagcagagggactgatgcgccgtccccttccatctcccagcctacctgtcagagcaggctctggctggaaaagccagcccaaatggccctcttctgcctccctcccccatgcccatccctgctgccacccccaggacccatctgcactctcgggttccctacccacagccatgtgggaaactgacatcccaagcttctctgagcaccccaggaaggtcacctctcaggcctccctcagtggcaaaaccctttgagtggtacatttctgagctgttcctgccaggaggaaaccctggtaatttggagaagggttgctgagtgccaggcaggtcagccagaagtgatgtgcatttcactgaaagaacagagttgccacccacatcttcatttctaggctaggagctgtcctggaattctaaagggaaggaaggaaggagggcgggcagtgagcagccccagccctgtctctgggggttctaattggcctttgcagagccaaagctcctaggtttgctggcagaggacgtgaaggggctgtagccactggtagtgctatgagttgcggtcttagctgtcactgggtaagggctgtgtgccatgactgtgctagcccagctaactcggtgagctagctctccttaccagcattttccaattgaggcaggctcggwggggccaagtgaccaggcggtagacaaatagctgcaaagtggccaggcctgggtaccctcttcccccaactataagcagctcaaggcctggtggcttgtggcccaccaggtgccctgggagcaggcaccgggtggtgaatttacctgagtcacatcttcgttggagcaaggccagttttgccctttcttcccgagcaggtgtggaggcccctggcatgagcaggaaacactagaatgttccagagacccaagggaccagccttttctgggggcagatgccatgtacagatgggcatctccaacctctggatgccctgtgtctctctgaggatggggcggtggtcagaaagggccctgtcttcctagcctgcyggccgctccaggagccgcccagcgtgcaccgctgygcctcatcttctgagccttccatcctcactgctcctgggggcagccctgtgggggaaatcacgtttttaattagcctggttcgggatggcggctctaaagctccgggccgtgaatgcagcctcttcgcctttggaatccgctgccagtggacacaatgtagctgtaggaatgaaaacaagagagagaaaggcccacaggctcagatttttaattggcactgtcctcccagccctgcacccccccgctggccctcccggggctctgtttgggcggccgggcccgggcgacgagtgatggaggctttcacagcttcagactgatttaagtggacctgtatagattcctgcagccacgctgaaagagccaggcgcaatcaccgcgccgagaaaccctgggaaatttatcagccacctgcgcgtcgtgaatagggagaactgctgagggccctgccgagccgcctgggcttcaatggccccacagcccagcctcacagaagagatttttctaaagctgcaattaatttttttcccctcaatcaattggaagttgctttcttgctttcagctgggtgagtgtgatccttgattctgtgattctcccttaacctgagcgttccaacaattgacgtttctctccagagacagacagctttatttcctgtcggccatctaggaagagacatttttgtttgtgttttgtgtgtccttttcgtgctctttcttttctttctttaagatcatctcaagctaacagtgagaaaaaaggcatatgtgagcgattctgcctcgacaggtcccacgataccrtcaggaatgtccgtttttcttgctttcatgaaaacactgtggggtcttacttagaggagacagtggtagagatgaaagaaggaaggagaggagtgcatgtaatgcggaaaggagaaaggcagtcttgccggactgccagagagccgtgtgctgcagcttcaagaggtttctcctagaccgacctccaccctgcaggaacagttatggggacaattcttggctcctatttaattttacaatgagaaccaattccactgcataagaagagaaggccaccctttctgcctggagtcactgtctgaaagcttctgtgatcggcagttgcacgtgcccctgtgtctcggggatcctgactcacggggatttcaggttccgtgttcactcagggacattgctgccgaaggatggcaaccattctggctgctgtggcagagcgggacrcctgcaagccagcctgagcacccatctgcctgttgggccaccgggcagcttctgcagatgggagtcatcaggcttgagaaggtgacatctgggctatgccgggctgcccttctgttttggtagagtcactgccttcactgccccacccttgaarctggcttgcttttgtcacaaccaccggagaggcgttggtgtgagagtgagacccgtcactgtggacgtgttcacacgcatggcgctctggctgtcctctccttccctggagcccgtgcctttgttaagatctctaggacctgctggcatggcagcttgcccgtaaagcctctcagcagggagggctactgttcttgagggtgagagacagaagtggccgccctgtggtctgagcctgcccggcacagccactgactgcacttgtggtgactgtcagttagggctccgatggcttattcttcctcgaggaacactcacgttctcagggtgggcatgtatgcacacgtgtatgcacrcacgccatttgttcagttgtgtacctgctttaggcttccggctctccagctgggtgaccttagcaggttcctcagcctctctaggcctctgtttcctcaactataaaatagtatcactggcacaggcctcctgggggttctggaggaaccagcgagtcgcggtgtgccaagttcctttcgcagtgcccagcacatagttaggatctagttcatgggacctgtaagtcttatcagtgcttgccgtcttaataagacccacctgttgacacctgggaccgagggtcaagaaggggctcctctcctctctggctcccaaggaaggggcctcttgcaggcacagtggatccagtgtgttgggggtgggtggtgcttttcccctaaggccatggtggttgctccctcgaggattttagaatcttatctctgagttccccgtgactctcggctcctgttttctagtgaacatgggcctcagtgatgacacatggttgtctggcagttcctttttgtggtagccacttgctgatagaaggagaggcacctccccagtgggttctgtgctttctctgaagcaccagatgttggtgccaggacagagttggctcatctcctaacttgggctgagccagtgatggtctcagccagaggctggggccctgtcctgaagctggtcttggggtagtgttctcactattccaccacagctcacacttcccatctgcactggaagggttactgggggctcagagttaaactggccccagcattattggtcactgtagaaactgcaacatgttgaagtgaatccaacatatcgaggaagaggtatgtgtgtgacgtgtgagcatttacctttaagggaaggaactggatgagagccagtcggggtccgttggaggctgcccgggactctggacagcccctgagggtgtctgctctgggcactgtgctggtttcttcctgttttgtcttactggttttgtcttctgggtgctttcagcctctcccacacacatcatttgtcacctaggcggggtatgctccagaggaaagtaaaatacccacagcctttgtcccttcctcccatctggctgagggctcttcctagtgtggggtcagcggggcgtgccctctgcggcctttgccgggctgttgcctcactctgctctgccgcagcgggggctgtctttttcctcctcctctcttcctgcgctcggggctgtattgcatggtggtcagcgcctgatcccggattcagactgctggcacctagatcctccccactcactccctgtgtggcctcaccaaacctctgatgacagtagcgccccctcccaaggttgaggtgagggtttagtggggcgatcccatggagctcagggtaaattcttagtaaacattagctctgccatcattcgaggctctgcagctgctaggacaccagaacgaacctccagaaatgccctgcctttgttcccaggacaagacaagattctaggggatgacggactggtgggattcatggcatctccacctttgggttggttttctgcacaggaagaaacacntggatttaagaatgatttagggtggctccaagccctgcacattcttcaggggccatcttggtgtgccccctactccccttgttatcccagccactgcctgcccttttctgggccaaggcttggctgctcaggaacacgatccctccccaacctgccgcgcagagctgtgcaggctgagggtgctggccggagaggtgtggagggcctgaggctgtgctgctcctcacactcgcagacaagcccacggggtgcacctgagaatgcacctgtagcaaggtgcagccgtcagggctccctgaattgccttctttgctgctccagttggtgtggtggctctgcccaagggcrttcagccttgtagttgggaatttttaccaagcagcaggcaaggcttgctgggggttcctaggggtagaaagtgattttctgccatcctgaattctggtattttatggtagcagtgaggtgcagcgtggtggttaagggtgggtgcaggctttgaacagacagatctggatttgaacctggccctgccactgcctctcggtgggagtttgcccaaaccaacctctgtctctccaggtgtaaaaggaggctggcagagcctgtcccttgtgcctggatgatgagctgatggaggtgagaggtccccccatgcccgccccaggcatctgtctccagcactttcactcagacgcagctaggcactctgggatgcgggcgctgtgtttgtatattctgccaagcatttaaacagtaatgaacaaaaggggaaaatatagaaagggggggaaaagcctatcagaaaattcatagttatgttgaggtgtgtccctgggaaagtcaaaagaacagagacccaccccggccaacccttctggagcctgagttgggcctctgagtgggagccccacctgccaagcaccctgggccttgagctgggtcttcccaggaccccttctgatccagcctgcacagctgcctcgagaggtctgcctcgtgatgcccaccatgacccgcccaaggccactcagctagacagagcagattttctatttctgtgtctgtttggtggcaaacagcatgccccgggctgcatgcccactgctgaggatgggccctgtcctcagccctcttggggatctcctggcacctccagtactctttaaggaaacatttcctgagtgcctgaacctggcacagaatcctgacctcctgctggggtgggtctggcccggtcctggtagaaaatacagaacccaaccccccatggcccacctctgaatccctgtggtccagaagccctgaactaggggctccctgtcaggtgtcacattgggttagagagacgggacttatatgggcaagaggctgagccaccccaggaagggtccctggtgggtaagtctggggtgagtctccccacatctccacccaatagctaagccagtatttggtttgcctccaggtgagaaaagccttagcaaatgcagtctccagcaggtcctgtggggctcagggaacaccagggccctacatatactttgtccccaccactcacttctggcgctgcaggtggggccagctgagcccagaggagcagaatgtgcccaggaatgtccttccacacccaccaccagcgggcatgtccatggccagctgccctgctggacgtgctgggatgtgctggccaagccttgctggtctgccaccttgtcctcgcccctgaagggctccagtagccagcgagggccagcatggcctcccccgccccagcatgcctggggtctctgctttcatggactgtttgtgggtggggtgaggtggtcagtggtcctccttgtgctgtgtctgcctggggctgctcgtgggcaacgtgggtcactccctctgtcgtggtgcagctggcaccatcaggtgctgttcaaacccctctgagccccgagctgcttgtgatctcatttcaactccatgcagcccctctagggcagttttatttccccattttacagatgggaaaagagaaactcagattgcgtaacatgcccaaggaagcaccggtcccagtgttttgttttgttttgttttgtttttgaggtggagtctctgtcacccaggctggagtgctggagtgcagtggtgcaatcttggctcactgcaagctccgcctcccaggttcatgccattttcctgcctcagcctcccgagtagctgggactacaggcgcccgccaccacaccctgctaatttttttgtgttttttgtagagacggggtttcactgtgttagccaggatggtctcaatctcctgacctcgtgatccgcctgcctcagcttcccaaagtcctgggattacaggtgtgagccatggcgccaggcccggtcctagtgttgacaggcaggatcccaccccaaatggatcatcatttcagtccttcattcagccacctgaccctgtttttccaggcatcagggttgcagcccacagaggcactcagacagggagggcccaccagctcctgggtgcggggggctccagaatggagagcgaaattccctctgcctgcacagagaggctccatggaggctttgatagggctggggtggctgtttcatttcagctgggctatgcaatggcaggaagagtctttcgggagagagaggtttaggaagcgggcgatcctggcctatggagggcactccatgggaggggctccatgtgtccaggggagcctgagtaggcagggagggtatgagtgagattggcctggagataccgggcctttagccctggagtgaggtgtttgctttttattctgagagcttggggaggaaggtgctggatcaggtttgagacacattgagctgagaggagcgtgggacatcagcagggacatgcccattgggtctggagctcaagatgggatctggcctatggtggccattagggtggtcagcagtacaggtctgagttggatttggtgcccggtcgcaagttgcatcgaagctagtctcggtgcagtggctttgcagggtagggcagggacacccggggctcaagccgaagaccctcattgtgcagatgggcccagagcaagcaagacttccccagggcatgcccagcacaaggcggctggagccaaagccaggcacccycgtcctgccaggtacgtcctggacctgcgctgcctcatggcatgtctggttgtctcctgccacctgcggaccctgtgaggcccagcaccagcaagggtgacccagcccctgctcagaatggaggagagatggaggtccccagaggtgcatctagaccccatttccaagggggccctctcgagtgggagcagggagcattttgtcagaaagggcagcctctggagggttgtggtgactgcttgctcctggagttttctgtgctgaggcctctttgggcagataaatcagttgtgtttctgcagcgcttgcctgccttctccttatgacttctgttttgatgttgggaggaaagaagtctcgctccccccagatcgagaggaagtctagctgcacctgactctgggaactccgcctctgcatctcttctgcttggtgggtgtgaaaacacggccagtgggagcggggctctggcgtcacagacatcagaactgcagacacctggcccaggtgtccgtgttctgtgtgtcctgcggccaccgaggctgctcacagacatgagaggccattccccacccagaaccattggtgacaaacaggcagcctcctctaacctccgcaggatggggcccggcctggcagctgcccccagtggccaacgtgggcctctgtggacaagacaggtgcagctaaggctgcaggtgcaaagcaatcccagggtgggcgggcagggggccacctgaacctctgtacagcaaaacagtgttttcctgggatctccctcttcctgttgttctgtgaaagcacctaccagccatgtgaaaagccacccggctaaccacccacatgcaggcgtctggcacagggtggctcactggccgttcaggggtcggcccctcctgatgtttgcatgtcccccttgtgtgaaactcagatttaatttggtgattattaaagtgcaggaacctggggctggtagaggttttttgtccacagattttgcaaagtgccgttaaaaaaaaaaattcatacgctttgttgctaccaataaagagaaaaggaaagaaaagaactttggtagagaaacatcgagagattttaatatggagatggggtgggaattcgaccttggaaaacacaagcgatcangtgaataggattttggccttttctaacttagtgtgtgctctgctcttaagataaatacacacacacagagatagacatggcatttcattttcggacagtacattcacgtgttcgaaaattaaaacaacatacagagtaaactcttgccccatctctcccatctcccatgccctcagatggaccgctagtttcttgtgctcctttttacaatataagcaaataggaatttcaattcttattataacagaggagataatagcatgcaatacataccttgctgtatcttgttctcttgaatagtaaaccctggaggtgttctcatgcccttttttttggctgcacggtgttccactgcacagatgtacccactttgcggggtcccctgccgactcctccgggctgcttcagctgtgaatttcacgtgcatgagtccctttgggcatgggagatccgtcttctgcagggtccgttcccattgggattgcttggtcacacgtcgtgtgcctttggcctcttggaggatgtcgccaggttaacgctgtaggagcccttcctccctgcatctcagagggccacgttcagggtggtttgtttcccaccccacctctcagtagaggctggtccagcagttgacattttcacaaccagataggtaaacggtttctctgtcattttagtttgcgtttttctaatcagttgaacatcttttgtatatttaaaggctatttttatgtccttttctgtgttcttttcatttgcccttttaaaataattgtgtcggccgagcgtggtggctcacacctgtaatcccagcactttgggaggccgaggcggatcacaaggtcaggagttcgagaccagcctggccaatgtagtaaaaccctgtctctgctaaaaatacaaaaagttagccaggtgtggtggcgggccctgttttcccacctactcaggaggctgaggcaggagaattgcttgaacccaggaggcagaggttgcagtgagccgagatcatgccactgcactccagcctgggtgacagagcaagactctgtctccaaaaacaaaaataaaaataaaaaataaaataattgtgtcattggtcgttttcttctcaattgtatattagggagattaatttttgcctgtgatatgagttacaaatatttattactaatttgttctttgttttctgactttgcttttgacattcttgagctttattgagatataattcatataccacacagttcacccatttaaggtgtacaacttagtggtcttgaatatattcacagagttctacagccatcaccacaatcaattttagaacatttttatcacctcaaaagaaagtccataccccttagcagtcactccccgtccccttcagccaccaccactcccagccactggcaaccacaaaactgtgttctgtctccatgggtgtattagtgcgtcctcacgttgccataaggaaatacttgagactgggtaattttaaaggaaagagtcttaattgactcacagttccacatggccggggaggcctctggaaacttacagtcatggcggaaggggaagcaaacacatccttcttcacatggcggcaggtgagagaagtgctgaacaaagccccttataaaaccatcagctctcgtgagaactaactatcacaagagtagcatgaaggtaactgcccccatgattcagttaccttccactgcgtccctcccacgaaacgtggggattatgggaactacaattcaagatgagatttgggtggggacacagccaaaccgtatcagtgggtttccctattctggacatttcatatcaatggatccatgaaatatgtggccttttgcgtctggcttccttcacttagcgtcatgctttcaagggtcatccacaccgtagcatgtatcagtatctcctttctttttatggccaaataatattctgttgtacagctagaccacattttatgtgtccattcaccagttgatagacatttgggctgtttctactttttggatattttgaataacactgttgtaaatgtttgtgtacaagtttctacatagacatatgttttcatttcttagacatggaattgctgggtctgatggtaactctgtgttgaacattttgagaagctgccaaactgttctccgcaacgactgtaccatcttacattcctaccagtgcttttggcattttttgacatgtaaatgtttttatcaaatttattacttatttcttttatggctctggattttgagttttagaaaggcctttttttctcacgagatgataaaggaagtctcctgttttcttctagtactttgatgggttatattacactctttggtctgtgttgagtttatcttgtatgtggtgtgagtatggagccagcattttctttaatgtagctgcctgtctgtttcagtaccatctgttgagaatgccatcttttctcctctgctttgagattctacccttatcatataccaaactgggtctatttcagaacattctgtttcattggtctctgtaggtatgcatgtacgttcatactaatatgctgttttagttatggaggcttagtaatgtgttttggcatattatatggtacgggctagtctaggagggttagcttccccactgttctttacagagttttcctgactaatctcacttgtttattttttcattaaaaacttgaaaattagtctgtcttaagaccatggggattgggagtactgttgatattttagattgggatcatattagacttctgaattaatttagggagaatttacacctttttgaggttgagtcttcctatccctcacacaggatttatttctatttgttcagtcttgcttttctgttctttaaagtttttttttttttttctatcaattttcccagttcttataagttcattcctgggtattttatcttttgtgttgctggcgtgtcttcttgctcttgaaagcagattgttgttagcaagagtggttggatataagcagagctcccagacccctttgctgtggccttgctgtgtccacagagagacagaggcacagttgtggggtggagtgtgggaaggggggatcgcacccttggtggtctctatttatccctccaaacacttctgaggctttgaggctcttattagccttgtacacatgagaaactgaggcacagaagtttaatgatttgccaagttccctcggggcacacccgagctgggattccagcccaggcctgtccagcccatactaccccaccgtcctgccggaggactgcatgctttcctgagcacagcccagagtgatggggtgcgattgcacatcacgcagctgtgcagtctggggcatgtcccttctcctcactcggcctctgtctgctcatctgcaagagtggctaaaccagttggtgatttgctcacttctccaagagtgtgccctccatggaagacaatatctggaacagagttgtgagctgctggggtggagcccagaggccgtgctcagcagtcctgtcttcagcaccccgatgtggccccaggcagctgaatgcgaacgagtgcccaccagcccctctgagagccttggacataccttctgcatcgctagtcctgctcagaagccacccccaaaactgtgagccctgctggtcgactctattcaaggtctgtgggcgcaggcagtacattagcctcggccccccgccagaaccctgtgtgctttggaaaggtcccttgacttttgttaggcaaagaattctcttcacgccaagctgcgagcgaggtggtttcacnagtcctgtcctgagtgtgtgctggctggaatgtacaccacagaaacaaaatgtttgttttccaattgtgagagcaccgggaggccctttggcgtcagctcccacaccttctgtgttcgggcaggccatctgccatctggggcctggtgcagaaacgtcgccaccgtgtggcctgtggggtgccctcggagaggggcccctgggttggccaccattcagaggacacgcgtggctctgggcctccaaggtctgttcttacccacggcatcctggggtgtaggcctcaggaccccagggctgtgcaaacagaggcccagttgggagggccgaccgggtgggcccttccttcctacctaccctctgcccccaggctgcacgatgcacccactgtgaaccaggccgtggcatgtggggtcagggttccctgcacgcttggcaggaaatggggtacacacaggagcttgggcctgcttccggagtggctgctgcagaggcgggttttggtgggagagaaggaatctgccagtgaagagggagacagggcggggccgtcaggatggtgctgacccagggctggtgcagagggggtttatgtggctgaaagaggtttgctatagaaggagtcagagcctgagtgggagcagcaagggcggagggcccaggaagcagagcctgaggaagaggggccttgggaaaggccagcccgagagtggtggccgggctctggcctgcgtggcgggtttggcccgatgagcaccactctggtgaacttgacaactccccaggccaacggagtgactttctagggctccgttatgagtaaccctctgttgctgatagcccacgggatgagtggagtccacagggcmcctgctggagcccacgcttgccttccttgggtctggcagggmagatagtaggctgggcctgctggccctaggtccgtcttcagaggcctgggattttaggtgtctgggctggggatgggctgtccccaagatcaactcctccttcccccactccttcagcctccggaggccataggtaattttccttagagtccttgtccccagctgggtcctaggcctcgagttaccgtaggcaaggctacactgtgtaaagaatccagygggaggggtgcccccaggatgcacagcatgagggccccaagagagccaccagagcggggacagcaaggccaagggatggctgggggtgtggagaccatggagagagccccaagctggtgccacccttcccgaagtgactcagcgtggcctggactggccgccacacagcatanctggctctggcaccacctgggcctcccagatctggaggggatgtcagatttggggcaagataccttgtccacagaaaaggaaaaatggcgcctgccctgtgagtctgaccagnctgagacagtgccgccaaagtctgtcccctgctgtactggcttctggaacggggtgaccacagtctggctggcatgtggcaggcgctcagtacacatttgttggcctctgcagaaatgagctaaggaaactgtcacaggaaggtgggaactttcctagtaactgaccagggccagccttccaccctgaagatatttaccacccccactgggccatttgcttctagaacctgtggtctgggaagagtcttgagtatccattgccaaatcagtggagcttccagggccctggagtaccttcccgctcctggcaacctgatttccctattttcaggccctggcaacctggcttccccatctgggttttgctgccagtgttgccctgattcctgagggtaaggaggcagtccagactcagaagggctgcctctttggggtccaaaggtggtaagcatttcacaaaaatgggctgggcatgatgctgtcccccgcttttctttttttggagagacaggtcttgccctgttgcccaggctggagtacagtggtgcaatctcggctcactgcgacctctgccacctgggcttcagtgatcctcccacctcagcctcccgagtagcggggaccacaggcatgcgccactatgtcaggctaatttttagtttttttggtagaratggggttttgccatgttgcccaggctgatctcaaactcctgggctcaagcaatccacctgccttggcctcccaaagttgtgggatgacaggtgtgagccaccccgcttggctgatgctatccctttttaagactgggcaccaacacggccctgggcgagcagctgacctggcctacacaggaggtggctgggcagcagcagaagaccagatgcccaggggaagggccctgcagagcctgggcagtcagcccctagggaaaggttggccatgcccacagccttcgaggcatctctagcacctgcagcctcagaggaaaagaagccaccaccacctgacccctctggccccaggggcaggggcagcagcttcctgtgagaaagagtacggccttcacgcaaaatccagatttaccagagatgggttaaagatgggccaaaaatatgcttgtgcctttttttcttttctgaaatagttttttaaaaagcctaggaaaccacatgccttgccgtcttggttgtttctgtgccagcttccagcacaaatgggacttagaaaatttccaggctgttggccatccattctcatagcctggtgttttcttgatacttggagaattctgttctcatgcaagcgtctgtttggggaggaaatgcgtccactcagccagagcctggggcccctgcagctttcagcagggcagctgccaggccaggctggggaccagctctgctcgtgacttgtgagttgggcttgttgatggccctttctcagagggactcgaggtagctccatgaagacctctaacacagagcgccataaaactggactaaaaagagggagagagcaagggaaggaggaaacgcagctggtcccgccatgaggagcagtggcacaggagggaagtggtcttcgcttgcccaaaagggaggcacttgagcacctctgggagacgggcttggcgcaggcaggggcccagaggaagcctcatgtgggcactacacttaagacaccgactaaccgaggagaggcgtccccaacaaccacccctccccagcacatgccaggcaggctggggccaggaactggactccccacagggccccgtggccagtctctgaccatggcttgacattcccgttctagaaagaatagtagtactaagaagcaggtgcataacctataactacattaacacccagggtgcttttacctgtggctttagattgggtctctagaagcggggcctgagccggggattctcgtgccagtgacacagagagggatgctcccagcaagaaccttcagggaggcgagggaagcccatgaactgcagaggcccaggaaagaggtgggctcagctgaagtcgcttctcagcctggtgctttgggagctgcgaagtgtgactagcacgtgggacttgatcccgcccaagaggagggacagctcctgtccctgcacctgttggtcattggctgggggtgaccccaaagggaaagggtaacctccttcctatcctagatctcccagcccagagtagttccggaaggggcagccatgaactgtcagagccaacactcacagcagtggagagtgggcactgctgtgggtttgggactccaggrgggacaccagcagcctggctttcctcttaggatccttgcagtggccctgtgaagcagcctggccagagacagcagttctgcttcccaggggaggaaacgggaagtgaggccacttggccagtggaggatctcagtgcctccagctgcagagtctagtttcccactctcctctccggaaccctccaggttcagtggagagccagggcccagggggtgagaataccgcagcctccttcggaggaggcaaccgggacaaaggggagtggtcactatctgctcccagacatatcacctgaccagccagctttgtctttgtcaccggatgcccactcctgcatgtggggccgtagctcatgagttctagggacagcagtccctagacaaatgctggggctgtttccccctccactycccaggccttgcccttcggagcccagagtgggttctgggtcactactgataaaacatgtggtttagttcagctcaggagatgtttctagcgtctctattacgtgttcaccctgctggcccaggaacagcagcacctgggagagggaatgagcttgttgggctgaggctggacggagtgagtagcagtctgcctggcagcagtacagagctgatatgttgagttgatgagtttcctgaggcaggtctgtatttcagcttgtacctagaaggcaaggaccaggccacctttgtctgtatccccgtggactcaggagaaagtatgggaataaatatctgcacagaacagccctgcagaagaggggtcattgctccaagctgggaagccctagggaggccggctggggcaggctgagcaggaaaccccagctggggccagcgggaatggccagggcctctttggtggctagagctgaggtctagggggtctgatggaaaaggcagggcctccatcccaaagttgcctctctagcaggctgctgtggtctgccttttgcagactctaggagtaggtcttgatccatgtccctggccactagcctgaggccatagggacagttcccactgagctttttacctgggcaggcctgttccagagtaggtggcccagcccagggctggggctggatgtcaagagagcagaagtcgacgggctgggggacagttggtcctggagcagcactttcaccttggaataatgtgttcatgcagcactttgaacttagccattttgcggctttttgcagacatttttgagggcacacaggcctccaggcttccaacttgcctgtgcagtgttcttccatggggtagctagagctgctaggagactctggggcgggaccttgccccggggcatggagggcacagggcagctgcagggcctgggtgtggcacaccctgggtgtctgcatgggggttgctcacgagggatggggctctgggcagaacacacaccgccccattgtggcagtcacattccttcctgacaggtggggctcgccaccagctggggcaaacagtgggtggttcttggctttcttttactgtggctgaaatggctgttttgagtcaacggaattctcaaggtttcgctggctttgtggccaggaagcaggtatatttgaagaatactggagactcagtggcattctggggtttgcttgtgacgagattcaccagcccttccttgtagactccccctgcttcacagcagaaagggcccaattagtccagatagccctgaacaccctgactcggcaggcaggctggctgcagcccagaggtggaagagttgcctggcgccgtgatgcccatgtggatggagtctgcctctgtattgcctgtctgacctcagccccttccagggcgcagtgaggcaaaagccacacgtctgtgaaaggtctagctaatgggtctccagtgcccgtgcctggctatggctaatgcataaagtgtcttactttgtttgggctgctgtgacaaagatgccttagactggggaacgtataaaccgcagaaatgtatttcttagttagaagctgggaagtccaagatccaggtgccaacaggatcggggtcttgtgagggcctgctcttcatagttggcactttctcacatccttgtctggctggagaggcacctgcgctccctccagtctctgttatgggccctcatcccatctgtgaaggcccctacatgacctcatcacctcccagaggccccaccttttgcactgaggaatggtgggggggggggggggcacaaatttcgaccgtagcaccacggttagtgccgagacccacacaatcatggtggccataagttaggcacccccgctacctgcgccttatgccagaggaggtcagtgggaagctccgagcaggaccgagagggtgagcacagacaagcgctgtgcggcgtctgtccgatygcgcaggctgcgctcctgctgcgttcacgtgcgaggccacagaaaacactcrcagcaggccacgccccaggcccctcacatgacagctcgcagaaaacgctggcacgcgttcgggcgtcaggcacacgcatctcaacagatgtggctgacacccaaggcagtcggcctcagtgccctgtcacccacctagaacctgttcacagcatgtcatccgggctgctctggccttgactggacatgattatttatccttacacaccgtggctgctctacaggccaagaaacaggctgctcagccagggtcaggagaargtgggtcaggctccccggggacctcaggccctgacgcatcctggcctcaccctaggcctcctctgtcggggcagcctggctcagcagagcccgggacacacggctgaggccacccaggctgggccrtcttgcccctgttttgtgccccctactcagttctccttctgtcctggctcaggtstaggccagtcaagagggtggctgagaagcaggaggagcctcagagaccctcccctcgaaagcactggggcttccacctcacaagcggcaggttcgctttgggagctgctggtccatcgcccaggcctggccaggggcaggcgaggatcctggttgccgatccatcgtccaggcctggccaggagccggtgaggaacctggggctgttgtgcaggggtcgccgtctccagctctctgccgtggtgaggggattgtgctgtgtgcacaccaccgggctgcatcgaatcccaccatggcccagagggtggacctgtggctccttggggggccagcatctccagtctaatgggtgcccctgccactctcctgagttcccgtgcagagctccccccaacacctcagccttcacctttctcagttaatcaaaagattccaaaaaaagcaaacccatcagaacggcttcctccaccgagtgttcaggaacaatgagcgtgcccatggcaggcacatataccttcctccagagagagcgccttttatttcccatccgctgaggctggttcaacagcttgttggctgtgacagccagtgatcacctgtatttcaaagagacacacaaacactgcagcctttgaaagaatcaggccctcgggacaggtctgtggtcttggcgtcagcaggcgtgcggcgagggaggcggcgggtgctccaaggccctgctttgcttccccagtccccacccatctgctgggaagaaactaaaggctggaattcccccctgccctctgtgcgcagctcttccctcgctcccctctgctattcgacctcgttgctgcagtccggttggggatatccaggactgcgccgggagtgcccctcactgtctcagcctctgtcctgtctgtggcntgtgcatcattctgaggagaaggctggattttgtgctctgccctgggagcaggtgttgaactgcacccacttgtgcacagtgtcagccctacccccatcgctggcagctgacgccaagcagaactggcctgcgtacccttgaaatcctgttcaagctctgcctgccgctcgggcaggccccaggctgcctcctgccccaggccagcctgggagcacacttggtgcctgggagcacacagagggagcacacttggtgagcggagaagcttctgcgcagcctactctctctctggggcctcaaagggcccakcaaggcaggcagggagcatcatgcacctcttccagatgaggcccccagctggcgagcaccagaacctggagcctggcccctcctcagcagatcagacctcccagtccccagcacctgtggagggcacaggaccactcccttctagagactctgtgtctccaggtgaggccgagaactcatgtttccccagctccctgcatggctctgttacacaccaggctcaggacttcagctcggccccttctagcctgcggctcccgctctggttgtggagagtgggtagagcgggcgtcgtgtcgccctgtgtggggcagttacagcctgggcttcctccaagtcagatcccttctcaagggaagtatcgcggcgcgtcagttatgtttgcatagaggtccctgcttgaaaaacattgatttcaccaccattgtagggtgtttgggttactctcttcttttccatttaacggtatgttgccaaatttttacacacatcttagaatgttttcttaagataaaaatccaagtagtgaaattacctgatcaaggaattggatatattttccccaggttgcgcttcagaaaggctgtggacgaagtgttaggagcattcctgtttcaccgcagccccccagaactgggtctgcatcaaatttgtgtgctttgccgagttagtaggtgaatagtggaattgcgcgtgtctttatgagcacagagcgctcattggccggaggtgcatcttcatgagtacgttgctcatgggcccgtccttgcctggataggaggaaccygggacttgattggtcttgccacagcctggtggtctagttgctttgtggggtgtgcagtcctggggctgcgggaggggagtaacccttagtaacctgtgtgtctgcccctccacagaactgtcagaccttcagcagcctcagctgcctgagygcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccgggggacgggggaaggctgcccatggccacagctgcatcatggggagcccttctagggccaggagccccaggacagcagtggggagacactccttgtgtcacttgagttagaagccatggaggagtctgcccttccgagcacagcagctcagccttcgacagcgctgggaggtgaggccacacagcagcgtgcggagatgggcccagcctggcctgcagccctgaggggcctgggatggcccccaccacccacccaccagggtagctgaggtggcacagacaggctcactggctccgggtttctgcccccgctgcaggcagcacagtgcagacttctgctgcgtgagtgagttgcgggggccccagaagcacgaagcccagcccggcgtggcccactgtctcccgtgcatggccctctgcttacccggactcaggagaagggcgtgtttgcggcctggaggacaggcgtggagaggtttgcttgatttccataactcaacacttgcccacacaatctgcccatggaagtctggcctagaatgcttgttagggccagagcagcccctctgggaatgaggctctgtagcccccgcttttcttttggtttttgcttttagcaagattttttttttttaagtctatgagcactgaactcaagaaacaaacatgtgaagtggggctgctggggggaggtgagccccttgtcctcactgccatccctgcagccctgccttacccaaggcctagggactcactgattcgaggctggatgcattgacttccccagcacaccctcccctcacccctgcctccgtatctgacagatgactggtgggccaggggctggcggggggcttctacccagcgcagtgcccccacccttgtgccccayctgagggtagggcacagagtggccctggaattacctctggcccttaccagccccttgctgcccccaatccctagatgaggtccctggctggatggatagctccgttctgcccccacgtggggcctggccccaggcctcacccccagtgcagtgcccaggccaggcacaggtgcttctgacatggggcacacgtgtagtctccttacctgcacagcgatcataaccctgtgggcttacgagagagactcagccactctgtccagtgtgcagggaaagggctggaaggaagaaggccgaaaggaaaggccccagagagcacagtgctcagactcccgggtgacttctggtttctttttatatacttctgttaaatttcctgtaataacacatgctgcttttataatgttaaaaaaaccacgtagaatgtaggctgccccgtgtgttcacctcctaaaccaggacagttctgaggggcagctggaactgttgacacgcactctggcacgggaggcggacccaagagcacccaccccagaggggcaccacactcgcccgtcccgccctgtgtccccacctctgccctgaggtgaacacaggaggctttccacctgccagctgccagccaacctccccgagaggggcaggaaccgaccagcaggacagacccacccaggacagcggcaccaggtcaggcctcagcctttccgatcctctggagggctcaagccgaacggaaggagggaagaactgcagtcacctgggccggtggcgctcacatctgacgtggaggcctctgcttcacttggcccagttcccagccttgtcggcagtgaggacatggaccctcgctggcatccgtcctccgtctggcacaacgtgccgtgttctctctggttagggtttgggtgggacggagactgcgcccctgttcctggtccgcctaagtctctgccagtctgagtctcgtgggccttttctgcaggccctggggttgcggagcaggcagggggacgtcggtggctgggggacatcccgccacctgccaagtagctgcaatgggaagagatgcggttcccgtgacagccaggcctggatgttcaagtcatgtgagaccaccaaataccttgttgcactaagccaatttgaattgagttttcataagtggtacattgagcccagggcttggtactgtgtgggccctagagctggaaggtgcaagggtgggtgaggcccgagaggcctgctctccctgtcctcccctccaccccccaccctgctacccttcacggttgcctggcctggcagctcccgagcctgggaggtgtggctgggcctaggctgctgctcactcccagcctcggtgggaaagacccctgggagcaccccggacctgtggtcctgagtctttttttcacgacagttccgcgacatgtgttgaacacagggccttagcccattggcagccccgaactccagccccgcatgcggccggcggttccacaccgtctctgccagggcccgggccccctccacatgctggaagtggccaggctgccggaaggagccaggggtgaaggaggtcattcctcacttctaggcaacaccgacccccaggcaagcatcacaccacggctcatcagctccagccagagacagggcaccccgcagggccaggaagtgcctgtaaaagaagtgaatccctctgttttatagacggggtaacaggctcgggctacaccaccccaccacaggtgtggctggacctcacccctcagaagagctcatctctagagtgaggacactggtgccctggctcagccggaaagtcagccacaggggccaccacatgcgtcccccacaggaggattccaggcaagggtgggaagcagcacggcaacagaaggggctagaaagggcctgggaggcggggctggaccttcctgcaagtcgcagctccacccctcactaactgttggccctcagcaagccgcgagctcaccgcaccccagactctagacccgtgcagtgggaaggatgacaacacccacttcactgagcccaccgcggctcagagggtggcatgctcccgccccaacaaagcagggggctgcacctccaggggctgtccctctgggcaccccactcctgggtagcaacttgaaagaggaggtctcggctgggcgcagtggctcacgcctgtaatctcagcactttgggaggccgaggcaggcggatcacaaggtcaggagatcgagaccatcttggctagcacggtgaaaccctgtctctactaaaaaatacaaaaaattagctgggcgtggtggcaggtacctgtagtcccagccactcgggaggctgaggcagggaaatggtgtgaacccgggaggcggagtttgcagtgagccgagattggccactgcactccagcctgggcgacagagcgagactccgtctcaaaaaaaaaaaaaaagaggtctcagcttgaactccttcccccagaggggttgctgtcttggcgggaagcttccccattaaacacaaaagaaagaaaaaactaaagacctacaaacaaaccggcatcacgcacagcctggcatcacgcacagcccggcatcacgcacagcccggcatcacgcacagcccggcatcacccccagcccggcatcacgcacagcccggcatcacacacaaacccggcatcacacacagccccggcatcacccgcagcccggcatcacccgcagcccggcatcacgcacagcccggcatcacccgcagcccggcatcacccacaaacccggcatcacgcacagcccggcatcacccacaaacccggcatcacgcacagcccggcatcacccgcagcccggcatcacccacaaactcggcatcacccacaaacccggcatcacgcacagcatggcatcacccacagcccggcatcacgcacagcccggcatcacgcacagcccctccaggctgccactgaactgcagccgccgcctgaacgtcctgtattgtctcctaaggagctgccatcaggggactccatcaaggagccagccatctgcatattttccaactaaggggccaaatggccctccctcaaatccagtgacactggcccggctggtggcctctcatcttgctgaaaagactgtcaccgtttcccccaatcctgatttaatgggcggccttgcgggggctgtacttgcccctccccggcgtgggtcccacactttcttatcgtccaccttcatgtggtggaaatcctgctccggagacccatggcttctctcataagaagcgctctccaggccgggcgcagtggctcatgcctgtaataccagcactttggaaggccgaggtgggcggatcacctgaggttgggagttcgagaccagcctgaccaacatggtgaaaccctgtctctactaaaaatacaaaaaattagccaggcgtggtggcgggcacctataatcccagctactcgggaggctgaggcgggagaatagcttgaacccaggaggcggaggttgcagtgagctgagatcacgccagtgccctccagcctgggcaacgaaagcaaaactccatttcaaaaataataataataaaataaaataaagaagcagtctctcaagggttatcagtagcttctgaactgatttggggagaaatggagcaatcaagttatctgttcagctgactgattctgaaacctgaaacttcagttatgagtgatttgttcccagggcccctgtgggaaggccgccgcgcccttggtcgggaaagcaaagctcaccacccccaggccacaggctgttccgttagggaaggcagtgccaaagtttgccctggactgccttgttccagatagggccaacagcagctcactggcccctctgggcctcagtttccccatctgctaagtgaaggggctggagcaggtgaggtgtttcagggcccttgtccctcgcacctctgatattcagtggctcaagcataaggcaggactagagacagtggcccagaccctgctggtggcctcccccatacggttcttcctagcagtcaaagcctgagtcaaaggctgctggtcaaggcagagtttactgaactgttagtttcctcctgcacacaccgggcatgacaccttcaagtctgtccagcagtgggtccagaaagtaccctgtgtgccttggacgcagaggctacagttctcactgtgtggcatgggagccttcacagtgccctcgggagctgcccctggtctttgtctgcaaaggtgactgggaggatagaaaaagcagcgggctggcattgtttcgggggtggggtggtgggcagtgtgcctgggcagtcgcagggaggctgacttggttctgggctgcaagatctgtgcataggaggcccctgggtttcttccaggctcttcactgaaatgcaaagagtctgaagaggaggcagtgggcatagtgcccctgaatctggttaggtggagtttactgcatttaaaggcccatggtgagtggtgagttctgggatttgggagattcccagaggcctgacaggcctgtcccaccctcctggacttcactacagggagctgaagtcagggcccaggcaggggagcaggccacccaggtagggaacaaatgcctgcccatgcagggcagagggcagaaggcagggctgtcagggccttggttggtctgggcactggggcaggtggaggggaggcaggggtggaggagaggcaggggtggaggaggtggggctctcctgggcgggtggaggagaggcaggggtggaggggaggcaggggtggaggagaggcaggggtggaggaggcggggctctcccaggaggccatcacttgtcggcgtgctgcagcagcaggtccactgcctctgcgaggttgtccacgtacccatcagccttcacttccggatggtgctcgtcactgggcctggagaggatggccggaggttagtcagtgcccccacgctgacccctctgcagccacacccaccctcccagcatctaacatgggcctggccttagcttgaggaaacctccaggtcctgccaggcagcctggcccgtggccact

SEQ ID NO: 10628 - DNA, 15523 bp, Homo sapiens
tttctattctttttcctttcgtgctttatttctctttcattccctgtcttccttcttttttctttcctgtctgtttctttttcccttctttccttcatttctttcctcagtctttctctttttcatgtttctttcctttccatctctctttcaaaaatggaatgtttaaaaagttttctttctgtatctacattttttaaattttctctcttttctccattttcttcctccctccctccctgctcccttcccttcctccttacctttcaccatctgtctcttttctccattccctccctccctccctccctctttctctccctctgtctgtgtttgtgtggattctggaagagcctacgtattctgcatcgccctgtgtccacagcgacccaccaccgagtccttgtttgttctttctccctccctccgagatgcatctccaaatacccacacgccatgggttgtcttctgactctgtcgcggtcgatgcagagacacgttttggggaccgtttctgtggggttgggggagaggggctgcgtttttggcctcgggaagagcttcttgactcacggtttcgcttttgccatccttgggccgccctgccatctggatctgtcttgctgacgttcgcgacggttgtcgggctctatctggcgtctgcttttatatcgtgctcttggcttccggagctgcggtggcaggtttatgtgggggtgggggctctcactgtgcttctgggcccgagccgggtgtggggctgcccgggctgatcgaccagcatgtcgcagatcccgaggcccgagccgcaaagcgggaggctggggacgcccttcctggcctggtcgctggaccacgcgcatcctggccgtctgaggcggtggccgaatttgtttctgagtccccgtggggagccggagaccgtcctgcccctgtcaccctggtgcaggggagcggtccccgggctgggccgtggccctctgctgggatcttttctggcaagtccctgtgcggagtcagagagcgctcccagagcgcgtgtgcggcccaagaggtaacacctggcgggccttcagtccctcgtgcgtcctggtcgtacgacaggccggccgaaaatgtttccgagtctcgctctggagacatgggcaggcccctacgtgtggcatgggcggcagagagggcgtccctggcccagcactgctcccgcgtgtgtcctggggttgaccagagggccctgggtgctctgtgtctggctctgatggtggcgtttttgaggacagatgtccgtgtcttggtttcctgggccagcggcatcgtcggtgactcgatctcctgcccccgggggaggtatatctttcactccaagtcggcattttgggccaccaagttattgttgacacgttgttgtctggcgacctgtcgctggagaggttgggtctctggatgtgtgccgggttctggcttaccggtgacccagttagccagctctgctcctgtttgagccacctgctgggatccgcgggcttgctgctttctcgctcatctgagaatcccgactctcggtgctggcccagatccaggcctctgacccacctgggggtggcgggggctaccctacccctgttcgatctccactgtgggcacctggggcggccgtcacaaccccatgatgttggctctgtgctgtgcrtgtcaggcattctcgtctccattgggttgtccgccgtcccttccccagagtgaggaatggctgggctgatcggctctctcgctggcrggctggctgacccccgctcctgggggtgctctttgtgatcaatgtggtgatgtcatgctctcccaggcagggtgccagccgcgacgggtgaggggcggatgttcgtggtgatgggaccattgttttcatcccgcttgcgagggcctccttgtctctctccccgtctgtggctggtgcgttgggaaggcatgagtatggaatccagcctgacctcactgtcccaaccccaccttctacttcgcaggatgtgtcggcgaggttatctgacgtggcaggcacctctcgctctcgcttcctgtggttgtcgacttgcgggtggccccctccgcggtggcccgtcgtgctgctttctcggggtttgcatgagcattggctctgcctgggcctttgcggtgctccgggttgtccctcaggtgcccgaggccgagccgtgatgtgtcgttcccacccccagcggcccctcctccggtcgccgccgtggtgtctgcgtgtggctcctgagggagctcgttggtgtggggctcaaggcggttgagtgagacgcgcccctcccacgcggggaaaaccgcctcctggtctggtgagcacacgtcctgtgctcccctctggcgggtgcgaaagagccgtgtgagcgatcgcggtgggctagggccggtgacatgtgtgccagccgaccaccgagaaactaccgtttctgcctctggccagtcgttatgtgggtttacttttggagatggtttgcctcgaaagaaaggcgggtggactgggggccttaggtgttgttcgcacgcgcacaggccgggcccctgccctgaccgtaaatgctcaaggttgccgcacgcaggttttttcttgtaccgcaaggtccccttccttctccggcatccctgagcgcctctgtgggccagacgaggggcgactggtgggtggggagtgtgacctgccctgggtgagaaagccttctttatcaatttgagaagtgtgcctttggggtaccggatactctcggcctgccacctctgtgttatggtagcgctgccgtagcggctcgcttgcagagaaccctcctcctcttaccccctggacaggttgaaggggggagagcaagggttccgctggccaccgcggtggtggccgagcgtggctcgtcgccaactgtggcccccgcctcaccattccgagctgggggaggataccgtctggtcaggcccagcgtcctagcggttgtgaaccaactgccacgaggggtgggtgtgcgtggtgttccgtccggcgtgtgaccccctctgctgccagtctgctctctgcccgctcccatgccaaatcacgaccagtgccgatgaccgcgtttgcagggcatggggttgggccgtctggccctgggaaagcatcccgcggtgggggtgcgcccgtctcctggagcgggaccggtttgggggagggacgagaaacacgtgcaatgagacgctggcattggatttgtggctgtggtctcttcggggccccggtggcgggaccgggggctcgtgaggtgggtgtcagtgggtgccgaggtctgtctggcatcccaggcggagcgctgtgggaccgccctcgtgtctgttggtggtgggatcccgtggccgtgttttcctggtggcctggcagtgcctgaggtttctacccgagccgctcctctgtgggatcatgggtgcccttgccctcacagtccctggcccttgcctgtctgtgccccccttccccgcccgccgatcctctctacctgagtggctcactgggtttacgttggtggtggccccatctgggaccgaactggttgacccggtgtccacttcccctggagcgtgtgctttcgggatcgggttggtagcgccacgcgtgggcctggtgggcgcttggagggtttttgggttggcttgcagcacgtgcggagaaagagttccgggggctggccgcgactgcggtggcagtggggggagccacggggatcgccaaaggccagttggccactccaggtgcggcgcggggttgccttcgtgctcagaggctgctggcggtgagactccggcgtgtgtcctgtccgcgattggctgctctcgaggcgtcctgtggtgtccccttccccactggcaggctttctcatgccttcccttcacctcggccttcccctggggtctcttcttctcccggccggctcttctgaattgggtcggcgagaccccaggtgtgccttccttcctgggcctgctgcggccgttacctgaagcgtctgtcctgagcgttggtgtcagggagagcccgtcctccctgcgtgatgttaccctgtttggcgcatgcacctgagcacagcccggtggtccctcccagacaggcattcttgcgatgtggggtgaagtttgatctctgccttgctggtcgctcggcctttccctgggtcgggggtgggggtgagcatgccagccggcttccttcgctctcctttggccgtcgtgtggtgtctgcaacccctgcgcctgtgcccctcggtggggattggagccgggccttgaccaggacaggtgtgtgggtgctgcggccacacagcacgactgttgccaggcacggcaccgtggtccgcttctcgctctccacccgaacgtcagggcgccccgtggggcggggggagcactgtctcctcgccgccgccctgcacccgctgtgcgcacgcatggccgccagttcatcgcggctgctgggcacgggtcgggcggtccgcctcctcgcatgtggacgagaagggtcggtggtggtgagcccattggggggtggtggtgtgtcgtgtgggtggggtgtccggttttccatgccccacctcccacctaccgccccgcgcccatgccctgccgccagcccggccgcaacccatcttcacgtccggggtgctgggcccctacttgcaaggccttggccttgtcggggcctcaccgcgctttacttacctggttcatcctgccagtaacatgtttgtctgagagattaagccatgcgtatctaagtatgcatggccggtacagtgaaactgcgaatggctcattaaatcagttatggttcctttagtttctcgctcttcttctacttggataacttaattctagaggtagtacatgctgacaggcactgaacccttcacaggggatgcgtgcagttatcagatcaaaaccaacctggtcagcccctctttggccgcagccgaggggtgggcgccggcggctttggtgactgtagataacctcgggccgatcgcacgccccctgtggcagtgacgacccattcgaacgtctgccctatcaaattttgatggcagtcaccatgcgtaccatggtgactatggatgackgcatcagggttcgattccagagagggagcctgacaaatggctaccacatccagggaaggcagcaggcacgcaagttacccactccggacctggggatgtagtgatgaaaaataatacaggactcttttgagggcctgtaattggaatgagtccactttaaatcctttaacgaggatccattggagggcaagtctggtgccagcagccacggtaattccagctccaataacgtatattaaagttgctgcacttaaaaagctcgtagttggatcttggggacgggtggtgtcacctctatgctcttagctgagtgtcctgtggggcccgaagtgtttgaaaaaactagtgttcaaagcaggcccgagccacctggattctgaagctaggaataatggaagaggaccgtggttctattttgtgggtttttgaactgaggccatgattaagagggacggccggkgggctttcatattgcacctctagaggtgaaattcttggaccggcacaagacggaccagagcgaaagcatttgccaagaatgttttcattaatcaagaatgaaagtcggaggtttgaagatgatcagataccgtcataattcccaccataaacgatgctgactggtgatgtggtggcattattcccatgacctgccaggcagcttccgggaaaccaaagtctttgggttccggtrggagtatggttgcaaagctgaaacaaaggaattaacagaagggcaccaccaggagtggagcctgtggcttaatttgactcaacacgggaaacctcacccggacagggacaggattgacagctctttctcgattccgtgagtggtggtgcatggctgttcttggtggagcgatttgtctggctaattccgataataaacgagactctggcatgctaactcattatgcgaccccagagtggtcagcgtcctsaaacttcttagagggacaagtggcattcagccacccgagattgagcagtaacaggtctgtgatgcccttagatgtccggggctgmatgtgtgttacactgsctcagcgtgtgcctaccctatgctggcaggtgcgggtaacccattgaacctcatttgtgatggggatgggggattgcaattattccccatgaatgagcaattcccagtaagtgtgggtcataagcttgcgttaagtccctgccctttgtaccacacagccagtcgctaataccaagtsgatggtttaatgaggccctcagaacccaaatcgacctcataggactcttagcagtggatcactcagctcgtgcatcaaagaatgcagctagctatgataatttgaattgcaggacacattgatcaccgacacttcgaaagcacttgtggccctgggttcctcacatgactatgcctgtctgagcgtcacttgctgatcaattgcccctgggggtgcctctgggttccttggggtgtgtggctagggggttcccttgcagggtctgccggggycctccatccccccaagtacagacccagcgatgttcgcccttccgctgygcacgccccttccccctcaccctgtgggccctgtgtggtcacgtgttggtggcagggggaaggggggcccggctgggagagagatggtggtgtcaccgcccacaaaaatggagagggaagaaagctggctctggccgagctcctgtggctgccaatgtggtccaggttcctccctttggagctaccttgtgctgcacgtggctcgtggttcattggccctggccaggtggaaggtcccgtgccattgtcgtcgcgcttcgtcagtggtgggggtgcgtcgtgggggggaggaaggtaggtctggaagggtctggcagggagatggtcggggagcgtgtcctggttgttgtggttcactgcctgcccctggtggcggcctggtgtctggctgaccgctgctcccgtgcccctgctccctaccacccctatggggcactgtccccctcacccgccgcctgcccacctggcttgctttgtggcgtgtatggggctggaagcccacctcgcggcccgcccaggcgcactcgtggctgcggtcccagggttcgcgggacgccgtggtgtcgtctgccatcgcgtgactgcctccagcttgtggccgtgccatgccgggtccctgtcctgagcttccgcgttggggtggggcggtgcggctgctgcaaccttggacctgtcccccagggaggtgtgcggtggccgtcccacccctggcctgtgcccttccctcccgtcatcctgctgtggcagggtggcaggggtgcagtcagccgtggctctctcgctctcgcctctcccttagccgggcccgtctcccgacagagcgtcgggtggtcaggcaggctggtgcatttcatcagtccgctgaccagcccacccctgccggcccatttgcctcgttcccctccgagacgtgacatcagatcagacgtggcaacccgctgaatttaagcgtattagtgagcggaggaaaagagactaaccaggattccctcagtaacggtgagtgaagagggaagagcccagcgccgaatccccgccctggggtggggtgtgggaaatgttgtgtatggaaggcccagtccctggcactgctcgtcggtggcccaagtcctgatctaggccaagactgtggatggtgtgaggctggtagcggcccctggcgtgctgggcctgggtcttcctggagttgggttgcttgggaatgcagaccaaagtgggtggtaaacatctaaggctaaataccggcacgagaccaatagtgaagtaccgtaagggaaagttgaaaagaactttgaagagcgtgcaagagggcgtgaaaccattaagaggtaaacgggtggggtccgcgcagtctgctcagaggattcaacctggtggcgggtccggccgtgtcggtggcccagtggatctttcccgccccaagttcctcccgaaccctccacccgccctccctccccgactgcccctcctcctccccggaggtgggttggtgtgggcgggcagggccggggtcggtgggtgaccatcccctaactggcgactggcggccgcccggcgcatttccaccacagcggtgcactgtggctggctctgggatggttgggaaggcccggtggggaaaggtgggtctgggggccccgtccgtccttccccgtcttctccccggccccgcgtcctccctcgggaggccatgcgggtcggggtggcggcagtggtgggaccgaacctcctgagttacagaccccccgcagcagccctagccaaatcccagggcggagggagcgagacccattgccgtgctctcccttgccggtgcccacccccttgggggtgcgcctgtgtctcctggtggggggctgggccaccccgcccacggtgtgactgctctcccacccgcctccatgcatccccaccgacgggggaccgcatagaggggtggggtagactgtccccagtgtgccatgggcgggtcacactgtcggccccgggggagttctctcggggccatgcggacgtcactcggtggagcgagcacatggggtcagcggcgacgttgtctccccacccgaccctacttgaaaaatggaccaaggttaacacgttgatgagtcaggggctcccacgaaagccgctgtggagcaatgaaggtgaagggcggtgtgctcgctggccgaggtgggatcccgaggcctctccagtctgccgacggcataccaccgtcccgtctcgcctgccgcggcagggaggtggagcacgagcgcacgtgttaggacccaaaagatggtgaactatgcctgggcagggtggaaccagaggaaacgctggtggaggtccgtagcggccctgacgtgcaaatcggtctttcgacctgggtatagggggtaaaagactaatcaaaccatctagtagctggttccctctgaagtttcccttaggatacctggtgctctcgcaaacctaacctccccacacagttttatccggtaaagcgaatgattagaggtcttggtgccgaaacgatctcaacctattctgaaactttaaatgtgtaagaagtccggcttgctggcgtggagctgggcgtggaatgcgagtgcttagtgggctacttttggtaagtagaactggcattgtgggatgaacagaatgccgggttaaggtgcccgatgccaacaatcatcagacccgagaaaatgtgttggttgatatagacagcaggacrgtggccatggaagttggaatctgctaaggagtgtgtaacaactcacctgctgaatcaactagccctgaaaatggatggtgctggagygtccggcccatacccggccgttgctggcagttgagagtggacgggagcggcaggggcgttatgcccgtgtgagtgtggtgggggtcctctcctgcaccctcccccagagccccacggattctatgccgcgacgagtaggagggccgctgcggtaagctttgaagtctagggcatgggcccggttggagccactgcaggtgcagaacttggtggtagtagcaaattttcaaatgagaacwttgaaggcctaagtggagaagggttccatgwgaacarcagttgaacatgtgtcggttggtcctgagagatgggtgagtgccgttccgaagggacrggtgagggcctccattgacctcagccggttgaaagggagacgggttcagatccctgaatccagagtggcagagatgggcaccatgaggcttccagtgcggtaatgtgaccgatcctggagaagcatgcaggagccccggggagggttctcttttctttgtgaagggcaggacgccctggaatgggttcgccctgagagaggggcctgtaccttggaaagcgtcgtggttctggcggcatctggtgagctctggctggcctttgaaaatccaggggagactgtgtaagtctcgcacagggccatacccatatctgcagcaggtctccaaggtgaacagactctggcatgttggaacaatgtaggtaagggaagtcagcaagctggatccgtaactttgggataagtattggctgtaagggctgggtgcgtgccgccactggacgaggtgccaccacccccccacgcccagggcgagcctgtcgtggccctcccctgccccacgccgcgtgccgctccctaccccgccccctctctccctgtcctccccctccctggggttggcggtggccatagggccctgttggtggggcatgacctcccgtgatggggcccagggggctggtgttggccgtgactctggacgcaagttgggccattcccgtggattaccccagttgtggccgcccatggggagcctggtggttgctggtgtgccctgtctcgctccgcaccatcgtgtatgtccgcgtgggcagggaacgaccgggtgtccgtgggtggtgggcggggtggttcgttcccccacctcccccgggccccatccttctcctgtccccacctctgtggcggtggcgggctgctggctggtccctgcccccggggctgcggttccgtgcagcgcctcggccagtgcttagcagccgacttagaactggtgtgcaccaggggaatccgactgtttaaacaaagcatcgcgaaggcccttgggggctgttgcaaagtgatttctgccaattgctctgaatgtcaaaatgaagaaactcaatgaagcacgggtaaatggagggagtaactgtgactctcttaaggtagccaaatgcttcgtcatctaactagtgatgtgcatgaatggatgaatgagattctcactgtccctacctacttactctccagtgaaacaacagccaagggaatgggattggtggaatcagtggggaaagaagaccctgttgagcttgactctagtctggcatggtgaagagatgtgagagatgtagaataagtgggaggtcccctgtgatcccctgtccccctgagggggaggggtggggtcctgtgggctgcccgtggaatactaccactctgatagttttttcactgacctggtgaggcagggggtgagctctgaggggctctcccttctggcgccaagtgtccagctgtgcgctggctgggtgtgacccattccggggacagtgccaggtggggagtttgcagcggtacacctgttgaacggtaatgctggtgtcctaaggcgagctcagggaggacagaaacttcgtgaggagaagggcaaaagctcgcttgatcttgattttcagtgggaatacagactgaaagctgggctttgactatccttctgacctttttaagcaggaggttgtcaggaagttaccacaggagataactggcttgttgtggccaagtgttcataaggacgttgctttttgatcctttgatgttggctcttcctatcattgtgaagtagaattcacccagcattggattgttcaactaatagggcatgtgagctggatttagaccgtcgtgagacaggttagttttaccctacatgatgtgttgccatggtacctgctcagcatgagaggaaccacaggttcagacatgtgcttggttgaggagccaatggggtgaaactaccatctgttggattatgactgaatgcctctaagtcagaatcccacccaggtggaaggatacagcaacgtcatggagccttggttggccttggatagctggttccccatccctgctggtgggctgcggcgccctgggttaggtgtgtcccaccatgtgccaggactgggtccggtgcagagtgcccttcatcctgggaagggtgtggctggaaaggctacctactcgcccgtcacgcagcatacattcggggggaagttggcactaaaccattcatagacgacctgcttccgggtcagagtttcataagtagcagaacagctccctctctgtgatctattgtaagtcagcccttgacagaagggtttgtccgcgtgtgtgtggggtggcccggtggggtgggcttgtctggcaccatccatcttcctctctcctgacctctcaccgaccacgggtgaggggggtgcttgtccccaccggcgtgccccgatactttggttcccctctcctccctgttcactgccgaggtggcttgtctgctctgggctggaaggtgctcggggagcatggggtggacctgtggaggtggctgtgccgagctgggtctgtagcctgccagcccctgccccaggggtggccgtgcgggcccgtggggtggccacctggggttctggccttcgtgccctttctctttcctccacatgggtcgaccagtactgcaggtggcgggaagcgcgtggcaaggcccagggcgtccccaccatggccaatctccactcgtggctgctcctcggtcgggcctccggggtcgaccagctgccgcccgagggtgtgagacagccggcggctcgctgtgtcacatgccgatcagcaggacctctggaccaagcggtgtgcaggggtgcccgtcaggatgagccggatccagagtgtccgcatcttggtgggaacctccagggttgaccagctgccgcccgtgagctccagacttagccggcggctccctgtgtcccaggttgaccagcaggtggcctgtggcggtcccactggatggtgtggctcacccatgtgagggcacctatccccattcatgcgtgggtggccctcaccagcctcagcctttggtggagctgggaccacgcggaactccctctcttacatttttttcagacccactttgtttgcttccacggtacttttaagagagagtcactgttgccgtcagtaagtaatacttcctccttttgtttttttggttttgtcttgtgtttttttttttctttttttcctttctttctttctttcctttttctggggatggagtctcgctctgtcgcccaggctggagctggagctggaatgcagtggtgccttctcggctcactgctgccgttgcctctgcctccagggttcaagcgaacagcaatttttgtattttgagtaaagacggaatttcaccatattggccaggctggtctcgaactcctgaccttccacccgcctcagcctcccaaagagtgctgggagtacagacgtgagccaccacgcctagccaattccttttttccttcaatcttattttctgcacgctgctgtgtataaacatacatttttatatatatatatacacacacacatacatacttacacacacataaatatgtagtgataaaactatatagatatttccataattaatacgtttatattataaatgttaattttaatgtatgaatatgtattaaatgaaaacccatttcatttacatatacacgtgtatgtatatccttccttccttctttccttccttctttcatttattattttttattttcgcttatttattttttatttttgggcctgcctgtcttctcactctgggctctggtaacctcagcctcccaagtagctgggactacaggcatatcttaagcccgggaggcagtggctaacgtgggctatgatcgcgcaactccactccagcttatgtgaggtggggtgaggtggggtgaggtggggtgggatggggtggggagaaaaacaattgattgtgatcttaattaccttttaactttattcataccctcttatttgcttgtatattgtcatgggttattctatgtcattgtcatgttcatcgtttgctttcttgcttgcttgcttatttatttccttccttccttccttccttccttccttccttccttccttccttccttccttccttctttccttccttactggaagggtcttcctctgtctctgtcgcccaggatcaccccagactcaacactttggaccgaccaagcggtcgtcctgcctctgatctctcccatccccattacctgggactacaggcatgcaccaccacaccggttgacttttatgttgtttctcatgttttccttaggtatgtatgtatgtatgtatgtgagtgagatggggttcggggttctatcatgttgcccaggctggtctcgaactcctgttctcaagcaatctgcctgcctgcctcggccgcccacactgctgctattacaggcgtgagacactgcacctggctcattctatatttgcctgcctgcctgcctgcctgcctgtctatcaatcgtttttagtacggatgtgctctcgctttgttgtccatgctctgggcacacataatccctttttaaacttctatgattattattattacagatgtcatctcacatgtcgaggtgatctcaaacttttaggctccagcgatcctcccacatcggcctcccatagtgctgtgatgacacgtgtgggcacggtatgctttggtcatatttgtcatgtattggttctttccgtttttagtacggggactgcaaacaaaattttgagatgcatctcaccaatctgtcttttctttctttgtttttgttttttttctttagacggagtttcacttttgtcgcccagggtggagtacaatggcgcaatctcggctcaccgcaacctccgcctcccaggttcaagtgattctcctgcctcaaccttcccaagtagctggaatgacagcaatgccccatcatgccaggctaatttttctgtttttagtacagatggggtttctccatcttggtcaggctggtcttgaacttccgaccattggagaattttaactttcttggtggttgtttttcttctgtgtctgtcttctgtcttactctccttctctgcttgtccctctgtctgtctctctctccctccctttctgtttctctctttctctctgtctctctctttctgtctgtctctgtctttctctgtctctctctctgcctgtctcactgcatctgtcttctgtcttattctccttctctgcctctgtctgtctctctctctcccttcctgtctgtttctctctctctccctttctgtttctttctctctgtgtttctctctgtctttctctgtctctttctttttctctgtctctctctctgtgcctgtctctctgtctgtgcctatcttctgtcttactctttttctctgcctgtctgtctgtctctctctctctctgtctgtctccctccctccctgtctgtctgtttctctctgtctctgtctctctctttctgtttctgtctgtctctctctgtctgtctctgtctttctctctctgtctctttctctgtctgtctctccctttctttctctctgtctctctctgcctgtttctctctctgtctctctccctccctttctgtttctct

SEQ ID NO: 10629 - DNA, 18068 bp, Homo sapiens
agaaaatggatatgtctgtccaagtctttactgtcaactgtgagattcattctggtactgctgacatgtcgaggggacttgccaggcccctttttctctctggatctcccattttctcatctgaaaattggggccacgttggattatatgatagttcagggtccttccagagctaacatttgctacttctattctgcatgaggcaaagtagaatatccaggtcaaataaaaggaaaactttaagggactgttagaacaaacatcagccacgtgtgtgcgtgtgtgtgtgtatatatagagagagcttatgagttacacagatgtatcttgaaggcttgtggcaggtttgtgttgtgtcagcttatttctaacaggagagagtcaatctgatggtaacccagtgtcacctgtagctaggatcctttgcgggtcacaccctcatacctacccagagttggaaacccagaagatgtctgtggttttaggcacaaggtgtatttagttgttgttactgtgattgggcatccagtagtctatactcctgtttttcagtatagtcatgtgtcgcttaatgatggggatatgttctgagaaatgtatccttaggcaattttgtcattgtacaaacatcatagagtatatttacataaacctagatggtatagcctactacacacctaggctatatgctataagctgctgttcctaggctgcaaacctatacagcatgttactatactgaatattataggcaattgtaacacaatggtatttgtatatctaaatatatctaaacagaaaaggaatagtaaaactatgatattataatcttacgggactggctgggcatggtgggtcatgcctatatctcagcactttgagaggccaaggtgagaggatcacttcagggcaggagtttgagaccagcctgggcaacataccaagacactgtctctacacaaaaataaaaacattagctggggtggtgcacgcctgtattcccagctatttgggaggctgaagcaggaagagtgtttgagcctaggagttcaaggttacaatgagctatgattgcaccactgcctcggtgacagcaagaccctgtgtgaaaaaaatcttatgggaccactgtcacatatgtggcctgtcattgaccaaaacactgtaatgtgggacatgactgtatttgcttagtcatgctttttttgttgtttttttgttttgtttttgttttgttttttttgagacagtatctcgctctgtcacccagactggagtgcagtcccatgatcttggctcactacaacctccatctcctgggttcaagcaattctgcctcagcctcccgagtagctgggattacaggcgggcaccaccacgcccagctaatttttgtgtttttagtagagacggggtttttccatgttggccaggctggtctcgaacacctgacctcaggtgatccaccctccttggcctcccacaatgctggctgggattacaggcgtgagctactgcacccagcttgtatttgcttagttcttttttttttttctttttttgagacagagtctcgctctgtcgcccaggctggagtgcagtggctcgatctcggctccctgcaacctccacctactgggttcaagggattctcctgcctcagcctcctgagtagctgggattataggcgcccgccaccacacccggctaatttttgtatttttagtagagacggggtttcaccatgttggtcaggctggtctcgaactcctcacctcatgatctgcctgccttggtctcctaaagtgctggggttacaagtgtgagccactatgcccagccagttgttttttgttttgttttgttttgttttgttttgttttgtttttttgagatggagtctcactctattgcccaggctagggtgcagtggcgcaatcttggcccactgcaacctctgcctcctgggttcaagcaattgtcctgcctcagcctcccaagtagctgggattagaggtttgcgccaccatacctggctaatttttgtgtttttagtagagatggggtttcaccatgttggtcaggctggtcttgaactcctgacctcaggtgttstgcctgcctcggcctcccaaagtgttgggattacaggcgtgagccaccgcgcctggccacttagttcttattttcacattccaattccacctttccccctctctccctgagctttcagcacaatttttgttttctaaggtcatgttaactctgggtccttaggcctcaggctgtgttttcttgtcattgccccatcaccagcatctctcgtgcagggcaaactgcaggctgcagcacaccaagcatgttttcattttgatgtggctgttctgctttgtgtgggccctgcttctcttaccacctggttctggtcattgcagtggcccagctgttggccttttctcttagctcatggttgaggtgtggcctgagggttttgagagaaaatgatcaaactcaactttgtgttgtaggtgctctgggacctggagttccccacatcatcaacaccaaactgctgaagcactttacttgcttgacctacaacaatggcaggtcagggggtggttgctgggatttttcttgtgcaggagaaagtaggtgggggttgggagtgaggagcaggggcttggactcaattccatgtccacggagatgcagtgctgaaaagactgctgccatttggaaggctcctggggccccagtaagtttagcaaatgctaaatatgacatactctgcccttcttagaaaagtattaccttttgggaaccttagaagctctgggaagtcctacaataaagacttgttttacttcacatacttttgaatagcccttcccgatgtctcacagagctggtgttctgcggaaaggcagcattgcagaaaagggcagcccaactcggtgactctggggaaagacccgcaggccctgcccctgggcttccttcctgccatttgcatggmgtgtgttttctgctcttgagtgtgcttggaagaatcagcacagctgatttcgggatgattgttttcccagcagccctgctgggcaggcggggacagactcacagggccctcaccagctcaaagcgctagcagtgcccaggtagagtgtaggcccagctttctctatctgcctcagagggaaacatggactggcacactgctccactgtgtgtgaggcccaggaaccttggaagggcaaagtcacccacattccttttcctttcctgaagttgggaagacattccgtgcatatgagaataggattggatgttcttattttgcttttggagaaattgtctgagagtttaattttgtttctcctttattgccactgattttctagattacggaacttaatttcggattctatgaaggcgaagattacygcatatgtgatcatacttgccttgcacatacatgacttccaaattgacctgacartgttacagagggacttgaagctcagtgagaaaaggtgagcacaacagaataaagagctccctgcagggtgtctcgatgtcttatttctggtaccactggaaagcatgaggcaccaccaagggaactgaggatgtttaaatgtgggaacaacttggaactaaaggactattttcaatgaatgaatcattgactgaatgagcaactagacattactgagtgccttctctgtgctagataaattatgtcattatctcactgatttccctagaaaacaattgaagaatcaggctcagaaaagtacgtaacattctcaaggttacacaaccaagaggggagtagttggccttgagacctgagcctttccataacattctgttctgaataaccaggcagcctccattctctgaattgctgtcacaggggagagggattctgtatggttctgaggagtgcagctcagggtggaagttgtaggacaacccaatttgagcttagtaagaagagcttcctcacaatcagatggaagggtttgccaggggaaccgctggttccaaggccaggtggaactgctgtttggcagggattttatgtttgcacttctctgacccaactgggagagctggtggtggaggtgaccttttaggctccatctagccttgtagaggagattcagacagtaggggcagagctgcccaggaacctgaactgtgaggtcagctgatctttgtcagtgatttaggggcatctgacatccagtggcccagagggtgtctaggagagcctgtgaacacacctctgtctggactctctagcagtccgtggagggactgttctgagggctgtccacaaactgtgttcccacaggcagtgaggctgaaaaaaagagaacaggtacttggaacctgtcagattctagcaagtgctcaatcctggttgctaaaagtttggttatgggaggtaaagaaagttgctcacggggctgtagataccctggtttttcatcacccatatggatcttttgaagggcattaaaatgaaattggctgtctgatggttcccagcgggtgaggggaccttgcctgcctctctgccaggggctttgtgcctgctggcaacctttgggattctgtctttatggcctggagcatgaatgtgctgctaccttttgccaaacctccctgaacagtcatgttgaggggtctctccagttcttctgtttatgtcttccttaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttcatctctctcctttggtattattgctgtgattataaatggcagatgtttctcatgttggttcacctgtggggatttgggagggtgggtcctccctcccaaagttgactcaccaggctgagtcaaatctaatggatgaaggtttccaaagagaaatgtgaagtggcgtgcttaggtctggaagggccagtggagtacgcagtgaggaaggaggatctggcccagcacgcctgggaaatgacacttcaggctttatcagaagctaactgggtcaccagtgtgatgggggctgccacaggccagtaggatacagcctgttgtaatggggtggagccaagtcagaggaagtggtgacccaatttctctgtctggtggaggccacatagaaggcaggggtcagctatgaaagccacactttgaagaggatgaatcagtcagtgttcagttcagaaaatcaattgctctaggtatcttaagaagaatggattttaatgtatggataaggtgctgtagaattgtgacaagggccagaggactgggaatcggaaggttgccgtcaggactgctgaattcaagaacacactgccggggttgccatcggggactcagaagccacttctgctccataactgctcctggaattcatgcagctgaagattcaacactgggctgctgatttcagctacccatgctttcttctttttctttttatttttttgagacagagtcttgctctgtagcccaggctggagtgcagtggcacgatctcgctcactgctacctccgcctcccatggcctggttcaagcaattctcctgcctcagcctcccgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtgtgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggagggagacagaactcagctcctctgagaggagaagtttacacagcacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgactcttccttggaaaaaataatctctcagaaaaggacttctaatacatcctcagggtagaatgtgtttccgtgattactttttttttttgagayggagtttcgctcttgttgcccaggctggagtgcaatggcgtgatcttagctcactgcaacctctgcctcccgggttcaagtgcttctcctgcctcagcctcccgattacaggcatgcaccaccatgcccggctaattttgtatttttagtagagayagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatrcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcrgattcaggatttacatttttggcaggaacagcacagaaatgatgctgtgacccacrtgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcagtcttttgttgtggttttgctttttagagacagggtcttgctctgtcgctcaggctggagagcggtggtgcagtcagctcactccactcctgggctcaagccatcctcctgcctcagcctcctgagtagctaggactataggcatgcaccaccacgcccagctttgaatccgtcttttatccaaggagctctggccttttagcggagaatagcggatgacatgaatgatgggcctgaagcaggaagtgaaatgcaatcctgaccaccagacagatgggatcttcagctgcactcaggcaagaactaggctcggggtagaggtgacagctctgtgatggggagctcaggctgcaccaggaggccatgctaggtttgacttcatttaaaaagcacactacacagctgacgggctcaggagctccatgaagggcaccctgcagaggtctggagggtagtgagaaggtaccaatggggcgagcatgcctgtgtcgggaggctgatccgggtaggaataagcccagcatgccccacatgagcccaccatgaggaagcatttggagagaaagcttgctctgtgttgtcagaagggagattgaagaaggtgggcccaggggtgctgttgacagtataggctcatgtgctgttccaaggctyatctctggctcttgcctggtctggccataccatgtccacatccgctgtacttaggacttcctctgggcaccagggcagtggcctcaccaagacctggaggcctagatgatgaaatcatactggtgtttgctgtgcttgtacattcccatcagcagacatccgtgtttgggcctgactggccaacagggaagtccagggaggacacagtataagctgcttgggtagaggtcagctggaacctcttgtgaactctgcaccagagtgaagccttcacccatggcagtattcctgtgggtgggagggaagctactgcagactgaaagcaaatgattccaaggaaacacagtactttagagaattctctttagatccgtgagtgctgcccatggagctgggccattcctcctgagatacaggacaggacgcctcaactctgcttctttgggctctcccagacctacccaggccactggagtgagtctagagaaatgaccagggtggtgaagagacaccctgcaaactggcacatacgagaggaacccaggagggcagcagaccccagggggatgagggtgctgcctgcaaatctctgaagagttgtcacagaacagagtgaagagatgtcctttgggggccccaggaggtagagattctgggaatgaggttgggtttgtttcctcatttgtctgcctgtctgtccgccatccatccaacacttagtgagctttgctctgtgctgggcatagagaatcaacagtgaacaagatgggcaaagtccctgccctcaaccaacagactgaaaagagaggattcagtgccatctgcaggtggcatgtggctgagtgggcacaggagcatggagaaggcgcagttaactgttatttgtagagacaggggaaggtgttccatagaagtagtgactaaggagcttctgaaggaggggtagaatttagcgagggagagagactttggctcaattaagtaaaaagttagatgggctcagttttcttgggcaagtctggcctgttgtgcaaagcacccgcactccctgactcttccccaaacacaagagctaaggtgggtgttctgttcctcccacttctgcctccaaatgacctggagggaatttgtgtcccagctgttcccttccctgccacctttgctccaggtaatagccctcctcacacctctccacatctgatagggaactttcccctgccggatctcaggagcatcagcactcccagcctccaaaatggggacaatgagctcaccaagtcaatgtttaatacattattgacagaacttacgatgattttaggtggctcagggatgtagtaaagtacttgtgttctgctggttaggctaagctgaagtgacaaatggccctcaaatgtctggtttcaacaaaagttcatttgcttttgttgaatgtctggcacatgtctgtcagccagcaggcacctgggaccctgctccgggttagcttcaccccgggactcgggctgccatgtctgacacgtggtggtccactggcagagggacacacgatcggggcaagttctgctggcccttaaagcttctacccagaagtgaccattaaccacttctgcctacattcactgggcaaatcaggtcccatggcaacgtgagagggcatgtactytccctgaggggcagcaaacagtaactaccaaaaccaatgaatattttcattttaatagtttaatgtatgtttatagtaatataaaaagtcttttcagtgtgtgaaaaaaagacatgttgtaggatgggatcctggaatggaaaaaggacattaggtaacaaactaaagaaatctgaggccaggcacagtggctcatgtttgtaatcccagcactttgggggattgaagcaggyggatcacttgagcccaggagtttgagaccaggctaggcaacatggcaaaaccccgtctctacaaaaaaatacataaattagccaggcgtggtggtgcatgcctgtagtcccagctgctcaggaggctgaggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagttaataatgtgccagtactagtttatgaatttttacaaatgtacactgatagcataagatgttaataacacagaaactcgggggtggcaagggtgatatgggaactctagtaatcatctgtctgctcaatttttctgcatatttaaaacttctaaaaattaagtagatttaaagaaaaaagtactaacttctcaggtgacatatggatatagcaaaaattctaagatgctgagtaagtgaagttggggaagtgtgctccggggtctgaggtccctaagctgacagtccagtgatccatggggacggcctgtttctgttgtcttcacagagcaggcaggagtggaattatagcccgattgagcccttcagccctatatctggaactgtcacaggaacaagctgacccaacaagatggccccaggattctcctgtctccttcagaggaaacagtgctgggcctggccagctgggagccccagtatatgcccagactaaggaaaggcttccaaaagtgccttttttaaaatatagaactttattttggttactgaggtttttgttactgttggttcacagaaaagtcatttcttagaaaatagtaacggcagcattttttacagcgactcacattggggccaccaaacaagtgcaaaggacagtgccagggatagaagaggccagtactcttgtgcccagtgttctcagggagaacccagtgctcctggctccctctaccccctcccatcccacccaacagagcagcacctagggccaatagaaccagccacgcagccaagtgcacgacagtgaccccagcaggctggtgaaggccccacaggaaaggccgagtgggaggggattgttcaggttgagctggccctgcatccagccctcttcctcaggcagtggggtctgacctcacctggctttgggacttggacatattcacagtacggttcagtaaagtcctctgggagctggccttcctctcctcactcaggccactaatcctaccccaaccccaggctggatctggggacacacagtcagaagtggccctacctacggggagcacacaggtgagtggggggtcaggcaatggacccagatagctccaggacaaggcagaaagtgctcagtaccctgagagggagcagagaaaggccactgaggcccagagggggaaagagggcagggagagctatgtggaggtggcagtgtytcggctaaaccttgaggaacgaggacacggagatgggggagaagggcatgccgggaggaggaaagagcatgagccaaggcacagagtggggaggcttgggagggtcagtaaagaccagcgctcatccatgagaacacagatgcgaacgagaggcccaggtaccctcatctgaacaggctgatgctcaggaggggcggctggtgtgggcacgctcacatggggtttgaatccttctgcatttgggagctctctggggatggagtagagccttgtgcatccctgcccacccagcctagcatctgcctgcacgctgcagccccacctgtttcagcatgtccctcttgtcatccctggggcagcctttccatggggtctcctgttgctcccaggtccttccttcctcccaggtccatgtccaagtcctcaagtcaaccaaactcaactcctccagcctccagagacagctgggagggtgtggtggggtccctggagggattgagagggagacagctctagcaaaggggaaaattctggagcagttgtctctctccacctcactagaatcacttcccgccatcagaagtaaatctgctctttcctgagaagagtctgggtttggtgtgtgtaaaacacagttccttagaactcagagaaaatsctgaccaaaagcttcagcatttgagcttcccccgctcttcacaatctttatagacttcgagtgactggaaacccaccagcttctatcccttctccctgaaaaacattgcccactttcttcttgctatgggctgtggagctgaagtgttctggaggtaccgtgttttggaggcccgggacccatttgttcgagggggagggggaggggcggagtcttttcaggcagtatttccaccttagctcctctgagcacccatccaggcttggccctgaagcaggtctgtgtcctcacaggatggtgcagaagacactgcggttgctgtggtaaccaccttccacccgggctgtgatcctcgttgccatggctgtcaccttctgcccattgtgggctgccgagggacgtctgagagaattttcaaggtggggccgtgctggtgggttcaccaggcgccacgtatcagacctggaggtgcaaaacgaaagtcagtgaacttctgaggggtgtgcagtgctggctgaatgccctgcacagtcttaacttgggttccagatcggtggatccaggtgtttaaatctgggtgtaggytttatcttccagtttagtgttagtccaaagaggtgggctgttgagaaactaaggagcaaaagccctgcattccacgtccagctctgccttcaactctgcatgtagccttggacaaggtccctctgtaggcctcaattttcccrctttgagacactctgttgcccaggctggggtgcagtggcacgatcatggctcactgcagcctcaacctcctgggctcaagtgatcctcccacctcagcctcccaaagtgctgggattataggcttgagccactgcatccagccgacttctccactttaaataaggatctggataagatcatagggtggttgttgtgagacagggtctcattatgttgcccaagccggtcttaaactcctgggctcaagtgatcctcctgcctcagcttcccaagtagctgggattataggtgtgtgccacggtgccagcttttcctctttcatttcttttcagctctatgaccacaaatgtttatagaagctttattcataatcaccaaaaactagaaactacctaaatacgcttcagctgatgagtgaataaactgtgcagtacacccatacaggggaagactactcagcaattgaaaggaatgaacgccttacatgcaacaccatgaatgaatctccagcatgttaggctaagtgaaagaagccagactcaaaagactacatactgcaggatttctgggttttttttgtttttacttttattttttaatatatatatatattttttccgagacggagtcttgctctgttacccaggctggagtgcagtagtgtgatctgggttcactgcaacctcttcctcccaggttcgagtgatcctcctggctcagcctcccgagtagctgggactacagttgcgtgccatgatgcccagctaatttttgtatttttagtagagatggggtttcaccatgrtggccaggctggtstcgaaatcccgacctcaggtgatccacccacctcggcctcccaaagtgctgggattacaggcgtgagccaccgcacccggccacgatttcttttatatgacatttgggaaaatgcaaatctatgggggatagaagttggtgggtttccagtcacccaaactcttgtagagagcatggagggccagggaaaataaaatgatagtgaagctgtggtcagagttttctgatgcttgagttacaaggaaccaactttacacactaagtctccatttgcttaaggcaacacattgtcttatatgtatttttatgataatgatgttacaatgaaaggactggaaaggtgtggacggaatcagaggttggctactagcatgtgaataaaaaggcctaagctatgttgggaggactgtatgtatttgagtttggcagcaggggagcactactgaaaaggagtgatgaaatgagaggctggaaaagacaattaggacctcagggtacacagcggacaataccagagctggcattggcaaagtccgggctgtatcctgtaccctggggtctccaaagggaaggaggaggtggatcccagggagtccacaatataatctgctgggatattggaagaaaatactagaattttggttttttttaactgtatactttaaaattttctattttggggatagtttataatgtaaataatatactgctagaatacacatatataagttataaataggtataccggtgaggcgcggtggctcacacctgtaatctcaatactttgggaggccaaggcgggtggatcacctgaggtcaggagttcgagaccagcctggtcaacatggcgaaactgtctctactaaaaacacaaaaatcagccgggagtggtggtgggcgcctgtaatcccagctgctcaggaggctgaggcaggaggatcgcttgaatctgggaggaagaggttgcagtgagccaagatcgcaccactgcactgcagcctgggcaacagagtgagacttggtctctaaataaataaataaataattaggtatacctacatcggggggtttcttcaaagaatattttttcccgagagtgtgtgtaatacaaaaagtatggagatcattacaacagaacatgaagatccatgagaggttttaaaccatggatgtgatgtgactgaccagagctctcacttagaaagattaacctggcaggatgcatgggacaacctccagagtggagcagggggtggccacgggcagggagactggcaggaggctgctgcagggggacaggtgacattggcggtgcaggagtgataccaactacagcaaatatcagtatgattttacaaccagaatgtgaaagcgaaagcacggaccaatcagaacacagcccaagcagaagcaactggaacagctgtgcattgcagtaacacaggcggtacaggttagggtgagcggtgctgagacctgaattaggatgggggcagttggggaagaggaggtgctggaaaaaggaacattttagaagcagaatcaacaagacctggtgactgactgactggacatcttcggattagggagaaaaaggcagcagaagttttgttgtcagaacactgagtggatggtgatgtcgctgaaatggagaacgtgaaaggacagagaggtttgaggaagatgggtggcggcaattgtgatacattgaggcagagtgactaaaggacagcagcagcatcaactaacatttttacagcccctcagagattcagccagatagtgtgatcttattaaatggattttactaaggctcgaagatgtgaagtaagttgcccaaggtcacacagccagtaacctgcagagctgagatctgaaaccacatacccctgactcttaaaaagcttgttccctcctggggagtcctcagcccgggcctgacatagagccaggcacaggcctttttctgactggagtcgacagctggcagggttgcagggagcccgggcagccacaatccctgggtgtgggcctggcttcttcagggagcttactgtggctctagaggactcgttcaggcaaccccaagcactcactttttcttgaagaccaggaacttgttgttttgcatgatgcattctcggttgtttgagatctgctgaaagatggtcttactggttttgccctggaagatgatgttttcctgcaccagggccttggcacggccccgcacggcgatgccgtaggcccggaacgagtggatccggttctttattacctgggagaggcagccagagattgtcacacctcagggattcacagactgagtgggagagctgggcaagtgaattatcagttctaaaaccaagaggcaggaacatgccaggcaggtcagtgaagagcctatgagctcaaagaagggcaccaagaacagcctgggggagccagggaaggcttcctggaagaggtgataggtgagttgtaggcatttatcagatgcacaacagggagagctgttgcaggaaggagaaacaatatgcaaaggcctggcagagaggggaggcagtgtcag

SEQ ID NO: 10630 - DNA, 14199 bp, Homo sapiens
  misc_feature (1)...(14199): n = A,T,C or G, or insertion/deletion polymorphism (see Tables 1-2)
tggcgcgcgcggtgcccggggccctaccgggcgcggcggggacggcgggggcggccgagcacaagtcgcagacctacaccaacggcttcggcgccctgcgcgacggcctggagttcgccgacgccgacgcgccgaccgcgcgctcgaacggtgagtgcggccgtggcggcccggggccggtgcagcggcgctgccagcgcgagaactgtgcgttctacgggcgcgccgagaccgagcactactgctcctactgctaccgcgaggagctgcggcggcggcgcgaggcgcgcggggcccggccctgagcggcgcggcgcggcgcgggcggcgaggttctaccttcgaggatttcttttccattgtgtcggtgtcttttttacatgccctggtccaccggaaggccggcgcctcctctgtcagtgccgtgtacgtgtttggtcaaacgttcctaatggtgcctgaacctacactgacgccactcaggtagtagacggataggaaacaagtcatactgttggaagtgggtgtgctagcctagcatctgcctcgtacctgtggaaactcaatagccattgcaagagtatttttgttcctcagtaagagaaataaagaaattcgcagccctttgttttaagaagggagtgttttacatgctttttttgcttttttttttttctcctaccctagcgatgacctcttccaggtagcggtcccttgtgcgcggttggtagtacccagggcttagagcgagcgcgcacccggggctgcggtggaggctcctctgtgagctctacctgcctcccatcccgaggcctaggagaaggcgggtacctggccgccagctgacgccctggtggtcactgtggccctttagaaacacacagctccatttcataagcaaaacctcctcccccagccccggctcaagcaccattcacactgccatccaagccgcgggcggccgtggaaagggcactggaccacccgtctcgcgggcgccgtgaggtacagcgatggctcccagtgccgggcagttcaggtgacaggagctttccaaagacacctagggtccaaaaagcagggttcccatctcacaatttggatttgctcatagaggagcagataggacaggctgctcacatttctcctttgaaggcacttccacagtggactgtcgctggcgggcccctgggcggtgaccatcggtgccccgggagacagcgaggaattgaccctttggtcactgtgtaagcccccactaggctgctgctctttccaaagggaaggggctgggggaaccaggaaggaagcccacccccacacctgcatctgtctgggttcagccaggtaaagggactcactgtgatcgtggcccctccacggggcaggacgaccctgcctccgtctcgtgacacaatgagggagcagcccgatccctgagcggtctcttttttggtgcctcctacatttcttgaggaaaaaaaaaatgtgtccttagctaccctgttttgagcagcaatatgcagcctcttccttccaagattacctccggagaacaccgttcttggccaaggacactgaggagctaaatctgcctcactaaggaacgagcttgtttccaagaaatgaggataagatgggtaaaatcctcactaacaaagaatactataaaacctgtgagagccttagaatagcttctaataatcctaggacaggagaaagcgcctggctttgctgtgagtgtatcctcagaaaaagcaggaggtcgaccatctcttcactggagccagcttctcctctagaaacgatgcttttttccctaactaaagagcagcaaaaacaaaaaaaaagggggggcgaggggattttttttacttgtttgagaaattataataaaataattgagtatctcctgtgagtaatgcctttttgttttyaattattccacagcaggtggagttttcagtaatttgttcaagttttgcataagtggttccttaaatcaaaaattatttattaaataggatctttaagaaattttttgaaagttttacttttcctgctgaacaatattttcaatgtgtggtaattactgtactawcatccatgtccctaatattactggggtttcttttattactcagaaaacaaaagtggttttttaaaaatctcatggagagggtctgtggcagctttctggactgattcttcgtgtcacgctgagcagctgctttggcatccaaagctgtgggatcacagaaagtgttgcttcaggtgtggatgccagccactcctcatgctcgtcactcttaaaagattgagacacccaaccttaaaaatgctccaataatccattcagaaaccaaactcatatgcacaagatgtcaaggaggcataaagtcaattcttgcttgtttttttcatttcttaatgtaaaaacagccaaccagaaatttctaaaactggctatgctaattcagatattttctttctcacgctatctgccaggtttgtctaatttaaaaaataaaaaaataaaacagaataaaaaccgtccattgtaatagaggaaaaccttccaaaccaggcagagtacgtaattatcaaaacaccaggacctattctacccttgcatttccaagttacctccacccatcaccatctgatgacagatgtgccctaaataagagcctgagataaagccactggctgcatcctgcaccccagcttctcaatgtggtaacgaggcgccagacgcctgtagacacctgctccaggctgatacattaccactcagtccacatgacttaggaatagccatttccttttgtgagagagctggatccatccttcctctaaacagtattaaaaatgcaaaagggagagagcggatggtcatattaaatgtgctagtcccgtgcaccgacagcatgctccttgagaagaggcgtgtagacctcgtccctggccagagaccaacttcagcaggctggccagaaactattaaaaactgtgttgactgcatgtgggccaagggcttccctcgtgttccatggcgtgagggccctttgtggagcagggagaaagggaagaaggtgagtcctaccggggtgcatggccctgctgccctagctgaccctgcctgagagcagccttccccacctgatctggccacacttccctttctaggaaggacaggtgtctccaagggactgcaggtttccagaggatcccagatacttctaaacccctgcgaaggttatttcagaaatttactttacatttcctgcacatttgttatctgggtaaatgatttttttaaaatattgttaagggaaggtgtttttcagtgtattctgttggtagactttatgctgtgttacgttgaaattttacaagccaagtttaaactgtactataaaaattatttttgtattattttcagaacatgccacagagcaatattttgcacccgttattgccacagggttgtcccttggaagggtaactggaggtgggaaggagctccactgtgggctccggggggttaaacgctttttgctgcttgttcaaataccttctgaaagtgggaatgtatcagtgtctttttttattgaaagcttgatttccttttttctgttcatggattttggtactgcacctttcctcttaaatgaatactttgtattcactaaattactgtggaccttttcatacctattaccacccagtggcatttgaatctatttacaaatcgaatgttttcccaaatgatttaatttactacttctcgtagcttactgtcaagaattgggggtgctgaagataaaaggactctccatgccccccaggtgcacacctcagggtgtggacatcctccatgcagagcccgccctgtctctggggaggggtcatgggcccatcaccccccccccccacttagtgtccacaaacttattttgcgaactattctactttgcaaaaataaacttaaaatatacttcccattggttaagataaaagggctgtacttatcagtggtgggaaatttgtacaagaaaaaacagacttttccaaatccatgtgtgtaagttccattccatgtgagtcttttatttacgaagagacctggagtaaaagctgaaggcatctactgtatgtttggggctcctttctttatggccatgattttttttctcctcatcttggtgtggactttaaaattaagtacccccagtgttctgtcctttttctttcctcagtgcttctaatagataagaagaaatgtgtttctgtggctgagcaagccctgctgggccagacagaccttaccagccctggcttcatcctcgctgggctgcagaggcggcccctgctctagttgagtccggttctgctgccagctgaggacagacacaccgtatgaagggcctagaggtggctggcatgccagggagcaggtggccccttccaaaacgccttaaagtggtggctctctagagatctgaggcaccaccttcccatttactcctgactctaaactctagctggcctgttttagtgtggctggccggggcagtgaccagcgctcagctttgttcttgtttaattcaagtccaccctgttgcccgtgtcctctccacagctctgggtctgttggcccggagtgtatttctgccagtgctgcctcactgactcgggagtgggtcctgggtagttcacgatagagaggccagcacacgccatggggagagccccccacgctcaccccaggaggccctgcggcacatccaggctggaccactctgcaagcttctgtcacaaaagacagctccgggcactgtgcaaattggcctgttagcagttatgcaggtcccttctttgccaaaagatctattattcctccccactgcacccccagcagaaaagagcgagggagatgccctgcagggaccccttgggaacaacagttatgtgcagtctgtgcagtatgaagaacttggccccaccaggctgagccgaagacacacgtagttgcagagtagcactgaagccatcatctccaaccatgctagtaatgttactgtttctatttattttgccaaatgatttgttgaaaattgcatttttgctattttaatcttgccaaaaaagggggcctcactaatcctaattatgtacatacagaatgatgcacattgcttgcatctttttattcctcccaaagagcatatcaaggatatatatatacataatttgttagtttaacataaggcgaagagtaccatttggttttaagagtaaatataggctgaatttattcaagaccaaagcaacctatttaatgaggacaaatgagtgaaaccagctgttttagaatttatctgcagacactggagtgctcctttaaacgaagaaacagcctcccatggcagaggaaaagccaggtccttacaaaggcctctcccatcccagtacttcttctgcctgctgctctgccctgggacgtaggccttcctgccgtttctagtcacaggcaccctcctgcctcagggcctttgcacatgccattccttctacctgaacattcttccccagagagccacatggttcacccctcactacctgccagtctttgctccaatgtcacctttcaacgaggccttccctgacttatttaaaaggacaacacaccccaccctccctccctacccacctctctgcatcttcttcttgtgcacctatcaccatctgagtgctgcagatgttaatcattcatccatttatttgattctcgcctccccatctcccatagactgtaagctccatgtgggcaggaacttttatatgtcttgctcattgctgtatcctggtgcctacaacagtgcctgacacatattaggcactggataagtatttattgaaaaaaggaaattaaatcagtaaattgaaaactattaagaggccagaaaatgtcaatttcagctttcatcaaatctaggttctattattgtgagaactttagctgacccagtgacctggctcctatgggtacaagatggttagatacaccgggcagcagcggtggcttctgttcacagacaagtgaatgcctgccctgccgctagccccacctcacaaatatgaggctcactgttcgcaggggagcattttggaaccagctgggatgaagacagttttctgcaggtagcttttgtagccagatgcacagtagtgggttcccatcactccatgaggtcactgtagacctggaccattccagagaatcctttgtaatcagtctttaggtgtctcccagtccttcccagttcaacacgggtggcagcagatggcccagcccagggaaagtccacctgaccattagaaggactcatcctccagccaccaaagcaaggctrcagaggaagaggagcttgtcacaaacattaaccggctcagggctgggtaactgcattgacaaatttggaagcagcagggccagagagccaaggcccccgggtatccccattggccactggtggaggtgcactggaaggtcagggccttgacaccacagagccaagcaacacacacctccttgggcccaggycccagcacrgtggccctccagtgctggcaggtggcctcacccacagcaggggaggcgtgggtcctccaatgaccttcctgcccctgccagatgattttcacaactacctaactttggtgtttacttctaggtcctttggccaaatgcgttttcttctaagagttgttggcaaaatactgttacaagcttcttatgggacttttgtcctactgtggcctggttaaaggctttgtcctcctgtttaatccacttccgtggttttgctgtcatttctcttgatgccrtattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaagcctgctcctgccagcactcagggagggagtgtgtgcttcccaagagcctgcccccttggcccatgcaaactttctccatggcaggtgtccgtgaaggtctcccaggccctatgggctgtccagctctttgcacacattcttcccgcttgcaggaatggaatccaaacacctgatacggaatgatgacttggcagtggggagtggggcagcttgtctccrctaacttaggaccaaaactaggaaactcaccatgagcatgtgttggagatcagctgtggcctccagcccctgtacacacagaggcaagccccacctctgacagagccagtcaccgttcagtaggagcttgtcttccctgggcccccaggtgggaaaggctgggctcttagtcctacaagtaaaggcgctgttaggagcaaggagcaggcttagctgggtccacagagggactaagctccttagtgacctgttactgcctcatctacggagtttgaactccattcaccatcacctttgagaatttggccttgttttaactaaggattgttgaagttaattataacaagggaccatcctcaccctgtgtttgctttgttccattaaacgtgcgtttggcctaatgaagtcagtgaatgttcctcttttttcttttttggtttctttgactgatttttggatgatatatgttgctttatttctcccattttctttgattactgtggacaaaggaaaacactgaggcaaaagtaggtcgtcaatcacattactttgacccagttgtgcagaacccctttctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcactttttatagaagaattgtatttaatttctttcttttatgaaagattatttcaagtaaaaatagctctgtaatctgtgtgacatggcttctccattacctgacacagagagaagctttgatgcctactcaataaaattaacatgtttgtaaagtattggttggtccaattatttgcccactgactcctgtgttcttggtaaaatgccatctaagaaaagctttattgccaagaggaagaggactatatcagacatccatccataccagttttgttttgtttaagtgttttcccagccagatgagatgtaaacccagttgtcaccatttcattctcttttttttttttttttttttttttttgtttgagacggagtctagctctctgtcacccaggcagtggcgtgatcttggctcagtgcaacctctgcctcccaggttcaagtgatattctcctgcctcagcctcctgagtagctgggattacaagtgcgcaccatcatgcccagctaatcttttttttttttttttgtatttttagtagagacaggttttcactactctgttgttggccaggctggtctcaaactcctgacctcaagtgatccacctgcctcagcctcccaaaatgctgggattacaggcgcgagccagcacgcctggccaagtttcattcatataagaggaaaatagtttctctcctttctaaaatgaccatgacacattctatctggatgaaagctgtatttagtctgttttcacactccggataaggacatacctgagactgggtaatttctaaaaaaaaaagaggtttaatggactcacagttccacgtgtttggggaggcctcccaatcatggcagaatgcaaaaggcaagtcttacgtggcaacaagcaagagagaatgacagccaagtgaaaggggaaaccccttataaaaccatcagatctcatgagacttactaccacgagaacagtatgggggaaaccgcctccatgattcaattatctcccaccaggtccctcccacaacacatgggaattatgggagctacaattcaagatgagatttgggtgggggcgcagccaaaccatatcaaaagctgaatagggttgtccttaacatgtcttcaccagaggttgcaaccataagcaagagaatggcagctgggagcatagaggaggaggaggaggattttgccgtgaatttttatctgtgagtgctcttctatggaggagaggcgctgcctctgtaaaagaaagaagccccctcaggaagctgtgggtggggtccaggccacaggcctatctaaagaaggtgtgatgcacccaggactcagtcccaacccactgtgtgccatgcactgggacagtgatggaggaggtaatgacagggtctcacgcactgaataggcatcattggggggtggcacattctgtgcctagtggaattcaatccatgcagcaaccgtgtgagatagcaaaatctctgtgttgtagagaagaaaagtaaggtttggcgaggtaagtcgtaaagccaggattccagctcaggtgtgtctgacatgagggtctgtgctcccagcatcagagtacattgtcatcctgaggaatgggcaaggcccctgcccaggaggagctcagagtctgggggatggtgacacccaagtccatctggctccaggtggggggtgagttagcacagatgggagaaggacaggaaagatacctggcagggctgtgggatttgctggagccatggccactacatacccatggaatcctgttaaggccaatgggaccatccgtttctggctctaatgtttttctacacgaggaaacaggaaactgttcttagtttgttcaggacaagcagagaatcccgtatgaaagacaaaatactgcatttgaagctttgaaatgtgcttagaagactatataggatggtggtaggaaccctggattgggctggccccagaattgaccttgaggaaggcatctcacccctccagccccaggtttctgttctgtaaaaagcgactcaaggctcttgaagtttccccaccaaatcaaaaaatctgtgtattatttagaaaaacagaagtcacctcagttattttgacagagaatttagtataggaaactagtcaagcaggtattggaagcctaaaaaacacaaaaaggagacatacacgtcccacggagagaacatacaggaagcagcttcctcacagggtcaggggcaaagcaaagagagcatgttgttaaaatccacaggcagatagggcagggctccaccgcgttgaggtcagacctttgaaaagggagctcttcccagctggtgcctgtgcctcaggaagccagagggggaggctcgcagtgctaggctcagatcaccagggaggggttgccggtgtctcagtagaggctgtgatttggccacttctttcctgtggggggaagaatgaaattgaaacaaactgcagctagcaagtgaagagctgttgctaagacaacattgagagaaactggaagcaaaaggaatgagcaagtccttatgtgtcttgacccacctacacacatgcatatatatgcatgtatgcatgtatgaacgtacatgtatgtgtgtatacacgcacactgagcaagaagaaagataggcaaatatgcctccctactrcaggcccccctggaactgaagctggccacagagcactgttggtgtttgaaactaccttcttccataaccattccatgttggctttgctctcaggcagacctcaggntgttgggattctttacctgaaggacaatccaaactttcattcctgtagatgctgagtcctcacaagccctttttttcaatgccatcatttaccattaacttatttttggatgtggacaaaattaaaggcaccccaaagagtcccctagatttcagacatcatttattggcccccattatgtagcaacaactcattcagtcacccagccaatagagtaacgactttctttgcattgattcacctagctcagaagcccaaaatggccaagtctcagctccaggttcagcgaaatcactgtgctgccttttgggaagctccctggggaagtaagaactacaaaacagaaaagcgctaaggtgtggagcaggggaggtatagattcttggttacgaggtatggggcaggggcaggtacagattcttggttacaaggcttcatagtgacaagagctcctcatatgcccacctcttgtttcccagaccatgtgttccggccatgggatcatcatatggcagaccatatggcagttgctgattcaaatcccaaactccatctgtaaggtagaactccgacctttcagggagctgtctccctgctggcatactaactgagtcttcactaggcaggaccacagcactatcaagccagctgcttctgggtcagtgggatgtggagtaagtgaaatccttgtgcatgatctcattgctttaaaattgaaattcttcatcagaagtaacactgtgtagaataccacagcgatgaataaggcactctttaagtccacgatagtggcttttggcagcagcattgcagacagggaaagcaaatctgaatccagggcacacctattccagtgagggaaaattattttcctttatgaaggggtccagctggccaacaggaatctggctggccctccccaggaatgcaccacaggggaggctgtcagaagatcactccaacaaagcagtggtggcctccaggctggccttggcaagaggaaattcatgtcgtgttcattcacagcctccatccctgtaatcatggtcctgggcgcattgaataaacatcaggatggctggtgggagggtcagctagcatcacagagcatgctttcttgtccacctgagtctcaagagcctcctctgcacagggagctcctggtgagcataaacatgccacccaaatatctccagtctctctacaccttctgagcgatccatccacatacatcctactccaccttcccgtacatacatctgttaccatgcttccttgtcaccaaccttggaatcctgttctttccaagttcctgagcatctagtcaaattgttttcacctgcccatgaatcagtgtaaatcatggtttttcaatagtggcactattgaaatttggggacagatcattcttttctgtagggaacagtcctgtgtgcattgtaagatgttcagcagcatcactagctgactgtggtggttagttttacgtgtcaacttgactgggttaagggatgcccagctagctggtaagccattatctctgggtgtgtgtgagggtgtttacagaagaagttagcatttgaatccatagactgagtaaagatggctctcagcaatgtgggtgggcctcatccaaatcgttaagggcccacatagaacaaaaaggcccctagaggaaggttgagtttacactctctgcttgaactgaaacatcaatcttctcctgcccttctgctggctctccagccctcagactgagaccagacttacaccattggcctccttggttctcagagctttgggttcagactgatgctacatcaggggctttcctgggcctccagcttgcaggtgcagctcatgggacttcttggcctccacaatcacgtaaccaaacccctcataataaatctgttgtttttgtgtatctctctatattccattggttatgcttctctggagaaccatgactaatatactgacctccactcactggatgccagtagcacccccacctagttatggcaatcgaaaatgtctccagacattgccaaatgtccctggggactggaactggagagcacccactgctgagaatcactagtgtaggttaattcttctggctgtctttcggtccagaaaagcgagagccatttgttctgttcaagcgccatccactgggacaatttcccttccctgccatcttccaaggacactccagaattcccagggcccactctcagctggtacccactatcccagataaccatctgaaggctggtctcagccatttggtcacgggagtttctgtgagccacagacagattgagagaggagtcaacacaagcaggagtgcatgtcacaggggtctcakccacctgttcacacactgacacgtgccttctggattttctccaacccatcctctcatacccgatcttcacttgatgacagcttacagctgcatgtgcccaaccttatggatgggcgggtcaagtaacacccagtatttgatggccagcttagtattgcagagtcagctgatgtccccggtcatctgttcagtccttaccaggacccaggggtacgccaggagctgctttttagaaagcagaatgtatatatagaagaaggcatgggtttgctccagaatatggagttcaatactacagttcacctcctggagctctctgctatgttgctgttggccacaaacacttgagcaccactgaatctgttgggtgatgaggcccaggggaccccacctgcaactggtagtctcaaagtcaccctggtcaatgcattgggatagcacccccaaatcatgtataggatgccttcaaaatgcaaaaagtctcagcaagcatcatgcctcattttggggtatgacctcttatctttcactttcttggggtgtcctgaaatgctccacaggatcctcagccacttcaccaagtgggtgagcccctgagcatttatggggttcatctcctacttttgtgtcttaccaaggtgatggcagtggctgctgccatcacactggctgcagaagggaggtggctggggctgcacactccatggagctggtgggagccctgcgtttctgagttggggcagaagctccctgaaagtcgctgtggccgcccaacccacagctgcagacccaggcctcctgtgcttcgaagaaggcaggagccccgccctcctggacaaggctacagccgtccaaactgtagctgtgcttccaagcctccctgtgctcttggaggggggcaggagcaggtaggagctgccctcctgggtgcagctgcctgagcggcggctgcagacctggccctcctgctccacagagcaggaaggcgctagg

SEQ ID NO: 10631 - DNA, 13080 bp, Homo sapiens
  misc_feature (1)...(13080): n = A,T,C or G, or insertion/deletion polymorphism (see Tables 1-2)
gttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaacttctgtttcctttttgttttcttgtgagcactgatacctcaatacattgatacctcaatacctttgaggtattttttgatacctcaaagatactagcttatttgaagctagagaagaatatttcttcaataacattgcacagttagaaaacattaaaatatcattcatgggccaggcaccgtgtctcatgcctgtaatcccggcactttgggaggctgaggcaggcggatcacaaggtcaggagatcgagaccatcctggctaacacggtgaaaccccgtctctactaaaaatacaaaaaattagccgggcgtggccgcgtgcgcctgtagtcccagctacttgggaggctgaggcaggagaatggcgtgaacccaggaggcagagcttgcagtgagccgagattgtggcactgcactccagcctgggtgacagagcgagactctgtctcaaaaaaaaaatatcattcatggctgagtgtggtggcttatgcctgtaatcccagcactttgggaggctgaggtaggaggatcacttgaggccaggagttcgagaccagcctgggcaacatagtgagacccccatctctacaaaacatacaaaaattagctggggcatggtgccacctgtctgtaatcccagctacttgggaggctaaggtgggacgattgcttaagcccaggaggccaaggctgtagtgaaccataattgccactacagcctgggtgacagtgagaccctgtctcaaaataaaataaaatattcacttagtgaatatttattgagctactactgtgtcccaggaaacctcactgactgatttctcatcagaggatcctggcatgtttataaacttttaagcactgttgagaaaggatatatacgtcataattaaacctcgttaatatgtgttagtcatgttaagaaatgcaggaatggagttcctatccggtgtattgtcaagatcagtcgtaacatttaatatagagaatagctctgtgctttagcctgcctgttactttgcttctcaaagcctaggtctggtcaacactaagatcctgtaacatttatgtaaaaacacacacacacacatgtgaaaatcaccttgctttccctttgagatcaattttccaggaagaaaaatctttgagtataacagtcagaaatgtgtaattcactcaatatttaactgatgtttattcaagtctttactaaggtcaggccctgctctcactcttctaatcatagaggatatggtgataaacaggataaacaaggacctgttctcacagagtgaataaacaactaagaaagataatttcgggccataaatgctgttaagaaaggaaaactgaaatggtaagctttttttttttttttttgagacggagtctcactctctcgcccagactggagtgcagtgccgtgatctcagctcgctgcaacttctgcctcccggattcaagcgattctcctgcctcagccccctgagtagctgggattacaggcgcacaacaccacacctggctgattttttgtatctttagtagaggcggggtttcaccatgttggccaggctggtcttgaacttctgacctcaagtgatccacctgcctcggcttcccaaagtgctgggattacaggtgtgagccaccacacccagcctgaaatggtaaacttttaatggaaggggtgctgtcttagctgtggtgatctggaaaggtctttgagaaggtgggaggtgacaccgagctgagaatgaaatgggggaagaaagcagccaagtcatctttaggtagggtgttcccgggaagccaggctggaacaagctcaggaaggagtttggcatgagaaagaccagtgtggctggagcagataagggtgaggagtgggggcagcagtggggagtccagatggagagggctttgtagatcagggtaaggagtttggattttattcgaggtgcagtgggaaacttcatggaattttaaaaagggaagcagcatgatctgattggaatttcttttttattttattttattttatttttttttttgagacagagtttcgctctgtggcccaggctggagagcagtggcacgatctcggctcactgcaagcgccacctcctgggttcacgccattctcctgcctcagcctcccgagtagctgggactacaggtgcctgccgccacaccaggctaattttttccatgttagccaggatggtcttgatctcctgaccttgtgatccggccgccttggcctcccaaagtgctgggattacaggcgtgagccaccgtgcccagccaatctgattggaatttttaagaaactactctggctcttagggcaaggaagggggaagggacagtcaagaaccagaggaagaagagagacaagtgagatcctgttaagattaatccaagtgagagatgaaagtgrtttggaataggatgagggagtagagatagagaaaagtggataaattctggatgtgttttgaacacgctagaaggtaaagtgtagagcatgaggggaaaagaagaaccatgttaagttgaggaagtatggatgcaaagcatgtttttatgggggatacgtggatttagaattaagaattttgtttaggtcatgttgagtttaggatgttaagcttgagatgaaatgattgctatttaataatatctgcccatcagactttaaaaggaaagcgaggaggatcaagaggaggcaaagaagggagggaagtttcttgaggatagtgatatatggcacttcagctctcttgagaactgattctaagacaaatccccctgttaaaagccttccttcatgtagccattttcctctcaaccttaatcaacttcataacttcatttatatatccattcatttatttaagaagtacttagctctttttttccccacaagtatatccaatgtgtatctttatttgtaatggaagataaaaaatattggggagtaaaaaacaggtctgggccgggcacggtggctcatgcccataatcccagcactttgggaggctgaggtgggtgggtcacctgaggtcaggagtttgagaccagcctgaccaacatggtgaaacctcacctctactaaaaatacaaaaaaaaattggccaggcctgatggcaagcacccgtagtcccagctactcaggaggctgaggcaggagaatcgcttgaaccagggaggcggaggttgcagtgagccgagattgcatcagtgcactccagcctggtgacagagtgagaccctgtctcaaaacaaaacaacaacaacaacaaaaaaaaaacaggtcttatattaagggggataaagatagctatatcaatacaatggaatattatatagatttgtacatattacagcatacaagtacaagtaattataaaatgtaaaagcatggaaaatgcatggctaaatgtcaagaggatagcaacatattaatttatagatatacatttaacatctaatttcaacaattaaaaatgtatatttagcagggggtggtcatgtgcatctgtagccccagctactcaggaagctgaggtgggaggatcacctgagcctgggaggttgaagctgcagtgagccggccgggcacggtgtctcacgcctgtaatcccagcactttgggaggccgaggcgggcagaggtcaggagatcaagaccatcctggtcaacatggtgaaaccccgtctctactaaaaatacaaaaattagctgggcgtggtggtgcacacttgtaatcccagctacttgggaggctgaagcaggaaaatcacttgaacctgggaggcgaaggttgcagggaggcgaaggttgcagtgagccgagatcgcgccactgcactccagcctgagcaacagagtgagtctccatctcaaaaaaaaaaaaaaaaaaaaagctgcagtgagccatgattgcaccactgtacgttagcctgggtgataaagtgagaccatgtctctcaataaataaataaatatttaaaaatataaaaatgtaaggccgggcgtggtggctcaaacctataatcccagcactttgggagaccgagtcaggcggatcatcgaggtcaggagttcgagaccagtctggccaacatggtgaaacctcgtctctactaaaagtacaaaaattagtcaggcatggccgggcgcggtggctcacgcctataatcccagcactttgggaggccgaggcaggtagatcacgagggcaggagatcgagaccatcctggctaatacggtgaaaccccgtctctactaaaaatacaaaaaattagccgggcgtggtggccggcgcctgtagtcccagctactcgggaggctgaggcaggagaatggtgtgaacccaggaggcggagtttgcagtgagccgagatcgcgccactgcattccagcctgggtgatagagcgagactctgtctcaaaaaaaaaaaaaaattagtcagacatggtggtgcatgcctgttgttccagctacttaggaggctgaggcaggagactcgcttgaacctgggagatggagactgcagtgagccaagatcgtgccactgcactccagcctgggcgacagcaaaacactgtctcaaaaataaataaataaaataaaataaaaataaataaaaatgtatacttagtcagaggtggtgtcatgtgcctgtggtcccagctactcaggaggccgagacaggaggattgcttgagcccaggatttgaggtcagcctgggcaacacagtgagatcctatctctttaaaaaaaaaaaagatatacctgttagtggaaatgtaaaaaaaatggaaatagtcatattgtaatggaattataaactttgtttttaagatggaattttgctctgtcgcccaggctggagggcagtggcatgatctgggctcactgcaacctccgcctcctgggttcaagtgattcttgtgcctcagcctcccaagtagctgggactacaggcatgtgccaccgtgcctggctaatttttgtatttttagtagagacaaggtttcaccatattggccaggctgatctcgaactcatgacctcaggcaatctgcctgccttggcctcccaaagtgctgggattacaggtgtgagccattgcgcccggccacaattaaaagcattttgttattatttccttaatattgtgatctttatctttccaatgaacatttgaaaattctcagacaacacactaggttttcattagaggtttttttaccgagcactttttgtgtgctaggtaccttgaggacatgatctctaagccactgtctcttaaaccttagcttttattcttcttgactgtgttattcaacttgaattcaaaagataacattcaatcggctgggcgcagtggcttacgtctaatcctggcactttgggaggccgaggcgggtggattgcctgagctcaggagtttgagaccagcctgggcaacacagtgaaaccctgtctctactaaaatacaaaaaattagctgggcatggtggcacgcgcctgtaatcccatctactcgggaggctgaggcagaagaattgctagaacccgggaggcagaggttgcagtgagccgagatcgcgccactgcactccagccagggcgacggagtgagactccatctcttaaagaaagaaacaaaaaagataaaattcagaccgccaagactacatctgccccacctgcacagagcctcgccctcgccactccacagccggtccgcatgtgccgccagctcaccagggtgatatcactgggctccagcaagggcaaggccagcttcgcaggtgacgatgccccgtyggccgccttcccctccatcttggggcgcccgcgacaccagggcatgatggtgggcatgggccagaaggactccaatgtgggcgatgaggcccagagcaagagaggcatcctgaccctgaagtaccccatctagcacggcatggtcatctactgggatgacatggagaagatctggcaccacaccttctacaatgagctgcatgtggctttcgaggagtaccctgtgctgctgaccaaaggccccctgaatcccaaggccaaccatgagaagatggcccagattatgttggagaccttcaacaccccacccatgcacgtggccatccaggtcgtgctgtacctgtactcctctggccataccactggcatcgtgatggactctggcgacaggtcacccacattgtgtgcatatatgaggggcacgccctcccccacaccatcctgcgtctggatctcgctggccaggacctgaccgaccgcctyatgaagatcctcacattgtgcggctacagctttaccacccgcagagggagagntcctgtgtgacatcatcaaggagaagctgtgctaagtcgccctggactttgagcaggagatggccccacgggtcctcctgggagaagagctatgagctgtcagatggccaggtcatcaccakcagcaacaagcggttccactgccccgaggcgctcttccagccttctttcctgggcatggaatcctgtggcatctacaaaactaccttcaaatccatcgtgaagtgtgacgtggacatccacaaagacctgtacgccaacacagtgctatctggcagcaccaccatgtaccctggcatcgctctgcaggatgcagagggggatcactgccctggctcccagcatgaggaggatcaagatcattgctccttctgagtgcacatactctgtggatgcgtggctccatcctgacctcgttgtccaccttccagcagttatggatgagcaagcaagaatatgatgactccagtccttccattgtccactgaaaatgctcctaggcggactgttccttagttgcgttacaccctttcttgacaaaaacctaatgcgcagaaaataagatgagattggcatggctttgtttgtgtgtgtgtgtgtgtttgtgtttgtgtttgyttttggcttgactctgggtttaaaaactgaaactgtgaaggtgacagcagtcggttggagtgagcatcctccaaagttctacagtgtggccaaggactttgactgtacattgttcttttttttctttttttaatatttattttatttatttatttattttgggacagagtatcactctgttgcccaggctggagtgcagtgatgtgatcttggctcgctgcaacctccacctcccaggttcaagtgattctcctgcctcagcctcttggtagctgggactacaggcatgtgccaccacgcccagctaattttgtttttttttttttgtatttttttagtagatacggggtttcaccatgttggtcaggtttttaattttttttgtatttttttagtagagatggggtttcaccatgttggtcaggttttttttgtctttttttagtagagacggggtttcaccatgttggtcaggctggtctcaaactcttgacctcaaatgatctgcttgcctcatcccccaaagtgctgggattacaggcgtgggccaccgtgtcaggccacattattcttttttaaatagtcattctaaatattgtgaggtgcattgttacaggaagtcccttgccctcccaaaatccagcccacttctgtctaaggagaatggccgagtccactctcaagtccacacaggggaggtgatagcattgctttcatgtaaattatgtaatgcaaaatttttaaaatctcccccttatacttttttgttttattttgaatgatcagccatcgtggcccgccttttttgtcccccagcttcagacgtatgaaggcttttggtctccctgggagtgggtggaggtgtggaggcattcagggcttacctgtagagaccagttgaataaaagtgcacaccttaaaaaaaaaaaaaaagataaaattcaagtataacagacagtggtcttaaaaccagtctttatcccaatagccatcaacatactctgttgtttgtcatttgttctctgtagtgacttgttacattttaagactgtatttttagttatcagaagaaaatctcattggctgctttgcagtcctgccctctgttcacatagcctatgccacaaacactgctttccctgagcctggcttcccagagacagctgtcttccaagacctcaaggcccctttgcacttaaaattattgaggacaccaaagatcttttgtttatgtacattatatatttctatatttaccccatttgaaatttaagtggatacattttaataatttatgttaaaatgacaataataaacccattgcatttaaagataacttttttttttttgagatggagtctctctctgttgcccaggctgcagtgtagtggcacaatcttgactcactgcaacctctgcctcccgagtttaagtgattctcctgcctcagcctctggagtagctggaattacaggcatttgccaccatgcccggctaatttttgtattttgactagagatggtggtttcactgtgttggccaggctagtcttgaaccgctgacctcaggtgatctgcctgcctgggcctcccaaagtgctggggttacaggcgtgaacctgtaatcaccttacaatgtgtttatacaggctgacattattgagtgctaactaatctattccaggcactctgctaagcagtttatatacattatctcaagtaattgtctcaaaactccatgacactgatactattaccctcccacagaatgtgtaactttggcttagggagagcttcaatgacttgcccaaggtcagatagctagtaaatggcagagctgtttgaaccaatgtcaacatgaatatcttttataaagttaacaagaagttagttctatcaattttagtttgaatggactgtaagaagggacaactacacctcacgtaaaattgctgataagccagacagaagcgacaaaagaaatcaacctcaaatcacacaatgtccaaatcagaattatagctgtatctatacagatagagagttttaaaaattatccattttgtttctaagtagttgtagcaatgtttcttctttttaatttaaaaaaaaaatactggctgggtgcagtggctcgcgcctataatccgagcactttggggggtcaaggtgggtggatcactgaggccaggagtttgagaccagcctgactaacatggcaagaccctgtctttactaaaaatacaaaaattagccaggcatggtggcacacacctgtaatcccagtcactcaggaggctggggcaggagaatcgcttgaacccgggaggtggaggttggagtgagccaagattgcaccactgtactccagcctgggtgacagagtgagatgcttctcaaaaaataaataaataaatatatttatttatataaaaaagaaagggaaaaatatatatttatataaaaatatatttatataatatattatatgtgtatgtatttttcctcttcttttttatagagatgggggtcttgccatgttgtccagactggtctcaaactcctgggctcaagcaatcctcccacctcagcctcccaaaatgctgggattacaggcctgagcctgtaactaaacttgaggcatgagtctgtttctaagcttgccatagacaccttcagtgcatgtctgctttttgattaccacagttgctaatcgtgggttataaaaatatagaattcaaatatgttagggcaataataaattatatatagatgcattgatgttgcagtacataaatgagcctttcagtcattttgcattctagatagatgtaatcttttttaaaaaaattaattgctttcatcttgagcctgggatgtcaaggctgcagtgagccatgattgcattactgcactgcagcctgggtgacagagagagaccctgtgtcataaacataaataaatatttttaaaaagattctaaggctgagcatggtggctcacacctataatcccagcactttgggaggctgaggcaggaggattgcttgagactaggagttcgagaccaacctgggcaacatagggagactcctgtctctacaaataaaaattaagaaaaatttattagaggctgcaatgtctattactatttttaagttatttattattattagggtttgaaaaaaatctaggatgggaaaacaaaattcaagaatgcaaccaggaactatgtgtcaaggagaaatcccagagaaagtatagctttcgttaagcctcgcccatataactcataatgcaaccagagtcttttttttttttttttttttttttttttgagatggagtctcgctctgttgcccaggctggagtgcaggggcatgatctcggctcactgcaacctctgcctcccacgttcaaacgattctcctgcctcagcctcccgagtagctgggattacaggtgcccgtgaccatacctggctaatttttgtatttttggtacagacgggaatttcactgcgttggccaggctagttgagaactcctgacctcaggtgatcctccagcctcagcctcccaaagtgctgggattacaggcataagccaccttgcctggccccaaccacactctttaagccagtaacctctttctcaggaaggtcatgacccaatattaatttttcatctacaggaagtgacaagaaggctttatacatgtgctgtgtaaaaatggagttcaaaatgtagttaatagaaacagacctgagaatgtgctagatgattatgaattgctgaatctgacatgacctacagcagccacacaccaactctaccagtacacagctctttctccccacttccttctgaattatctcacccactttttctccactggttatcttaatcattttgcctttcctgttaccactctaagtcaggttttgttataagaactcatcaccctttagttatctatacttttgtgtggatgatttttatgctttaaatttacccaaaacctattgcttagacactaagaaaatggaacaaacatgcaagaaatgttaacaatgaaaacagaataatttccaatctgctccactgattgtgcaaaactgtaggatggctttatgttcagaatcattgcccttttagactcaagagttttgaactctgcttccaaagagttaatccttcatccgtgttttctgtgcatggagcccataaaatctaattacattccgcttctaaataaagagaaatgactcccaaattcgtctggaaaagtagctttttttttttgagacagagtctcgctctgctgcccaggctagagagcagtggtgtgatcttggctcactgcaacctccacctcccaggttcaagtgattctcctgcctcggctgagtagctgggactacaggtgtgcaccactgcatctatctaatttttaaatttttagtagagatgaggtttcaccatgttggccaggctggtctcaaacccctgacctcaagtgatctacctgcctcagcctcccaaagtgctgggattacaggtgtgagccactgagcccggccaggttttgttcactgaggatgtgccagtgtcccaagttgtaaaaagttaattccataggcttgcttcttaccttcttagttcgaaaatcatatatatctcatcgtaggaatacactaaggcgtggatactaaatatagaaagtatgtttgggatgatctgacttgaaatatggttgtgttatgaatggaaatcactttgtgttacattggggtgcatagagaactaggcagaactctcagagcagctgataaggtgctagagaagtggggtgccgtggctcacacctgtaatcccagcactctgggaggcagaggcaggtggatcacctgaggtcaggagttcgagaccagcctggccaacatggtgaaactccatctctactaaaaatacaaaaattagccaagcgtggttgtgggcacctgtaatcccagctactcgggaggctaaggcaggagaattgcttgaacccgggaggcagaggttgcagtgagccaagattgcaccactgaactccagcctgggtgacggagtgagactccgtctcaaaaaaaaaaaaaaaagaaaagaaggtgcaagaggccgagatgctactaagccgacacagaaaacaaataggtctcagctatgagctccaaatttcagtattgattgctaattaatctgcttctcacatgagcaactctgtgttcctgggtcagcagcagggatttgtttgtatcattcaattatttaatgatagttacaaatttaacttaataataatatacaatgatatgctgaataatggaggtaattatacttaacatcataattttaatatagattgtatctgcattcaatgtaaggcattgtttcctagagtcaagtcccaggactatgtgcatcagaaacatttagtgatacttattaaaatgcagattcctaggctctggctcagacctgatgagaaactctgggaggtgaggtccaggaatctacgttttagcagaaccccatgtgatatttatgtacattaaggtgctagaaccccatgcttctgtaattaaggaagctcaaactacagagtattggaaaagcttttacagggagaagcatctgaatcagaaagttattcccaaggggaacccagcctggggacagagggacacaataagtgttcccagctgccttaggagcctaggagctgcaaccctctccttccctggagctccctgtgctgggaggagaattctgctgtgtggaccccaactgggggctaagcctggtaaccacagcagtgggtctcs

SEQ ID NO: 10632 - DNA, 46193 bp, Homo sapiens
  misc_feature (1)...(46193): n = A,T,C or G, or insertion/deletion polymorphism (see Tables 1-2)
aaacaactcaaatgtcctttaacattgatatttccacataatgaaatattattcagcaataaagagaaataaactattgatacatgcaacaacttggatggatctcaaaagcaccatgctttttagtgcaaaaagccaaagccaatagaaaaaccattaactactacagttgaccttgaacaacacaggtttaaactgtgtgagcccatttatatgcagatttttttcaataaatatattggaaaattttttggagatttgcaacaatttgaagaaactcaacagatgaaccatgtagcctagaaatatcgaaaaaatttaagaaaaaggtatgtcatgaatgtgtaaaatatatgtaactaccagtctatttttgtgttgactatgttattggtaaggcttccagtcaacagtaggctattagtggttaagttctggggagtcaaaagttgaacatggatgttttactgtacagggggtcaatacccctaacccctgcattgtttaagggccatttatataatggtacattggacaaaactatagtggtagagaacagattaatggttgccagggatggagacaagagtggatataactataaagggatagggatacccagtgaagttccttggtggggatgaaacagctatcttgatttatagtcgtatttgcagtaatctgtaaatgggaccaaattgcatagaaagaactatatacacacatacacacacacaggagtggatgtaaaaactggataaggtctgtaggtctagttaacagtattgtaccaacgtcattttcctggcttttaaattataccacagttacataagatgtcatcattgggggaagctgagtgaaaagttcatgggattcttggtactatttttacaacttcctgtgagtctataattatttcaaaataaaaaggtaaaaaaatttcacttttattttattttttgagatggggtcttgctgtgttgtccaagctggagtacagtggtgtggtcatagctcactgcagccttgacctcctgggctcaagggattcttctgtctcagcctcctgtgtatctgagactacaggtactcaccaccacacttggctaattatttaatctttaattttttttttttttgtagagattgggatcttgttatgttgctcaggctgtctctaactcctggcctcaaatgatcctcctacctcagcctcccaaagtactgggattcaagacatgagccactgcactcggccaatttcacctttcttttttaatgtgaccacctgaaaattttaaattacatatgtggcttatatcatatttgtattgaatattgctgctctagagactccaatgtatgcactggattaagctatggggtcaatcattatatgttccagtaatctatggggtcaatcaatatatgttcctagtaatctgcggtagactttcctcacaaaactctgtagtcaaatacattcaggaactgtaataggttgaacaaagttacacagatttctttacaagagatcttccaggtctttaatatgcaaatgtttatcataaatctcaaatactctcatttcaaaggaaactaaggcacagagggattaagtaacctgcttaaggtcatttggttagtaagcgatgaagccaagattcaaatcctagtaatctggctctcagaggaaggcctctagaaggaaatgaagagtttgagattttagtgaattgtaccattgttctatataaagataaagctaagagcccagtcagtggagcttgcactttaaattatttctcaaattgtggagatcaatttgtgcagacttacctgtatgtctctcattcagtggtcctacaaccaagagcttgtctttgaaaaagtggaaaggataagaaatacaaattcaagctatgaaatagagacttaagacattttttagtctgccagggaaatctatgaattgacaattagataacaaaaaatatcattaaatttaataatggcactatgactacatacaaaaatgtccataatttttagagatgcataatgacatatataggggtgaaatggcagtatctgcagttttgctttcgttatttcacagagaggtgcagagaagttaataaaaggataaggaggccaggtgcggtggctcacgcctgtaatcccagcactttgggaggctgaggcaggcagatcacgaggtcaggagatcgagaccatcctggttaacacggtgaaaccccgtctctactaaaaatacaaaaaattagctgggcatggtggcgggcacctgtagtcccagctactcgggaggctgaggcagaagaatggcgtgaacctgggaggcggagcttgcagtgagccgagatggcactactacactccagcctgggcgacagagtgagactctgtctcaaaaaaaaaaaaaaaagaaagaaaaggataaggaagatagatgaagcaaatatattaactttgttaactgttgaatgtggggtgacaggtagtgcatgatactattctctatatgtttatgtttgaaatttttcattaaaaaatgttaagctgtatgttgaaaatcattcctttcccatactcttttcaacaattataatttttaatggctaggtagaaaactaaagttacggcttcaaagcaggttatcattattataacatctaaagtaaaaattgctttgaatttgctcccattaagatacattttatcttcattatcttcattattcacttcatcctgactccagctacagaatcatcttttgggccttatagggagtatcaaatcaacaatcaagaacaagtaggccaggcgcggtggctcacatctataatcccagcactttgggagaccgaggcagacagagtccaggagttcaagaccagcctggggtgaaaccccatctctactaaaaatacaaaaattagctgggcatgtagtcctgtgacttgggaagctgaggtggaagaatcacttgaacctaggaggtggaggttgcaactgagccaagatggcaccactgcactccaacctgtgcaacagagactccgtctcaaaaaaaaaaaaaatagaaagaaaactgatacaactatactagttaataataattctggcccaacaagtgcctatcatttttttccatacaagattttttttaactttcagaatggttggaattaatcataaaagcagatttttagctaaacctcagtcactttattgggaaaagacagtttcctcacaattttttttttaagtaggaacaacacatcccaaatctaagagatgactgtttcttcttcctagttcccaaagagtttactaggaactaaactgctaccatgtagatatcttattccttaataaataataagcttctaaaaggcaaagagaggttttagacttattttctttgtatgcctattgtatcccaagtaaaagtgcgaagggacaaggaaaataccatttattgaggatgtatatgtgtcaagctccacaccatcactttattcttatttttatttatttatttatttatttgagacagagtcttcctctgtcacccaggctggagtacagtggtgtgatctcggctcacggcaacctccgcctcccaggttcaagcaattctcatgcctcggcctcccaagtagctgagattacaggcatgtgccaccatgcccagctaattttttgcatttttagtagagacagggtttcaccatgttgcccaggctggttttgaactcctgagctcaggcaatcgcccaccttggcctcccaaagtgctaggattacaggtgtgggggtccacaccatcattttaaataagcttttggataaggtgttactcctatattgcagaaacgaaggctcagtgatgtagtaatttgcctaaaagtcacgtggctagaagacagcctagccagaaacccaagaatgattcaaaatagcatgcttgcaattatcatgtatgtgcataattaatatttaataaattaaatagttaataattaatattaatagttaatatatttatggttgctaaaattacatagctaaatgaaaggaaaagttaatatttaattaataaatttatggttgctaaaattatatagctccatgaaggaaaaaaaattggaatttggggttaaagcccaagctcaactcctgactttttggctatataatcttaaaatatgtaacatttctgatataatttcatcttctgaaagactgaagataatcatacccactttacagagttgttaagatcaaaaagtgaagtgagctgggcatggtggctcacgccaacactttgggaggccaaagtgggagaaccgcttgagtccaggagtttgagaccagcctgggcaacatagtgggaccctgtctctaccaaaaaaaaatttttttttaattagccagttgtggtggtgtgcacctgtagtctcagctactcaagaggctacattgtgaggatcacctgagcccataggtggaggctgcagtgagcaaggattgcactactgccctccagcctggacaactgagcaagaccctgtctccaaaaaaaaaaaaaaagtgaaggcccttttggaagtgtaaagcattaataaatgtatgacactattattactttctaaattattatacaccacttcggtcagggtagggggcagctctttttatttttttattatttatttatttattttgagacggagtttcactcttgtcacccagactggagtgcgatggcgtgacctctgctcactgcaacctctgcctcccgggttcaagtgattctcctgcctcatcctcccaagtagctgggtttacaggcccccgcctccatgcccggccattttttttttttttttgcatttttagtagagatggggtttcgccatgttggccaggctggtctcgaactcctggcctcaagtgatccgcccgcctcagcctcccaaagtgctgggattacaagcgtgagccaccacggccggccgtgagggtggatctttttaaagccagaaatatttgctctttaaagtctcaaaagcaaaactgatctttatggattctggtgcttaattgcagaggtggggaggcagtatgtgtgatggttatgaccacaggcttcggaatcagatcgacatcaggtttgtacctctcagctctaccaccttcaagctgtgtgatctttggcatgctacaatctttaattctgggatctttatctgtagaatgtgcaaaataatgttcccaatctgatatcattgataggaatgagcaaatgtatgtaaatagctttgcacagtgtcaagtgagcactttcctggagccctcagttagctattaataacttctcgagctaccatggccattaacaatgggacctgaagcactgcggatgctacaaatgcttcagcagacccagtgcttgatttcaggaatttcagacgaagggcgacacgccctcagctggagatggaggaagaaggggcagggtccagcagggctgagaggagagaattccgaagaaaaatctctccccagccctgggaaaggaaaggaacgaaggactggtcaaggagggtccccagagcgcccgccgcccgccccggctggggtggctgagcagtccactcacagctccaagctctgtggcaccgccttccgagtgtatctggagatcatcctcctcctcctcctcctcctcctcctcctcagccgcggccggggcaggcacgccagggtgggggcctccgggcctggccctcccgccggctccggcccggcccctcccgccacctaccggccccgtctcgccccgtcacctagactccgagcagccacctccccagggtccccacctctccagtcctccgacctccctgctttgccgcgggggcggaagtgacgaaggcccccggacactcgcaaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccgtaagagaaattggcttcattttgttagatggcaggagggagcctagactggggaaagagcactagactccaagtcaagcccctgctgcttggtcgcttctttttctgtactctgggttttctcatatgtacagtgaggyattagcctgagtgatcatagagtcccttccagttctgacaccaaattctgcatgatgacgtgtgtttggcgttatggggtggatgggtaaaattactgtctgtccctctgggttgaaaggcaaaatgatgatttggttagactgtggtgagtgggtgtctggataagaagaagcaggttccttacgagtctcttagaaagctgagtaagattggaatcatggagttagggtggtccatccaccgccatttctttctttaccaagcatcacctggcagcaagaataaactagtactcttatttaggaaaacccttagaaaattaagagataaggaaaacccttagaaaattaagaggtatcaatgcaacctccatcaaaataccagtgacattcttcacagtcatagaaaaaagatcctaaaatttatatggaaccacaaaagagccagaatagccaaagctatcctgagcaaaaagaacaaaactggaagcatcacattacccgacttcagattatacaacagagttatagtaaccaaaacagcatggcactggcataaaaacaggaacagaatagagaacccagaaacaaatccatatgtctgcagtgaattcattttcagcaaaggtaccaaaaacatacattggggaaaagacagtctcttcaataaatgatactgggaaaactgatacccgtatgcagaagaatgaaaccagacccactacctcccaccatatacaaaaatcaagtcaaaatggattagagacttaaatctaagccctcaaactatgaaactactaaaaggaaatattggggaaactctctaggacattagagtgggcaaagatttcctgagtaatacctcacaaacagaggcagccaaaacaaaaatggacaaatgggagcacatcaagttaaaaagcttctgcacagcaaaggaaacaatcaacaaagtgragagagaacccacagaatgggagaaaatatttgcaaactacccatctgacaagggattaataaccaaaatatataaggagttcaaacaactctctaggaagcagtctaataattgattaagaattggataaaaactctgaatagacatttctcaaagaagacataaaaatggcaaacaggtttatgaaaaggtgctcaatatcattgattatcagagaaatgcaaatcaaaactacaataagatagcatctcaccccagttaaaatggctgttatccataagacaggcaataacaaatgctggcaaggatttggataaaacactgttggtgagaatgtaaattagtgcagtcactatggagaacagttttggagattcctcaagaaactaaaaatagagctactatatgatccagcagtcccactgttgggtatttacccaaaaraaaggaaatcagtatatcaaagagatatctgcactcccatgtttatcgcagcactattctcagtagccaagatttggaagcaacctaagtgtccatcaacagataatgaagaaaatgtggcacatacacacaatggagtgcttttcagccataaaaaaaaaaatgagattctgttatttgtaacaacatggatggaactgaagatcaagtggaactggatggaagtgaaataaggatggcacagaaagataaacttcaaatgttctcactaatttgtaggagctaaaaattaaaacagttgaactcatggagatagcaagtagaaggatggtttaccagaagctgggaagggttgcagagggtttgtgggggagtatggttaaagggtacaaaaaaaatagagtgaatgaaaactagtatttggtagcacaacagggtgactatagtaaataataatttaattgtacatttaaaaataacgaagttcagatgagagcatgtcctggctataaaaatttttttaataaaaataactaaaagagtataattagagtgtttgtaacacaaaggataaatgcttaaggcaatggatatctcatttaccctgaggtgcttattatgcattgtatacctgtatcaaaatatctcatgtaccccataaatatatacacctactatttacccttaaaaattaaaaaaaaaaaacagcactttgggaggccgaggcaggtggatcatgaggtcaggagtttgagaccagcctggccaatatggtaaaaccccgtctctactaaaaatacaaaaattagccaggtgtggtggcgtgcgcctatagtcccagctactcgggaggctgaggcaaaagaatcgcttgaacctgggaggcagaggttgcagtgagctgcgatcactccactgcactccagcctgggcgacagagcgagactccatctcaaaaaaaaaagaaaagaaaaagaaaagaaaaaaagaaaagaaagatatacctaccatcccatgagacttgaaaaaggggcaaatttaggacagaggtaaaatgacaggacatgaatgttttgtagttctgaattcctctacgccatacaatgttcataaaagagagagatgtacattctgtagagcaagacagattgtactttagagtttaaataacaaaattttaaagcagggagagattttagagatggtagataacttatcctaaattaaagaaaaaaacccagaaagagaaagtgaaatgtccatagtggcacaactaattagtggcagaactggggtttttgatagtatgtaaacagtaggtgttagtgcagtgtttctcgaaatatattacacataccactgctagtacaagggcaaacattaaaaatttcattcttcacttccaaaataggaaaaatataaaaagtaaagattttattcttacatacttactaattggggaatgtgatactagatttctattcactgtattatatcaaggtttccttttaacgtaattttaaagataaagttttaagtgtaaagggtcattaaaaataatattaggccagatgcctataaccccagcactttgggagaccaaggtggaagaactgcttgagctcagaagttctaggccagcctgggcaatatggcaaaaccttgcctctactaaaaatacaaaaaaagttagctgggcatggtggcatgcacctgtggtcccagctacttgggaggctgaggtgggaggatggcttgagcccaagaggtggaggttgcaatgagctgtgatcatgccgctgcactccagcctgggcaacaagagtgaaactccatctcaaataaataaataaagtttaaaaaaattaaataaatattactgtaggtggtgtatggttaaggccaaaaccatggtgatggtatgtgactaaattttatttttttattttttatttttatttatttttttttttagttggagtcttgctctgtcacccaagctggagtgcagtggcatgatctcggctcattgcaacctctgcctcctaggttcaagtgattctcctgctttagcctcccaagtagctaggatcacaggtgcatgccaccacacccagctaatttttgtatttttagtattttgtatttttagtagagacggggtttcaccatgttggccaggctggtctcaaactcctgacctccagtgatctgcctgtctcggcctcccaaagtgataggattacatgcatgaaccactgtgcccggcctaactaaattttagaaaacartgttcatagaaccatctaaaagagttcagatgttacttctgcattgttctatgtggtttatattttggaactttaaacatagttttcaaagaagaatggaagaaaccatgaagcttgctamgatggaagacacagtggagtactgcctgttcctgataccagatgagtcaagggactcagataaacataaagagattcttcagaagtacattgagagaataatcactcngtttgcacctatgctggtcccctacatctggcagaatcagcctttcaatcttaaatataaacctgggaaaggtaaggctcttttacttgtttggattagtgtgacttttaatgttatcctgacaacagtgatgtgtaatagtccacgcttcattcagtgttgccaggaagagattaatacactaaactttttagatgagtaatacttgtctatattcagttagccttaaagcttttttttaaaaaaaatcatattaatgaaaactttctaaatttgccttaggaattagcatatactaaacattattaaactcatggctattcttttgaactttagttactacactatgccataatgtatctaagtatctatactaaatagtttcaggcatctggctttaatcatggttccttttgctgttactcaggattccttattttggtgatgtgtttggtaggctgccttgtttcatatagccattttggtgaggatctgagtggctctgcccagcttataaagataaataattgggctttatgactaatatttgccacttacaagcattttgaggtttcttcattgcttccctgtgttgttggtgcttgagatctgacctctggcaaaatatggcactctgtcctgttatgagaaaaacccaggattaaactaggagggagcggagagaccaaagaatgactcggacaggtctatcttggcaagtagatgagtttattaggacttacagacaagacactcctgggcagcatcaggacagctctagaaatccaccccacctcccatatttaagttgctwgtaagctaattttttggctctttgcctactgcgtatatgcaatgacactgttttccttggtatgttcccagctatgccctgcaatgtttgggttctcaggacctgctcctctgctaggcangatggctttggcttgccagctggcctttgaagtttaagcagcagacatatacccttaagtagtctggtggggaactggtcacattacagttctatcatttcttatagttttatgaaaataaatcatgggtaggtgaccaagtctctccttacacagtgacttatgtgaggtcttatttgggatcaggagcctggcatcttgtgataccatcacaagatataccccccatgtatacatcacaagtatacatcactgtgatactctcagtttagtgcgtatctgttatcttttggcaacaattgctacatatcttactgttaattttattgaactcttattcattgaaatacatatgatatttattggcaagaacactgtcacattggtgtagcacatctaaaaccaaccctttatccatcctctagaaaaccatttttactgttttcttatcttgtttaatggcattgccatccacccagttatccaagctagtcagtaattcaaaatcataatcagttcctcacttcaccatgttcagtcagatgctaaatcctgaatgcttctaaaatatgaccccttctctacatctatttggcttcagtgtagaccctctttatctctacatctggaaaacaacaacagcctcctaacttacctctctggttcctgtctttctagttcctaacactgttgctggttatgtttgtaaaacacaaatttgattgtgtcactctcctgcttaatatccttcagtagttcccattgcttcaagatgaaatttaaatcaaagtctaatatagacaaaaatagttactttaattggagttctctagttgaagaaacttgagatctggggtggggagaagaagagttggttgggctgttcttctacctattgtttgccatggcagctcttgagacactctgtaatgcacttgtttgaccttcattctgttaatgtgggatattaactgtacattgattttcgtgtgttgaaccatccttgcatcccaggaataaatctcgcttggtcgtggtgaataatctatttaatgtgttgttgaattcwgattgctgatattttgttaaggatttctgcattgatactcatcagggatattgatctacagctttctcatattgtctttgtctggctttggtattagggtaatgctggcctcagaaggaatttgggaattccctcccttttatttttttggaagattttgaggaggattggtgtcaaattctttaaatgtttggaagaattccccggtgaagccagcttttctttgttaggagcttttggattattgattcaatctccttactagttatagatctgttcagatttttgtatttctcatgatccagtcttgacaggttgtgtttctaggaatttgtcaatttcttataggttatccaacttactggtataccattgttcatagaattctcttatccttcttatttctatgacataagttgtactgtcccctctttcatttccgattttagttatttgagtatttgctcttattcctggttaatcaagttaatagtttgtcaatcttttaaaaaaaacccaactcagctgttttgtttttctattattttttctggtctctatatttctctctgctgtaatgtttattatttccttccttatgctaggtttgggtttagtttttgttttttttttttgaggtataggttgttgatttgagatctttcacaactacaaacttcctttttagcactgctttcactgaattccttaagttttggtatgatgtgcattcattttcatttgtcccaagatattttctaatttccctgtgatttattccaagagtgtgttgttgtttagtttccatgtgtttgtgaatagtgcacatgtttgaaaacttctgctccatccaaatctagcgtcctggtattcccagaatactctatacatacatactctatacatcatgcctctgtgcctttgcacatacttttccatttttctggaaagctcacctcttgtcattcctccaggcaagcatagcacagatatcccctcctttatactcacatagccgttactgcacactcctgttctagagttcattatcttgttttgagatcatttggttgtcttgttttaccctgagctcctcaggagtaggcttcttcttcaggattrcaacccctgctccccagtacttagagcaatcagtcaatkaatgtgtattcagttgaatgattatgtgcattttatttgcagtaacaaatttatctggttacatggttgcttttctcttgtttttaggaggtgttcctgctcatatgtttggcgtgacaaagtttggggataacattgaggatgaatggtttattgtttatgtaataaagcagatcacaaaggaatttccagagttagtagcaaggtattgtagttattttaattattctaaaggaattctattactgaaacaaagtgactacatttttatctatttagtaatttatttttctcctgtagtctgctggaaattgtacagattttaatagtatctgtgctctttttttttttttttgagacagtcttgctttgtcacccaggctggagtgcagtggtgtgatcttggctcactgcaatcttcaccttccgggttcaagcgattctcctgcctcagnnnnnnnnnnnnnnnnnnnntaattgaataaaagaatggtaagttaagagaaaatcaaaatataaagtgggatgagtatattgattaagaaaatacaaaaaaaaagatatagagtggaataaggatgaggacaagaataggagtgaggaatgattatagagaggagaataggaaagaatagtgtattagaggtcatgtagtggatgagaggaaaagaagataaaagatttatgaggttgagagatgataaaagaagtgaagatgtgtgatgaaattgaaagatatataaatgttatagagttgagaatgtagtgattgtaaaggtaatgatagagaaatatgaaaaatatagagtagtatggaaatatgtaagagaagaaagatgaaagaagtataagaagaagaatattgaggaagagaagtgaaggagtgatgagaggtagtacatgtaggagagaggggagatagaccattatagtgagttaagtgtgatataaaagtgagaattcaagagtagtgtgagaagatattagtagtgcgcggcacaggagcggtggctcacacctgtaatcccagcactttgggaggccgaggcaggcggatcatctgaggtcaggagttcgagaccagcctcaacatggagaaaccctgtctctactaaaaatacaaaattagccaggcatggtggtacatgcctgtaatcacagctactcgggaggctgaggcaggagaattgcttgaacctgggaggcggaggttgcggtgagccgagatcgcgccattgcactccagcctgggcaacaagagtgaaactgtctcaaaaaaaaaaaaaaaaaaaattaaagtactgtcaaagagttcaacttccaaaagatttcaaataaaacctacttattttaggttttctttttaaagttctaattatgaaaaaacaaatacatgtggtaaacaaaattcaaaagatacaaaggtttctactgctcttgcttcccagaagtaatcaccattaaattccttgtggatctttgaaaaataaaattccattcatacacatacacacatatttcacgtatttttaaatatgtattcctgtactagaccatagctatattttttgagaaatcatacacagaaacaatttaaagagaagtcagtgaacacaattgtataggaagcaaagtaggtaacattacgttaaaaatgggacctgggttttctgtaattaaccacgtattgccagcagagggcgttccgcccacttatattttgtcctagttttcctagtcagcacccaaattctgatctttttttacccactcaacctctttcccaacagaacaaaatagaagggagaaaaaaacctttgaaaacttattatttaaattttaaacatacattaaagtagaaagaatgaacccacatgttcccattatccagcttcaacaattaccaactcatggtcattattatttcatctgtagctgtcatttgatccttaaatatttcaggatgtaaatctaagcgataactcattttatttttatctttaaataaatttatttaaaatttttaaatgttttaaatttatttattatttatttagttttttaaagacggggtcttactattttgcccaggcgggacttgaactcctgggctcaagccatcctcctgcctcagtctcccaagcagctggtactacaggcacatgccactgtgctctattttattttattttatttttttgagacaggctctcactctcttgcccagactggactgcagtggaacaatctcggctcactgcaacctctgcctcccgggctcaagcaattctcttacctcatcctcctgagtagctggggctatgggcgtgcaccaccacacctggctaatttttgtattttttgtagagacaaggtttcaccatgttggccaggctggtctcaaactcctgacctcaagtgatccacctgcctcagcctcccaaagtgctgggattacaggtgtgagccactgcgcccagcctatttttaaaattgataaataaaaattttatatatttattatgtataacatgttgtcttgaaatacatatatattgtaggatggctgaattgagctcataacgtacattacttcacatgacttgatgtattttggtgtgtggatgcgaacatttaaaatctactgcccttagcaagtttcaagaacacaatacattgtaggcctggggcggtggctcacatctgtaatcccaacgctttgggaagtcgaagcggaagcatcacatgaggtcagaagttcgagacgagcctggccaacatggtgaaccccatctctactaaaaatacaaaaattagccatgtgtggtggcccatgcctgtggtcccagctactcgggaggctgaggcaggagaatcacttgagcccaggaggtagaggttgcagtgagtgtgattgcaccactacattccagcctgtgcgacagagtgagactctgtctcaaaaataaaataaaataaaataaaataaaataataaaaatagaagtatagagctagaacgatatataacagtatataaaatatgccatgtcttgtgtaaaaaagggagaaaatacaagtatatatttctatagttagattatgtgtaagcaaactctagaaggatatacaagaaacagcagtgatgcatgtagggttgagcagatagggacaaaagtaggagggagacttttttattttgtaactttttttttttttgagatggagtttcgctcttgttgcccaggctggaatgcaatggtgcgatctcggctcaccgcaacctctgcctcccaggttcaagcaattctcctacctcagcctcccgagtagctgggattacaggcatgggccaccacgcctggctgattttttttgtatttttagtaccagacggggtttctccatgttggtcaggctggtcttgagctcctgacctcaggtgatccgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcactctaggcctgagtgacagagcgagactccgtctccaaaataaaaaaaaaaaaagtgatgcaaatgaggcagaaataattatcttttcaggcccaaataacacctcctacatgaaggcttttctaatctcagctatgtgtttcttttttttcttttggaaccctatagtactttcgtatattttcatatttttgtctaatatttctttatgtaaattgcttatcttctctccttatcatatctaccttcaactcctccttacaatcttacagtctccttcagtgcttaatgttatcttaaatattttgctttcttatagccatctgcacatagtacatactcaaatatttactaagatgaagaggaaaatgtattagaatgaaactgttttggttactagcagatatatgctttttgaatgcaaaattggaaattttcttgcattaggattgaagacaatgatggtgaattcttgttaatagaagctgctgactttctccctaaatggctggatcctgaaaatagcaccaatagggtaagtatacccaagtttagaaaatttatagagatgaaatcatgctgcattacattcatatgtacctgcagtttgccagtgcccactgtgaaaattgaaatgtaccgtttgcaggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtaagaaaaatatcactttcattgctaattmaggaaccttttggtttcgtgtagttcagtctttctttgatttttgtttgttttccttaaagctctgttggagttgatcagtctttctttgactataaaatacctttcacctagattaatgctaattttcattttgtcttcattcctctttatgaaatagactagtaaattaaacttacagattttaaaatcaggaaacagatacatctttaaattcccattcagaagtgttacaatcttgtcccaatatttttgcatttatttaccttagatattgtggctaagtattagctatatccatgggtaaaaaatttgagacctttaaaaatagaaacttcatgggcctggagcgatggctcacacctgtaatcccagcactttgggaggctgagcagggggcggatcatgaggtcaggagttcaagaccagcctggccaacatagtgaaatcccatctctactaaaaatacaaaaacaaaatagcagggcgtggtggcaggtgcctgtaatctcagctactttggaggctgaggcaaggagaatcgcttgaacccgggaggcggaggttgcagtgagctgagatcacgccactgcactccagcctgggygacagtaggaaactccatctcaaaaaaaaaaaaaaaaaaaaaagtagaaacctaatggagcacaaacaaggtgctcaggttttttctgttgttctgggtctgtatatgggattctttgacctatgtcagaattcagtttctgaataaaactttagcttttattcagaaaagaaaggtcttagcctaattacatattcgttcatccattcaaatttgggtgcctattaaatattaagcaccattcaggtattaacaatattaaaaatatttttggccgggcgcggtggctcacgcctgtaatcccagcactttgggaggccagggcgggtggatcacaaggtcaagagatcgagaccatcctgaccaacatggtgaaaccccgtctctactgaaaatacaaaaaattagccgggcgtggtggcaggcccctgtagtcccagctgcttgggagactgagcgcaggaaaatcacttgaacctgggaggtggaggttgcagggaggtggaggttacagttgcagccgaggttgcagccactggcactccagacctggtcgtacagtagtcgagtactccgtgctcgaaaaataatatatgaaattaataactatagaatactctctttctagtctgcagtcatactattgattaccatgtctattttagctaagagataatatctcctgtattatttcatgttctttgtaattgcgcgcgtctaggtagtgatattcacggctcattttacctggcttgttctgttttgcgcgtatttttctgtcgcgagtgggtgactacgtgtagtcatttgttgtttagtctttcaaaggtgtcttattgctttgtcgtttccttcggtcgtatactgttccccacgtgttttcatgctctattctcaatcaatatcttcttttatatcttattgcttccaactttctctatattctttcaatattacattattctctttttatatactatgccatcataatttttcttctatatctacttcgttactctttattttactatatccttttttatgttcgtacttatcactactcagcttcttctctcttcatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattattatttttttctttttacatttctcagtgctcagtgaatgaaacattattttaattgttctctagaaaaaaaaggaaatattctgtttcttcatagcatgttaatatagattgaatattccttatctgaaatgcttgggactagaagtatttcagatttcagatttatttggattttggaatatttgcattaaacttactacttgagcatcccaaatctgaaaattctgaaatctcaaaactttgagcatatcgttgggactcaaaaagttttggattttggaacattttagatttcagatatttacatttgggatgctcaaactatacacgttttttcttttcttgcacccagtgaaggaaattttcaagagacctgcctccccattttatactcaatgttttatagctatttttgaccatatgtttctatttctataattatttccttttttttttttttttttttttttgagacagagtctcactctctcacccaggctggagtgtagtggagccatctcagctcactgcaacctctgcttcctgggctcaagcgattctcctgcctcccgagtagctgggattacagtcacctcccaacacgcccagctgatttttttatttttagatggtgtttcgccatgttggccagactggtctcgaactcctgacctcaagtgattcacccacctcagcctcccaaagtgctgggattacaggtgtgagccaccgcacccagcctaattatttccttcttaacaataaaacatttcatctcttccagagaattaagaattattcttggccgggcatggtggctcacacctgtaatcccagcactttgggtggccaaggcaggtggatcacttgaacccacgtgtttgagaccagactgggcaacatggtgaaccccatcgctacaaaaaataaaaaaattagctaggtgtggtggtgggcgcctgtaatccccgctacttcggaggctgaggtaggaggattgcttgaccccaggaggtttgggaggccaaggtgggcagatcacctgaggtcaggagtttgagaccagcctggccagcatggtgaaaccctatccctgaggcttcagtgagccatgattgctcactgcactccagtctctgcaacagagcaagaccctgtctcagaaatagaaaaaatgaattatctttatcttccagccatttaattgctgtataatgtaactaatgataagaattttactagcgattactaaaaagtaggcagtagggtaaaattttttttgcaacagtgtcttgctctgttgcccaggccggagtgcagtggagcaatctcagctcactgcaacttcctccacctcccgggttcaagcaattctcctgcttcagcctcccgagtagctgggattagaggcgtgcgccaccatgcctggcttatttttgtatttttagtagagatggggtttcaccatgttggccaggctggtctcaaactcctgacctcagatgatctgcccaccttggcctcccaaagtgttgggattacaggcatgaaccaccatgcctggccagcagtagggtaaattttatggtatgtgagttgtatctcaataaagctgttactaaaaacaagtaggcaatgaataggttgaatcttctttgcatttcatatgaatatgaagcttataaatggacttctcattatatttaactgtgaagtgttattcacaatcttaatttcaggaaaagactcatgtattttgtgtcttgatgcccaggtcacattcactaaatgtctatatgcacaattggtgcaacaaaggtttgtgccagaccggcggagtggatacaggctgcctcctccatctgatccccagtaccgagcccatgaattgggcatgaaattggtaatgttgaaccagaaaatgttgtttcctttctttatgtaaatggactcttaatagaatagtggcacaatatacaaagtccagaaatacaccctgtttatgtaagaatgcagtaaaatgtggcatttcaaattagaatgaaaaaaatggattacttagtaagtgatgatgggacaagtctgaagtcatctgaaaaattgaagttgattccctaatacctataccaaaataaattccaattggatcaaatatttgaacataaaaattgaaactatacaatttgaaaaaaaaccaagaaccttttataayttgaataggaaaggcctttctatgcatgacttgaaaccagaagctataaagggaagactgatgaatttgattatgcaaaaattaagcatttctgcacgggaaagaaaaactccataaataaagtcaaaagcaaatctggaaaaagtgttatatttgcaatctaaatgaaaaagagctgacttctctaatacataaagtgttcctttaagtcaatatgaaaatgataatactagccaattaattttaaaatgttcagaactatgaacatagtccacagaaaaggaaatacaggtgacctttaatttaaacatatgaaaaatattgaatcttaactcataataaaagaaatgcactttaaagctacaaaatagtgtttttcttttttttttgtttgctttcaaaaatgttacaatctagacattgataggaatgtctagattttctttttttttttattattatgctttaagttttagggtacatgtgcacaacgtgcaggtttgttacatacgtatacacgcgccatgttggtgtgctgcacccattaactcgtcatttatattagatatatctcctaatgctgtccctcccccctccccccaccccacaacaggccccggtgtgtgatgttcgccttcctgtgtccrtgtgttctcattgttcaattccccacctatgagtgagaacatgcggtgtttggttttttgtccttgcaatagtttgctgagagtgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacagtgaacataygtgtgcatgtgtctttatagcagcatgatttataatcctttgggcatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttctctgactttttaatgatcgccattctaactggtgtgagattaccatctcattgtggttttgatttgcatttctctgatggcgagtgatgatgagcattttttcatgtgtcttttggctgcataaatgtcttcttttgagaagtgtctgttcatgtcctttgcccacttgttgatggggttgtttgtttttttcttgtaaatttgtttaagttctttgtagattctggatattagccctttgttagataagtagattgcaaaaattttctcccattctgtaggttgcctgttcaccctgatggtagtttcttttgctgtgcagaagctcttgagtttaattagatcccatttgtcaattttggcttttgttgccattgcttttggtgttttagacatgaagtccttgcccatgcctatgtcctgaatggtactgcctaggttttcttctagggtttttatggttttaggtctaacatttaagtcttcaatccatcttgaattaatttttgtataaggtataaggaagggatccagtttcagctttctacatatggctagccagttttcccagcaccatttattaaatagggaatcgtttccccatttcttgtttttgtcaggtttgtcaaagaccagatagttgtagatatgtggcattatttctgagggctctgttctgttccattagtctatatctctgttttggtaccagtaccttgctgttttggttactgtagccttgcagtatagtttgaagtcaggtagcatgatgcctccagctttgttcttttggcttaggattgacttggcaatgcaggctctttttttgttctatatgaactttaaagtagtttttttccaattctgtgaagaaagtcattggtagcttgatggggatggcattgaatctataaattaccttgggcagaatggccatttttacgatattgattcttcctcaaaatagtgtttttcatcatttattagcaagtatcaaacggcttgataatacatactgggttgttgagaatatatacagaaaaacattctcagacattgttgataggaatataaattgattgtatcccttaggagaacattttggcaaaacagatgttccttgacttacagtggggtaacttcctgataaacctgtcaaaaattgaaaatatcataagtcaaaaatatatttaatacagctaaccaaccaaacatcatagcttagcctagcctaccttaaatgggctcagaatacttacattagcatacagttgggcaaaatcatctaacacaaaggctattttataataaactgttgaatatgtcatgtaatttattgaatacagtatactatagagtacagtattggttgattgcctttgtgatcacattgccaactgcagcttgctgccactgtgtatccagcatcatgagacagtatgcatattgctagcctgcaaaaagataaaaattgtaagtaaggtttctactgaatgcatattgctttcacaccatcataaagtcaaaaaatgttaagtcaaaccatcataagttggggaccatctgtattcatcaacatttaaaatgcacaaacctttttagtcagcattttcacttctagaaaatgattctttatgtattttacctatatacaaggacatatatggagcatagtcatgacagcattgttcatagtagcaggagactggaaactacttaaatgtccattagtaggggaatagttagataaattgtgctctagccatgaagtaagatggatgaatttgtgtgtgctcatgtaagtgatctccaaggtatatggttaagtgtaaaaagcaaggtgtagagtagtgtgtatgcgtccattgagcaacaaaaggggtggagtagaaagctatgcatacagagaggcacacacataatacttcagtgtgtaggttacttctgaaaggatgtgcaagaagttggtaatggtgttctctagcttgatcagggaagctccctgtttgaattatttagccatgtgcatctattattttttttaatcaaaggacttttaaaatgaagtgatttcctctctttactatgtctgagatcatgttcaatatatgtataatttctgttggacaagaaaccttttgtaaccctgttcataatcaaacaaaaaataaatgtaaatttctggttttgtaatcagcaggaaaaggaatctctttgaagagaacaggaatctttattgtatattattttctttccttttatgtttttagtaatctataatgattgagaaacttgggaataagtttatatttttcataaaattcaaaaagtgttataattgtccaaatgcccatgtatccagtcatctagttctagagtgtggctcaatggraaaaaagtaatgtgttataataagatacgggaaaaaaggaacttagtaacaaaaattctacctatctcatctaggctcatggatttgagatcttatgctccaaatgtagcccacatttttctgactgcaagaaatcccttgtgactgcctcaccactctgggccagtttccttgaaagtctgaaaaagaatgattactttaaggtaggacttgcartatatttgcttttaagtattcaatccagggaaaatcaagccagcgacttaaagtcctatagtccatatttaaatgtatgacataattatggaagctagacttaaaggagacctttctagttcagtggtactcaggtgctaatgaaggaggtatctatgaactgtttccagtattagagaaaaactaacactgttggtattaaatgatgaaagtgattatctgtaccagataaaacaacttgcaaaaacttgataatgcaaacatgaaaacaccagataggaaaattagcaaagatgtggattttaaaaattattaaaagatacctagtaaatttctcttaaaatattcaacttcacaagtagtaaagatatatatatatatatatgaacacagtaatgaagaatgtctttcatgtatgtacaaaaggatatgaatgatattctgtgctgtcgagagtatggtaaaaataacactcctataccttgctggtaacattgcaaactggtagaatcttaactggaaagtaatttggtagtgtcttccaagaggtatagaaaggttcaaacttggaaccttcactttgaataatctttttaaaggaaatatccaagaagtggaaaagtcccgaagmatatgatgatgataaagatggcacagcaatacgaaaagtactaatgatattatagtatatatatggtatttttttttttttgagatggagttttgctcttgtcgcctaggctggagtgcaatggcacaatcttggctcactacaacctctacctcctaggttcaagcgattctcctcagcctcagcctcctgagtaactgggattacaggcccacactaccacacccagccgatttttgtatttttagtagaaatggggtttcaccatgttggccaggctggtctcggactcctgacctcaggtgatccatccgccttggcctcccaaagtgctgggattacaggcgtgagccaccgtgcccagctattactgttgttgttattgttgttgtatagggtcttgctttgtcacgcaagccagtgttgtggtaggatcatagctcactgcagcctcgatctcctaggctcaagtgatcctcctgcctcagcctttcaaatagctgagactaggcatgtgccaccattgcctggctaaagattgtttttttttctttttagtagagtcgaagtcttgctatgttgcccaggctggtctcaaactcatgtcctcaagtgaccctcccacctctgcttcccaaagtactgagattataggcatgagccacagtgcccagctagtatattcttaaaaaatgtaaaatactaagtatgactatcactataaatatgcatttagaaaacacaaatgatagtaatggtgggattttgccattttttattctacttggcaaactttctgtactttgttttgtgaattactagttaatcagctatatctttaatttaattttttttttcatagaggcagggtctcaccatgttgcccaggctggtcctgaactcctgagctcaagcagtctgcccatctcatcctcccaaagtgttgggattataggcgtgagccatcgcacccagccaattatatcttaataagtaattaagtaaaagaaaatggtggaaaactttccaaactggaaataggcccttaatggtggaaaagattaggaatcactacatctagccgcgtcccctcatttgaagaaactggagctcaaacaggcccattaatgataaaacagggcctaggacttggggcacgtgattcctgagtagtagattatttgctgcctccctgaaagttgctggtgaacacatttttttcatgacaacttgtgagtaatgttctgatagacctttttttttttttaagggactgatagaaggttctgctcagtaccgggaaaggctagaaatggcagagaattacttccagctctcagtagactggccagaaaggtgagttattgttaagactcctactacaaagattggtatttaggtagttctttttattttttatttattatttattattcttatttatttatttttttgagacggagtctcactctgtcacccaggctggcaacctccgcctcctgggctcaagcgatcacaccactgcactccagcctggatgacagagtgagactctgcctcaaaaaagaaaaaaaaaacaacgaaagaaattttgcatcctcctctatgtaattttactcatcatgatatcacattttccatggcattatgaagtctttataaacataatttttaaaagctgcacaatatggccaggcgcggtggctcacgcctgtaatcccagcactttgggaggccgaggcaggcggatcacgaggtcaaaagatcaagaccatcctggtcaacatggtgaaaccccgtatctactaaaaatacaaaaattagctgggcatgatggtgcgtgcctgtagtcccagctacragggaggctgaggcaggagaatcgcttgaactcaggaggcggaggttgccgtgagctgagattgcacctggggacagagcgagactccatctcaaaaaaaaaaaaaaaaaaaagctgcacaatwtttcagcaaatggatgtacccccataatttactcaactattttttactgttggggaaaaaattacaagtagcttaaatgtccaacattttaatttatgttgcaggagaggctcccattctgcacaccaggataatttttaaacagtttaaaaccaaacttccatctccctccagacctgttgttgaattcccaaagtttgtggtttttttaaaatagctgaattaatatcgtagacttttattttagatttacctttcattttcactttttttcatttattgttattattatttatttatttattttagacagagactcgcttagtcacccaggctggagtgcagtgctctgcctcccgggttcaagtgattcttctgcctcagcctcccaagtagctaggactataggcatgcaccaccaggtctggctaatttttgtatttttagtagagatggggtttcaccatgttggccagactggtctcaaactcctgacctcaggtgatccacccaccttggcctcccaaagtgctgagattacaggcgtgagccaatgcacccagccattaattttttatttttaattattgtggatacatactagttgtacatatttatggggtacatgtgattacatgtataatgtccatgtggcatacaatgtataatgatcaaatcagggtaattaagctttccatcacctcaagcatttatcatttctttgtgttgggaatatttttagttattccatttttttaaggtatttggaactatataataaattattattaactgtagtcaccctgttgtgctaccaaacactagctctttttaattttttaaaaaatattttttgggatttgccaggaagatgttactaaaaagcattccagatccagaccccaagagaggggtcttggatctcatgcaagaaagaattttgggcaagtccatagagtaaagtgaaagtatgtttattaagaaagtaaaggaataaagaatggctactccataggcagagcagcaaacactagctcttattccttctatttaactaatttttgtaaccattaactatcccctcttttccccccgctctctgctacccttcccagcctctggtaaccatcattctacttttattattattattatttgagatagagtctcactctgttgcctagactggagtgcagtggtacagtcatagctcattgcaatcttgacctcctgggtttaagagatccccctaccttggcttctcaaagttctgggattacaagtgtgagccactgcacccagccagccattattctgctctctgtctctcagtttagaattgtttttagctcctacgtataatatcatagactttcccctaatttatcagagattgtaatagtgaaaaattataagcaaccaaagtatccatcaataatggataaatgaattgcagtgtacttatatgatagcctgctatctagtagttaaccagagatgaactatatttacatatatctgatttaggatttttcaacctcagtgctactgacattttggatctgataatttattgtgagggactggcttgcacttcataggacatttaacagcatccctggcctctatccagtaaatatcaatagcacttctccctcatcccccaatcatgacaaccaaaaatgtctccagacattgccagaggtacctgggcggcaaaatcgtccctggttgggaaccactgatctaaatgggaaccactgatctaaatgaatagatttcaaaaacataatgcagtgaaaaaaaaaaaaaaagcaagttataaatacgtacagtaatgggtaccaaaaaaaaaaaaaatagaacgaatgagtaagacctactatttgatagtacaacagggtgactatagtcaatgataacttaattatacatttaacatagagtgtaattggattgtttgtaactcgaaggataaatgcttgagaggatggataccccattctccatgatgtacttatttcacattacatgcctgtatcaaaacatctcatataccctataaatatatacacctactatgtacccacaaaaattaaaaatgaaaatgaaaaagaataaaatatataccgtgtggatgttacacatataaaaattttaaatatacaaaatactatacaggctgggcgcagtggctcacacctgtaatgccagcattttgggaggccaaggcgggtggatcacgaggtcaggagytcaagaccagcctggccaatatggtgaaaccctgtctctactaaaaattcaaaaattagctgggcgtgttggcacgcccctgtaatcccagctgctcgggaggctgaggcaggagaatcgcatgaaccctggaggtggaggttgcagtgagccgacatcgcaccactgcactccagcctaggtgacagagcaagactccgtctcaaaacaaaacaatacattatttatagatacatatatattcatttattcaacaaatatttattgaatgcctcctatgtgccaggccctattccaggtactggggatataataaatgaacccaaagtgtccttgtccttatagagcttacatgctaatgtaggagaaagaccgcaagccattatgtaatattagggggtggtaagtgctatgaagaaaaagcagtgtgtggggtagaggggtagagactgctcttctagatagattagtcaaggaaggcctttctaaggaagttttctttgaaaagagacctgaatgaagtgaaggagtgagacattcagttatttaggggaataacattccagcaaaaggacagacagcaaatacaagaaatagaaacagaaatatatatacatacagagagagagaaaagtgccgaagtatacttgagaaagcagtcacctctggggagcaagacaatggattgggatgggtggcagtggtcatcaaaggaaacattagctttctctacaatttttttttttttttttttttttgagatggagtctctctctgtcaccaggctggagtgtagtggcacgatctcagctcaccgcagcctccacctcccgggttcaagcgatgcccctgcctcagcctcctgagtagctgggactacaggcgcgtgccatcatacctggctaatcttttcgtattttagcacagacagggtttcaccatgttggccaggatggtctcgatctcctgacctgtgatctgccctcctcagcctcccaaagtgctgggattacatctctacaatatttttaaggtacatgataaacctatacacttttttgtcaattaaaaataaacaaataggccgggcacagtggctcacacctgtaatcccagcactttgggagaccgagatgggtgaatcacctgaggtcaggagtttgagaccaacctggccaacatggtgaaaccccatctctactacaaatacaaaaaattagcyggatgaggtggtgggcacctgtaatcccagctactcaaattaaaaataaataaatagccaggcacagtggctaatgcctgtaatcccagctacttgctgagataggaagattgcttgatcccaagagtcaaggctgcagtgagctgtgatcatgccacgcactctagcctaggcgacagagtgagaccctgtcttagaaaaagaaaaaaaagaaactatgcacagagatacttatgtgttgagtgagtgacataatggtgacatgatttgttacataaattgatggcaccctgtctgaactattaagaatggatcaaatcaagttgtataaaggacttgctttaattggataaacatttgcataccttgcaaaatcacgtaggtgatggggaactgtctctactctgtattattaatatgtaaacgttactaggagagagaataaaccaaataatcataacaaaaggcaaaataaaaatcattctggaatatcaaatgctaaagagagtcatagtgagaaggtaataaactttcactaaggttgaagcagagatgttaaaaaaagaaagataatggaaggcttcagggaggaggtatttgagttaagtcttaaagaatgaggattttttttctttttatggagtctcttttttttttgagamggagtcttgctctgtgcccaggttggaggtgcagtggcgcgatcctggcttactgcaagctccacctcctgggttcacgccattcatctgcctcagcctcctgagtacctgggacaacaggtacccrccaccacgcccagctaatttttttttttttttttttttttagkagagacggggtttcactgtgttagccaggatggtctcgatctcctgacctcgtgatccgcccgccttggcctcccaaagtgctgggattacaggcgtgagccaccgcacccggccaacggagtctcgctcttgtcgcccagcctggagtgcaatggcacaatcctggctcactgcaacctccgcctcctgggtaatacagactttgcaaaagttaaagaacttccctgggttctggttttctcatctgtaaaacaggattattaccttctataatagtaacaaaaggactcaataagaaaatgtatttaaagtgttagcatagcatttaatacatgctagataaattttaattgatgctttccttctggatcttcttttcctcgtatataaaatatatattatatgtatatttttatgtatttttagtacgtgttttatatgtatatgtactattaacataatacaactgtatgtacatatatatacatatatagagagagaccctgtctctgcatgtatgtatagaaagaattatacgagatcagtggcttcataatgatgttccatggagcctgcttcagagccaaaaaggaaggccaattgtgtagatctctgagcttctatcctccaatttatttatttttattttattttattttatttatttattgagatggagtcttgctcagtcgcccatgctggggcagctcactgcaacctccacctcccgggttcaagcaattctcctgcctcagcctcccgagtagctgggattacaggcacgtgccacaatgcccagctaatttttgtatttttagtagagacggggtttcaccatgttggccaagtgaactcctgacctcaagtgatctccccgccttggcctcccaaagtgctgggattacaggcatgagccactgtgcctggcctatcctccactttaatgaaggccatttttctttgaccccttctatattttagagttcctggtaaaagttttgtttgagaaaaagggatctgcaacctaaaaatatgcttaaaaacaaattagaaggctgggtgcggtggctcatgtctgtaatcccagcactttgggaggccaaggcagggggattatgaggtcaggagttcgagaccaacctggccaatatggtgaaaccccatctttactaaaaatacaaaaattagctgggtgtggtggcgcatgcctgtagtctcagctacttgggaggttgaggcaggagaatctcttcaacctgggaggcggaggttgtggtgagccgaggtcgcgccactgcacaccagcctgggcgacagagtgaaactctgttaaaaacaaacaaacaaattagagccaggtgttttggcatgtacttgtagtgctggctacttgggaggatgaagtgggaggatcatttgaacccaggagttcgagtccattctgggcaacaatgaaaccccatctcttaaaaaaaaaaaaaaaaaacactccccaaattagactagctaatcccttccaaccttaaaatactatgtatttatgattactattctatgttctcttatgaagaaatactcatgttttttatttttcatagttctcttgctatgagccctggtgaagaaatcttaaccttattacagacaataccatttgatatagaagaccttaagaaagaagcagctaatcttcccccagaggatggtaagtgatggaccaggatacagtggaagggttaaaaaaaaaaaattaaaatgttctactcagtctcacaggatcctctcctaagaggacttatgtgaatgtagaatggcagtattatgctttcttctttttcagatgaccagtggttagatctctcaccagatcagctggaccagctgctgcaggaagctgttggcaaaaaagaatcygagtctgtttcyaaggaggagaaggagcagaactatgacttaactsaagtctcagagagcatgaaagctttcatatccaaagtctcaacccacaagggagcagagctgcctcggtaatttgtgttaaagtataaatatataaatagctagaacccaaatgttgaagtcatagtcattgccatttccactttttttttttttttttgagtaaatgagttgtactgcttgctttcttttttgtgcctagtatagtgataacttacttatttgaagtcagatttctagaagcctcatcctttgcaatccttgaaataagccagaaagatcaccctaaaaaccatcatccagaaccacacagggaaaccatatactttactctttagtagctttatgggctcaacatttaactttcaacaagttcagacctctgatctcccaccctgcaagcagattggatactgaaaaaggaattcatcagaggcagaaataataacagaaatatgaaactacatttggcaaataacaggaaaaacaggtagatagaattattacttgtaggctgggcgcggtggctcatgcctgtaatcccagtactttgggagaccgaggcaggcagatcacgaagtcaggagttcaaaaccagcctggccagcatggtgaaaccctatctctactaaaaatacaaaaattagccgggtatggtggcgcacgcctataatcccagctacttgaaaggctgaggcaggagaatcgcttgaccccggaaggcagaggttgcagtgagctgggatcgtgccactgcaccgcagcctgggtgacagagcaagactccgtctcaaaaaaaaaacaaaacaaaaaaaactgttacttgtgtatcaaatatatcattattagtgttgatgctcttgaacctgatgaaagatmtaaatttatatttggtattctctctttaagaaagcagggataagggaagatatgttcttgtttattttttaagctttagttcttaaaagaacaggctttatttaaattaactcaaataaataatggttttgctaatgctagatatcttattggggctagagagtgggtaggtccctaaatcagcataagctaaatgtacataaacaagatgcaatttttacttttcatttatcagactttcccatttctgttgtcctgcaaggccagtaaactcaaggatttttaaaacttaaactacaacttttcttgctgtgcctccttagaaattctatctttggtagctttcctaagaatggcaccactttagaaaagtttcraagagttgtatttagaataaattaattgtctttgtcctttaatattgcagaraaccttctgargctccaatcacttttgatgcagattcttttcttaattattttgataagattttaggtaagtagtggtgtgatgttgactttcattttgaaactgttagtagtatggctgttgctagagcattggkttatgagatatctcagaagccaaaatgtttgctttctcttcctggtttgagttgctttcaaccatgaattactacccatgaataattttgtagaggctgcctagcttagtgtttgacatatatagtagctgctcattaattttttttttttttttttgagacagtgtctcgctctgttgcccaggctggagtgcagtggcacgatctcggctcactgcaagctccgcctcctgggttcatgccattcttctgcctcagcctcctgagtaactgggactacaggcgcctgccaccacacccagctaatttttttgtatttttagtagagacggggtttcaccgtgttagccaggatggtctcgatctcctgacctcatgatccgcccatctcagcctaccaaagtgctgggattacaggcgtgagccaccgtgcccggcctcattaaatatttgagagtgactgaatgctgtgtgtttaaatagggttttaccttggctcccatattatattgttcttttttggaattactgtacttacaaatcagtaataaaaagataactcaaaaaataattataatatgtatatatgtacagaactgcagagagaaagattgggatacccggaaactgctaaaagatgcttacctctggggagagagtgagattggagacaatacttgtatggcttgaatgtttacatcaaaatgtattcatttattaggtatttttaaaaattttttaagaaaaatattttaattaattgaattcacttttttttaagctaaatcttttgattcagcttgtacgcttttccacaacattaaatgcacacatatctgccagcattaccatttgtagaagggatttttgtgaagtagactgactgtgtgtattagtctttttcygtgggtaacattctaattattttgagatgtgtagtaactaaawaataataataataataataataataataataattactaagtggctctttctttcttgggatctgtrtagggccaaggcctartgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggtatgtgtgtttttaacctctttctctttctgagtctagtatgtcagatagctaaaaccatattttatcatagtttttctttttttggtgtgtgagatttgaaataaataagaatgttaattgttttcctaastctggtaggataaaggatcatagacttaattttccaaaacataagcttcattatattacttattctacgttatctatcaggatttaaaataaaaagtcatataatatgctcaaattagaatgcgattgtacactactacttcttaaatacattttttttcaaaagtagtttaaaaaaactacagcttaaatggattttaaaaaagagagggcacatgttctcaagaccttttgagactatgccttgggccacagtggattaaaacaaaataacataagtaaataaacaggatcttaaacattcaaataactttccagttttaacagtttattttgtatttttccctaatttagagccaaatttaggattcaccttccgtttatgttttcatcctagtttttaatgccaccactgtctaatcctaaacagaggtattatggaaagagcaagaaccctggagtcttatgggttagggtttgaagtctagctcagctgtccactgtgaatgtatctataaaccagtaatcctcatatcataaaattaacatgagaaccaaattagacagcagtaaaacctacaataggcctttaattaatgttaattctccttgctttgatcatctaaaccacttttaaaactatagtcacttccagaattgtcaaaatctagtagaaaccatacattagatttatctaaagcagtatttcttaaattttaatgcgaatataaaccaaaagatcatgttacaacatagattctgattaagtaggcctgggatgaagcttgagattttccttttttttattattattttgttttattttattattattattattattttatttgagatggaagtctccctctgtcacccaggctggagtacagtggcacgatcttggctcactgcaccctctgcctcctgggtttaagcaattctcctgcctcagcctcccaagtagctgggactacaggtgcgcaccaccgtgcctggctaatttttgtatatttagtagagacagggtttcaccatgttggccaggctagtctctggagctcctgacctcaagtgatccacccacctcagcctcccaaagtgctgggattacaggcatgagcgaccactcccagctgagtttttccatttctaataagccccaagcgatggagactctgctgctccatggacaatgctttgggtagcaaggacataaaagtctatcgagctgtaatctttcaaatcctttccccagcttgtggaatcagaggcccaactaacaatttagaatctttgtggttggaaccacaaagccttgtgtttttacttttaagctttttcactggggggaaagaaaggaacactcgcttctttcattttgaagaaaatttacattattatttcatttaatattcacttttatgtttgtttcttttaagactcttagacaagttataaatgtaccttcttaattctattagcccttgagctatttcaaaatagacatgcaatttattcgatttgcaggaatctttcctggagagaaatgtgttataacctttagaaccaagttttattatgtgtgctaggccatataacttgtagacttcattttcagtttatatcaccaaggataagaagtttcctttttaatttggaatgcaaatttacattgtggcttagttatctttttattgtaaccaccatgcaacctaatgatacattagcccataattttcttttccctctatgaataaggaacctgtatcccagactaccgataacaattcagatgaggaagatkctggtacgggagaatctgttatggcaccagtagatgtwgacctgaacctggtttcaaatatattggaatcctatagctcccaagctggactggcaggacctgcttccaatcttttacaaagcatgggagtgcagctgcctgacaacaccgntcacagaccaacaagtaagccaacaaaaaattaaccagcacatttagcttctcttttttctttttaaataaatattgaatatgattctgttcatttctagtttagattactcatttngtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactsattcactttttcaatttttttaatgaggcayaacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccacwagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttacagacagctccatatactgaccatgtttttataatctaggtctctggattcttctttattattgtatgcagcagagagatgcctttactatatcttaccctatccaagtaaaaacaatggaaatagtttcatactgttccctctccagtgaccaagggaggaattaggagaatggtgtagtagagttctcatctgagaacttactatcacgaactaataaaaactgaatatggccgggcatggtggtgggcgcctataatcccagctacttgggaggctgaggcaggagaatagcttgaacccgggagccggaggttgcagtgagccaagattgcgccattgcgctccagcctgagcgacaagagcgaaactccgtctcaaaaataaataaataaaaactaaatataccatatcccactccaatcctttgtcttcctagtgttcactgaaatgaactaaggaagaggataagtgttacacattgactaaagtaacacatcagatgatattgtgcaacattttaacattttaaataataattattttaaatatatttttattgtttgttttgaagctacatttctcatgttaaaaatggggccagaatgccgtcccagctcaactgtgagaaaaaggtttccccccatcgcacttgtggtacattaggtttatcttcattgaggattaaatattgggtagagaaagggtgataggcaaaaatataaatgaaatttttttttattctggttgccacggctgactgactttcagccaggctcacaagattttacctgtttttctattctgcatcatggacccagatgggttctatttatccttagcaccttcataatttattgcccatgtatatattctcaggtcaggtaggtcctgtaccaaagtttcttttatttatctgccattttcagtattccaggcctgctctcttctgcctcagctttcagatatccttggggttctacagcaaagctcttttcccactcactactgagaagcaaagttcaatgttgcagctcctgctgttagccactctcatcttttcttttccaaaaacacattaatcaaaaaacaaacagttactccatggtaagtttgggaaactcataaccaggaattccgcacactcccctttctatcagtattttcagattggggatgtgtacacatgcgctcacaaacacacccacatagagatagaaaagattgggagatggtaatacacatggaccctgaactgttttcttctaactgcaagatatgaagaaatctcaggacctctcttttgtgagtgcttttcccttctgcatgctgggttcagcccaggtaaaggcaagctgccaatctaacaagacaatcaagtcccatcacatattatccctcaacatttcctgatgaaggcactttgatttccccaaagcaatgatggtttgctggcagtggagagagcaatgaccttttgagatcaaaaggaaattcagtgctttaacttttctagttttagaatctctttagtgctatgggactttgggacttagtcctatgggactttgacatgtaaataaccttagggtctctggagcttttgtctttaatcacaaataagtccctagaatcttctgaagatatgattatttcctcttttcagcaagacctctaacattcctcctgcacattgcttcagttgttacactgacttgaaacctggacttaaatgtttaattgtcaccaatagggatcctttcccctacccccaaattctcaccttgtaaaattttctcaattcacaggacagaaaaagacatcagaacaaaggtgtggaaatttcttttattttccccaaataaactcttctcccttatggcatcatatatgaatgatgagaaatcctaaatttagtttattccataaagtttaagaaataggtcaggtttggcatctgtttatctccaccaatccctttgttaatcaacacgttgtggatgtgcaaatgccagcaactgttttatttaggaaaacaggcatggcaaagcaatagtcttttccctgggtcacaaactgagcatgtgacagagctgaaaacagcgaaaaagatttactgtctggagtcccattgggattctacttcctcaacagagcctcagggcatctgatttattataaagtactctgagtcataatgacttaattgtgacttttatttaactagcatgttcatgtaactagaatgcacctgtacatgaattttaaaatgtcatactgtgctatttttcttaattctgtaagggtaacaagtaactcagtaatgacttaaaacttgctatatattttcaatactaagataaaagttttaaccaaacttacaacaggcacattttggcagttagtgtaaacacaacattaacaagccatatgccagaagatgtttgcttccaaggccttagagaaaatgactgaacaagggcctacatccaaactaatgcttcccccttccccctgatttttgacagttgacagctcatcagttttcttctcacactggcttttttgattgcccattggtaggaatttcttccattaacactgctgatagaagtgtcttactgtaggctcaccctttgctctgcccttctgaggtccttctgcagcttatcttttgtcacttctcctttgtcaactgatctctagtttgtccctcaggaataccaaggagcgatctaagtgacttgatccgggctaagcaggcagggaagaacaggtctgtttttccacccactccttaatcagttggtgggagatggctaacttagggggcagccagaatgggaaagtcccattctgttgctgagtataggggccctttctcttcagggctgtggctacctcatcatgactgaaccaggcagctgtctctaattctctcaagttcacctggatctgaaagacataaggaagaaaaggatgtaaggtcaggagctacaaaatttagaatactatggccaaaggtcagaaaatgattctagaactaagcaatcttagaagataatacctgggatcttcaggttaggtgaaagtcagttctagatactgcccagaagcaaaagaggcataattaagaaatgagagttttatatgtgtgtgtgtgtgtgtgtatatatatatatatttttttttttttagacggagtctctctctgttgcccaggctggagtgcagtggcgctatcttggctcaatgcaagctccacctcccaggttcacgccattctcctgcctcagcctcctgagtagctgggactacaggcgcccgccaccatgcccggctaattttttgtattttttagtagagacagggtttcaccgtgtcagccaggatggtctcgatctcctgatcttgtgatccacccgccttggccccccaaagtgctgggattacaggtgtgagccactgtgcccggccgagttaaatatatttctaacatagtaaaaaaaaaaagataagatacattaaataaatcctggaagtacaaatactaaaatgttaagagtggttaacattgagaataaattatgaataatacctatttttccttgtgtctctattgattgtataaatttttcaattaaaaaagaacatacaaatattactttttttttttttgagatggagttttgctctttttacccaggctagagggcaatggtgtgatcttggctcactgcaacctcccctcccaggttcaaatgattctcctgcctcagcctcccgagtagctgggattacaggcacccgccaccacacctggctaatttctttgtatttttagtagagacggggtttcaccatgttggacaggatgtttttgaactcctgacctcaggtgatccacctgcctcggcctcccaaagtgttgagattacaggcgtgagccactgtgcccagccactcttttttttttttttttaaagggtaagggttaatgatagtcaaaagcatagtctcatctttgcaagaagcaaagtaatgcaaacttcatcccaaggaagctgaaatagattagatattctataaaaaccaaaacatacaataggcaaactttggcaggcagagaccatcagtcagtgatgctagagaagtgcaagatgagattggataaaacaatgtctagccgggcatggtggctcatgcccataatcccaacactttgggaggccaaggtgggaggatcacctgaggtcaggagttcgagaccagcctggccaacatggtgaaacccccatctctaataaaaatacaaaaattagccgggcatgctggcaggcacctgtaatcccagccactcgggaggctgaggcaggagaattgcttgaacctgggaggcgaaggttgcagtgagctgagattgtgccactgcactccagcctgggcgacaagaatgagactccatctcaaaaaaaaaaaaaaaaaaaaaagacaacgtcttaagtttctttcaactacaagtacctatagttttatatttttagttcccagcatcctgactgacttgagcaataagaccaatcctgcagtcagtcattaaatgatgcctgattgtgcgcctactatatgtaagacactcttaactcctgacaataaaaggtaaattgtcttatataaacagtgttgggaaaattggatatccacatgcaaaagaatgaaatcggaccgttatcttacatcatatgcaaaaaccaacttaaaatggattaaagacttaaatataaaacctgaaacaataaaattcttaggagaaaacataaaggaataaatttctagacattagactgggcagtggtctcttagatatgataccaaagcacaggcaagaaaagcaaagatagacaagtagggattctatcaaactaaagcttctgcagagtcagggaatcaatcaacagagtgaagagacaacctgcagaatgggagaaaatatttgcagaccctctatcttataaggagttaatatccaaaatatataaggaacttctacaacttaataccaaaaaataaataagccaatttaaaaatgggcaaagaatctgaatagacatttctccaaagaaggtattcaaatggccaacaggtatgtgaaaaggtgctcaacatcactaatcatcagggaaatgcaaatgaaaacctcataccttctttgatggctactattaactcataccttctttaatggctaccattaaaaaagtacaacggacagcaagtattggtaaggatgtagagaaaagggaacccatgtacactgttgtggggaatgtaagttggtgcacctactatggaaaaaaatatggaggttcctcaaaaaattaaaaatagaattaccctttgatctagcatcccacttctggattgaaatctagatcttgaagagatatctgcactcccatgttcactgcagtattcacaatggatgaatggataaagaaaatgtggtatatactataatagaatattattcagccttaaaaaggaaggaaatcctgcagttgcaacaagatagataggcccaaaggacatgctaagtgaaataagccagacacagaaagacaaatattgcatgatctcacttatatgtggaatctaaaatagtcaaacttacagaagcagagagtagaatggtggttgccaggggctgaagggaggggaaaatggaaaaagttgcatgccaggggctgaagggagggtggccactggtcaaagggtaccaggtttcagtcatgcaaaataagttttgaagat

SEQ ID NO: 10633 - DNA, 12592 bp, Homo sapiens
cccgactacaggctctggtgaccatgtcagatttgggtctgaaaggcagtgcttagcctgggtttggctgtgaggaggcccttggtaggaaggcacttgctgatggcagaaaggaatgaggagatgttttctcaatggatggatgaatgaaggagtgtttattaactagagactaaagaaagagctgcaggtgtgctgaggtctgcattgtgaggtagacaacctgcaaggggtggggggggggcgcggagtgggggcactccccagggagcttccctcccagtattcatgccctgtgtagcatccgctcacattgaatcacagctggttggtgtggctaataaaatactgcagaaggtatggtatgtgtctgaggctaggtcatgaaagacattgcagcttccaccttgctctcttggattactcactctgggggaggctagctgccatattgcaaggatgctaaagaagttctatgaagaggctctggaaaagaggcctcctgccaatagccagcaccagctgccagtcccgtgactgagccaccttggaggtggatcctccagcccagtcaagccttcagatgagactgcaggactggctgacatcttgattgtagcttcatgacagaccccaatccagaactacttaggccactccagaattcctgacccacagaaatggacagaaaataaatgtttattgcttgaagccactaagttttagggtgatttatttatttatttttatagaaataggatctcactctgttgcccaggtcagagtgcagtggcatgatcatagctcactgcagctcagcctcctgaagcaatgctcccacctcagcctcctgagtagctaggactacaagtgtgcaccaccacactcaactaatattttggggtaatttattatggagtaacaggtaactactgcaaattgctaagtgtcttttgagctaaaattcaagagcgcttcctgaaggagtcagttattccctctgtcccctaactcacttcagcccttggctctcacctgtcttgtgttacatgaaaagacaaaagacaggttggttttttaaatccaggcttcccaatttactatttggatgactggaggatttttgtcataacaaattattctccttatccttttcatttcttctccctcctttcctttcctcctctagttacttttcttcatcagtcttgctatagtaatagtagcatttagtagcaatggctgtctttttttttttttttttttttgagatggagttttgctcttgttgcccagcctggagtgcagtggtgcgatcttggctcactgcaacctccacctcccaggttcaagagattctcctgcctcagccacccaagtagctgggattacaggcatgcgccaccatgcccggctaattttgtaattttagtagagacaggatttcaccatgttgtgcaggctggtctcgaatgcctgacctcaggtgatccacctgcctcgacctcccaaagtgctgggattacaggcatgaaccaccacgcccagtcgctattattttttaggtacctgctatgtgcctggcactgtgctaggggatctatgggcattttattcagttccctcaatgaccctggtggtcatggtgggcattagtatatatagtaatttttattatgtattattatgtatgtattataatacataataatttttaaaaatagataaaacccaggttcagggctgttggatcacttgcccaggatcagatacaaggaatcagattgaaggccaggtttgtctgagtccaaagcctgtgtccatttccatttcacgcttttacctgtgagcctcagctttctcatatgtaaagtggggagaatactgacttcacagattcctgttgggatgaggagagcaggaggctttaaagtaatcagcccccatgtgtggcatacagcaggtggttggtgagtaggggttcccttgccttccctttttctcccctgtcttatgtactttgacatgggctgtcttgaccctcatgcagacagggccatggcaagtgcctctcacaatgagagcagcagggagttgatgtggccaagagctgaagacccctggtcctgtcccaggatagagtggatgccctgggtctggagcccacggagatggtgacaccagctctgacccacccactgagtctgtgcaatgtgctggctctgtgctccgacggggaagtgccctgcctgagctcacccagagggaaagggctggagcctgcactcatacccagactagtgcctgtggagacgctgggtgtgtagcgttgtctccagctggagaatcccagctgagaaaacattgtcctcagggggtatcgcatcatctctcagatcaggcaagaagccccaattaattacaagtgctaagtgagtggtctggaagcaggattttgcagtcaattaaagagatgctggaggaggcttcattaaccccctgcttcctggcagcttttggtttaggagaaagaggggagctgtctgcctagaatgagcttcccaacactgtggagaatgtaagcaggagtgcgccctctacctaagatgacacaggaggttttcctgaattgcatgggaggatggatttgactttacatccccttcccatcccaggtttcttgatttcctgtgctttgatcctgtagtgaagtcaatagtcaagacatggctacattttggggttcaccttcctcacagccccagctgatcttcctcaatctgcacatctgatcatggcatatctctgctcaatacccttcagtgacttcccattgcctgcaggtagagtccaagctccacgtcctggcacccaggttgaagtccccgacctctcagcctttcacggagagctcaatgaattcacgcagataccctctgtttctccatcccccactcccattgcccaggttaaactacttttgtctgctccatgcctttgttcatgccagtccctctcctggatgtgccctccttctccaccaggctgattcctactcattgaagactcatctcagatgtaaacccctccagggagcctgcagcacgatcccaagttcaccggtggcactgctcatgctgtggtgggcagctgttctgtttctccattatctcctccttcagcacgtaggttcctggagggagggctgtatgattggtattcttggtgtctagcacatggtggaagcccagtgaatactcattttaccggagaggattaagactcttaggagaagacattcaggactgaaaatgagaggatgctggcatttactgaccttgcgatccactgagtggagtggagaggagatggaagctgagggcagctatctgagtgtcccaggctgggttgtttctggaggtgcgccctgagtcttaggaggacagtgcctggggtgctgggcagagcacacagatggactctcagggaagccacaagcccttttgttctctttctctccagtccccacccttaggaggccctcagagcccagcctgggggctctgggaatgaccgtagtcttgtagaggctccaggagagcctgccattggctgctgctccagctctgagacatttcctccaccgcctgggaccctgtggctgaagaggtttggagctctggcttctccaaggccctgctctactccagtgctttgtaggaaagggggagttgcctcagtctctatggtgggcagcctctaagatgcccccaataatcccctgtcctggtattcacaccctgtgcagtctcctgcccaagagtgtgggtgagtcctgtgacttacctctagccaatagaagatggcaagggtgacgggggagtcacctccatgattagtttatataacaacgtggcttacatcttgctagcagactctctctgttgcctttgtggcttgcacgctttggtgaagcaagctgccctgtggtgagctgccccagtgggagaggcccacctggcaagggctaggggatggcctccagccaacagtcagccaagaactgaagcccgcaatccaacaggaactgaagcctgccagtaatcatgtgagcttggaagtgagtcatgcctagctgagccttctgatgagaccccaaccctggcctgcaccttgactgcagccctgtgagaggtcctgaagcagaaggaccctggtaagctgtgctgggactcctgacccacagaaatggagataatacacatgtgttgttttaagctgctgagtttgtaataatttgttatgtagccattgatcactagcacggcctcccattgcacactgagctccatctgactcagagagtccaggggccctgctacctacagtgcactaacccaggggtatgggcggatctgggagaacaggcaggagggtgatgtcaggacatagaaggtgggggatcagggtctgcacccctcccctcattgcctagtaagtacaaagagccaaaagaagagtgactgtggctaccaagtagatggtgcaaagattgatatcttgggccctgaatcagcattggggtccctggcaacacactgtgggccagaccctatgctgggtgttgcagagggatcagagcacaggccagccctgccctcataaagctcccaagttagtgagggatacaggtgcagcgacatctctttcaacagaaattgcaaagctccattcactgaatgcttggcgtgtggtgctcaaagcatgtgcaggaccccatttactcttcacaacaagcgtggagatcggagcaatgcttatcatcccatttcacttgcgagcaaacactcagaggggttaagtggcttactcaagatcactctgctgggtgacagagccgtaagcacatccagcgctgtctgaacactcagacatgatgctatgtggctgtgagcacaacagcctctgctctggtcagggagacgggctggatcagagtgggcttcgcagaggaagtgatgtttgagctggagcttgagggagctccaagctccttagagcaccaaggagagtaagggcaccattcatctcaggcaccggggacagaatatgcaaacaccaagaagatggtatagatggggactggggcacttggagcacagaggtgggtgtgggtctgatcagtaggttgaggccacatcacacagggccatttggacaatctggatgttatcctataggcaggcgccttcctgtaggcctttagagggctctgggcagggagtgacatggtgaagtctgcattttggatgcgccttggaggcaggcgcagggtggcagaagagggtgcatggaaggagaggggtgggggctgggagaccattgcgtggccatgggaagggcccagccaagctgagaggattgggacctaactaaggcagggtattagggtgagggtaagggtggagggggttccggaacagttctgactcctcaccaaggcctgggaagtgcctgtgtctgggaggaatgctgagtggtgtcctttctttgggaccccaggcttctgcacgtggcccgtggggagtaggtctccctcagtgtctggggaatgaatgaggacaggttgctgcccaccgtgcgacttgacagcattctcaggaagtggcacccagaggggctcgggggaaggggtgtcagagatggtgtgtgtgtgcggggggtgggggggtggtccatggggaacactcagcccctggggctgaagaattgattctggaaggcagggaagcagagtgatcctggaaccccaagcccagtcccaactctggctgcggttgatttctggagtcatctccatggtgtcctggccagaagccagggtaaaattgaagattttctggggcctcgagctttgtgggttgcctcctccctggtgagttggtgcccctgtttgtctctggtggtgccgatggacagaagagcacagacagagagctgctgtacaaggtctttttctttgttgtcatggttgattttgtacatttcagcatttgcatcatacaaaggggggagcaacagccatggcttttggtcaggttcaggggggctgagggggtgctcctcccctccccccaggcactgacacattgaaaggaagcagagcaacaatgacacagcacggatgtgggaaaggggatcccccacgsgggcaggatggtccatctcaccggggtctcaccaggactccccgctcccacccagggccagcacgagcacctcccgttttctccccagtgcagagcgtggggtgacaggagtgggactggagcaggggacatttggtgggaggcatgtcctcaggcctgggagaccaggctggccccagcctccctgtgcggtcaggggcctgtggaaccctagaggatggagcaggtggacagcaggggtgggcaaccctgccagctgggtactagggctattggggctggagggtcyaccccactgtactctagccacaaggctgtggggtggctgctttgcccaccagctgtccccctgataggggatctgggctgcaatacttctgtatcctccctgttctctctctctctcttacacacacctgggatggtgtctcgacttcctgattccatctggaggagtaccctgcacagctttgcagttaaggacaccttctgggagcttctggatttggaggggaggacgtccatgtttggagatcctgacctgtcactggtgcccagcccagggcgatccacagccgcctttttgcttctctctggcagctcctcccaggcatgggatcctgggcccttccctgagagcacacacgctcacctcacctggtgcacgctcccttgaacctcattcttttttcacccatctacaaatgattgctccttcctattttctcatctgggggttctctcccttgtgtgttgtgtgcgtgctgaattctggggccactcctcccctaagtgtgttgcatgcacactgccccatttgtatgtgcacactcattgccctcccatccagtgggtcacacacacctcacctcccaggcgatcctgtgaggatcctgcccctgccagagcaactctcacgtattctgtgcactacgtgctccacacagacaggctctctgggccacacattagctgctctccacagccaggtctgcatcagtaatgatagtcattgtgttcccctgggcctaagagtgatcacttggcagtggttggagccaggtgtgtgccaggcagaaattttctcctatatccacccccaggaagacctgaagtcctgctgtcctggagcagaatagaggggtctgggacatggacccagactaaaccagccatcctggagggcaggcatcagggtggggctgaaagccccgatcccactctgggaatacagagggactgcactgtggagaacaccagggcagccctctgaaggtctggggtccctccggcccacctggggtatctggttcgactgggttctcttgctcatctgaagcaccctgcgccttggtctctgctacctatctggtactctctgtgtccttgcatcactgtcgaggtttgaaggtccctgtcaagtggcagagggggacctctctgaacacttgtgtccaagtggggctcgcacactgggactggggaggcctggggcccctggactgggccctgcctgtctctggcccaggaccccagggtttttgagaatgaccatcctgcccaggataacagacacaaagagacaagcagacaacaggggtgcgaggcggctccccatcacagacacaggcacagacacagacacaggccccctggggggctggacacaggggcacaaggtgggggcggggtgcggggaggaaggtaggtcaagggagctggagctgtcgaggccctgctccccaaagaagggacagaccaggggacttttctggttccctaaacatatggattgttttgtctcgtgtttaaagtattgcagtctaactgatatggctttacctattggaaacggacagagaagacacatgtctgtctctgaaataaaagcagaacccactaaaatggaaaacctgcagaatgcaaactggggccaatgggaacaagggcttcaggggcaggcaagtcgccccctccctggcccctgcttttgggataggccctggcgggggcccagcatggcttcctggggcgctgcctgggtccattgcagtgggattctgaggacctcaggcaggagccccccaagggtgggaggactctaggccaaggacaaggtctcccgttggaggtggccaactgtgaccagtggtctcagggctgggaagggacatcttacccacgttctttctccccacgcacacatccatgcacacaactgtcttttcagacccccaaacatgcacacagcagccttcaaatgtctctgaattctctcaaacacacgcttctacaacccatcacatacctaacacatacccatcactcccaatacacacactgttttgaaaacacattcttacacaagctaacatatacagcctctaaacacgagatggatagcacacacatatgacacaatttcaacccaaatacaccacctcaatcaagcacacatacacaaggctaacatacacaatctgtaacacatagatatgatgactgcaacacacacaatctcaagacacacacacgctccagccctacacatatgcatatgatctctgaacacacaatccctgttgcagtctctgccacgcattatcatgcatgcatggatacagtttcctccctcatgtgacccctcttccctcaccatccccacacaactgactgagcagaaagctttgataatttgagtgggggacaaatgccagtcccagacgtcccagaggagagtttgtccttggccaatgagatgaatggatggacgccttctgtcaagtgggaattggcttctcaccaaaggcttggggctttggccaggaagcgtcctcctggggaccgtggggccctggaagcgcatggacaggacggggtggggagaggggtggataggaatgggggcagcttggccacaccaatggaggtgttccccatggcatagaccatcgctacccgatggctccaagtgttttctgggggcctggcagccccttgactgagcaagctgggcccagcctggcagtgggggcccaggacctaagtggggtgggggtgaggaacaaggggcgtccctacctggggttcctccacaaatgagctaaagtccacaaaggatccatttgaagggaccagcttggcaggggccatgtctctccaggtgggggctggggaagggggtgcccctgggctgggtgtcaccaaggagatggaagaagaagagccccagcctcccacccagatcccagcctggccagagccagggcctctcagcctgggccttcccgggacaggcttcccctgactcccttcctcagagccaggccactcagtgcccctgccctgacctgggggcccactgagggttagaggccaaaggtcagcatgctgggcagggctggaatgtgtcattactttggctggctggggacagtggtcctcctggcagtggggagcagggaggaatgtatgggggtcaccacactagcacgaccttaggcttcctgaggggcccccctgacccctgctggggaaagactgtcctccctttttcaagctacttgggagtggggtgcaggtggataccctgggatgaagggaggtgtgagggagagctgagggggagaagcccctggccagggaagaggggcagaggccaactgaggttttccccttcagaattgagacttaacctaataaaaagaaaagaaagaaccaaaaagaagtagtaacaggtggagtaggctggggcaggaggcctggttacttcttgaacatgtcctgcagcggcccgggcaggtatttgagcaccgtgtccaggatgctctcctcttcctcctcctcctcgtccccgcagcccgcagggatggccttcttgggccgggtcaggctcccctcgcagggctgctccagggctgctttctcctctgcttccttctcctccttcttcttcagcccatactggggagggggagggcagagacgcgcatgaagcggggtgggcaaggagacagcaggagtctcatgatcatgcagcactggctgaggtggccaggagtgcctcccaagcctcagtcctgtcattagtaaagtggggataagggtgtcttccctgtaggatggtgcctggtcctcagtgggagagaccatacgtggggtttcctttaaaattaacacctgcccatcagaacttcctgctgtgttgaaacccccaaagatctgaacacatggcgtttgcccatatattttgagccaaattttggtgacgaatctgacttgaaccaatggaagactacttctagcctttatttattgcacgcactaacagacatgcactggactgtctggagtagggtggcagccccagacccgctgggagtgacagctgacagcacaaagtgcttaggacactgtggtatttttcgaacattcccaaattcagaactgcactcatttttggtcccaaagatctgcagtacgaaatggtggaccgtagggtccaccctcttggagtacctactacgcgcattctcttatttaatccccaaaaggatcccttgagggaggtgaccttgtgatacccgttttgctgatgagaagagtgaggctcagaactagggcgaaggtgagagctgggatccaggggagccccagcaggggctttagctggaccggttttacccgcttgtggccctccccaggacgggcgggcgggcggagctgaccttatctcggatctgctgccggaccttctcccgctccgcctccatgcgcgcgtgcttggccttacgctcctcctcctgctgccgcagcgcctcctgccgctcctcctcctttttctgcgcgtcggggtccttctcctcctctccccccagcatcttccccatgtcctttgtggcccctacgaggaaggggtgggaaggagagggcggggtcagctaggggtcagggctggggagagaggggccgggtgggccgaggccacctcccacaagggtgggaccggctgaggacacgcggaggggcgctggacctcacctccaagggcctgcttcatgacgaagtccatgccgccggctctggttagcgtgccttagcccacggcagaatttgcatgcagcgctcctggctggcctggcttgggaagatgtgacaacctgcagaagagaattgggagtcagatgggagaggcctctgcacaggcagggcgggggagctagacagacagcagcctcaccctggttcagacaccaggcacccatcgctctgaggtcaagacccaatgccctgctggaggagaaaggagatggaagagagcgatttactgggcagacacgtaggtgctgccaaatagctttttgaaagcggtttggtccctattttaaagccttcatcttgaccctattgttcagatttgattgaagccaggagcattggaaagagcctggaacttggagtcaggcagatctggtttccaacgccaccgtcatttccttatttgccatgggaccttcagcaaggccctaacctgctcgagtccccagtttcctcctctctaagagagaaatggcaatgccacctttccccggctccggcggagattggagggggcccagcctgggccactggatcagcccatcaaaagaccagccggtgttactgccccagccaatcggaggcagctgagcaaatgagaacagccagcttggataaacagatcctgacttttgaaattagacaaatggaaaatacgttatttttattgtaatgtacgtgtaatttttatgttttatagcttaatatcgatttttattttgaatttcacgtgggagtgttggagacattataatcttctgggggcttagggcttttaaactacctagcacgggccttgcaggcactcggcagacattagcaccctactcctcttcctaaatcaccggctttcagtttttattatattttttattatgtttttgcctcagaagggttctccaaataaaatcttaatgggattctcaatatgcaaaatatgtaaaagtggaactcttccagtggaggtggtgggggaggaagagccttcccccttggcctccttaccatcttccccctacatccctgagaagctgaaccctagtgctctaacttgagattttctttgtattttaaccattcagttccactgttctttaacagacacagatctcttttcaagtgtagaggggacatccgtgagctatccaaagtgtgaagtagcttcatggtaagctgaggccaggcctgctccccaaggccttttgtcccacacagccttgcaaggaagaaaaagggttcctgggaaagggtggcagatgttgcaaccttgttgggttcaaggctgg

SEQ ID NO: 10634 - DNA, 13420 bp, Homo sapiens
aaaaattaagtaaattaatataataccacacaaaacctctcatcacaaacaaaagacctactttgcattaaacaatttaatacatgcaagtattgaatttagtcacctaaaggaaacaaaacttctgataagaagcaggaaaattcagagacaatatgaagaccctaaatcaggagactaatttgagtaataataaaactgtggtctcccacaaaaaaaaagatcctaaatcaaacagttctatttaatttcaaatttcaattgcatatatataataaggactcaatttttaataactccttacctatatacatatgccaggtcctgttctaaaatcttcacttgtcccatttaacctccacaacaattttcactttacagatgagtaaattaacttgtccaagtccaggcagaacagggatccaaactcaggctgactccattacactacaatgttttcctaacaactatcctatcaactatccaatcctatcaatgtttccatttctattcccactgattatattaagcatctaggataaagcaaataaggataaaataaaagttaaaaacttggtgacttctggaatgatttaaatattcgacctctaaatatccctccttttcaaatctgagaacactccagctatcagataccaggcaggacatacttatttgggacagagtatcacaaagaagctaccaaaacaaataaaaacaatactatcatataaaccatggtatagcaaacaatgacctgtgggctgggccaaattcagaccttggtcttttttcatacaagctaagaatggtttttacatttgctaaaggactgttaaaaacaaaacaaaggacaatttaccacagcaaagcctaaaaattcactatctgtgtccctttcagaaaaagtttactgacccctgatctaagctactgataaagaggtttccttcccctttttaaaaatagctaagcagtggctcatgcctgtaatcccagcacttcgcgggaggccaaggcaggtggatggatcacttgaggtcgggagttcgagaccagcctgatcaacatggagaaaccccatctctactaaaaatacaaaattagctgggagtggtggcgcatgcctgtaattccagctacttgggaggctgaagcaggagagttgcttgaacccaggaggtggaggttgcagtgagccaagatggtgccgttgcactccagcctgggcaacaagagcgaaactctgtctaaaaaaaaaaaaaaagctaaatgcgccaggtgcagtggctcacgcttataatcccagcactttgagaggccgaggaggccagaccacgcagtgaggagttcgagaccagcctggccaacttggtgaaacccagtctctattaaaaatacaaaaattaggccgagtgtggtagctcacacccataatcccagcactttgggaggtcaaggcaggtggatcaggaagtcaggagttcaagaacagcttggccaagatggtgaaaccctgtctctactaaaaatacaaaaattagctgggcgtggtggcacgtgcctgtagtcccagctactcgggaggctgaggcagagaactgcttgaacccaggaggcggaggttgcagtgagccgaggtcgcaccattgcactccagcctgggtgacagaacaagactccatctcaaaaaaaaaaaaaaaatacaaaaattagctaggcgtggtggcctgcgcctgtaatcccagctactcaagagctgaggcaggagagctgcttgaactcgggaggcagaagttgcagtgagccaagattgtgccactgcactccagcctgggcaacagagcaagactctgtctcggggggggggggaaaaaagctaaatgcaggaactgacttgtaagacaaactatatctaggaggattaaaggcggagtcccttagctctaaaccagaagataaatgtctgaagcatactacccacaccaccccaccccacccccatcccgggacaaaaagggcaaaaataagtggtttcctctcaccaggaggtggcagtaggttctggtttgcccatggactcaagttttttgtagtggttactaagaaaagcaagcagcctgacctctccaaagagctgactttctgtgcctgacaatctgaacaaaaaggaaatggaaaaggaagacaggaactaaccacattctcttcagttacctattcactctcaactagaaaaatgacaccatttctggccgggcgaggtagctcatgcctgtaataccagcactttgggaggccgaggcgggtggatcacaaggtcaggagatcgagaacatcctggctaacacggtgaaaccccgtctctgctaaaaatacaaaaaattagccggacgtggtggcaaggcacctgtagtcccagctactcgggaggctgaggcagaagaatggcgtgaacccgggaggcagagcttgcagtgagcagagatcgtgccactgcactccagcctgggtgacagagcgagactctgtctcaaaaacaaaacaaaaaaaatcagccgtttgtggtggcgcatgcctgtaatgccagctactcgggaggctgaggcaggagaatagcttgaacccaggaggcagaggttgcactgagccgagattgcaccattgcactccagcctgggcaacagatgcaaaactccgtctcaaaaaaagaaaggagaaaagaaaaatgacaccatttcctaaatgcatctaggcaaaaaggtaaaggggtaggggagaaggcaagtaagaatgatcagcttgcattattcagggctgttcttcatatttgcttctacaattcttaagagttattacccttataacccttcagttatttgagcaagacaatgaatttgtctgcacaacttcatgcaagatgacattttaaagatcagaatttgggccgggcgcggtggctcacgcctgtaataccagcacttttgggaggctgtggcgggtggatcacgcctgtaataccagcacttttgggaggctgtggcgggtggatcacctgaggtcaggagtttgagaccagcctgaccaacatggcgaaatcccgtctctaaaaatacaaaaattagccgggcgtggtggcgcatgcctgtaatcccaactacttgggaggctgaggcaagagaatggaatgaacccaggaggcaaaggttgcagtgagccaagatcgagccactgcactccagcctgggccacagaacgagactccatctcaaaaaaaaaaaaaaaaattaaaaaaaaaataagttaaagaaggaaagtagtaaacttacagcatttcccaggagagctaaacccagaagtcaaaacaggaaattacaagtcaaatgaacacatgcagaagtcataggtactgggtgactgtactagccaagttgccctgacaggcactggcaaacatccattaactaacagcgccagacctctcactgtttcttactccaactttctgctatactaccaaaagcttaatttttgcccagaaacccttggacacttaatcaaataacattagtataaaacatgccatgtcatgaagcttgcttcatgatgactcagcagcttctgcaaaacatccagttgacagcctaggataataaacagcaagtgggtagaccctatgtccaccaaagcctcaataaggactaaagaaagtccttatttttaagattaaaaaaaaaaaaaaggagagtattcttttgaatatacctgaatactttccttgggtagtggtagtttctgccaatattaaatagcacctacagtgttgatcaagaaacccctaaatacctttacttcccaattcaaaagctaaaatatgttttcttttttaattaaataggacaagaagcaaaagtattttagataaggggcaatgataaattatcaagatttaaaacaaaactacacagcctgaagtcgtatcaactctaagacaccttggatcataggtgttatgctgttaagacatcatctccccaaaattagatttttattttatctaagtacatttaagctgtgatcaggggccgggcgcggtggctcacgcctgtaatcccagcacttcgggaggccgaagcggggagatcacgaggtcaggagatcgagatcgtcctggctaacatggtgaaaccccgtctctactaaaaatacaaaaaattagctgggcgtggtggcgggcgcctgtagtcccagctactctggaggctgaggcaggagaatggcattaacccgggaggcggagcttgcagtgagccaagatcgcgccactgcactccagcctgggtgacagagcgagactccgtctcaaaaaaaaaaaaaaaagctgtgataacttcagacatctggaaaatattaattcccttctaacctctattcagaccatccaatgacctatatttaaaacaagtcatttttctacatgtcatacaagaaaatctaagcactcaaaggcattcataggagaaaagaaagcatgcatgtgtaacttccattctacagacggattaggttaaatggccaggcttgtgacctgaattctaatcttaaatctgctcgcaaataccccttttcttcacaaatttgaaaactaagcactttatgtacatatctgggggaaaactggtgggagtagtaacagtgccaaacctaaccatcagtagagaacgactgaaaatacctgaaccacaatttttactactcaaacatttccctcaaaataaaaaacatttaagaaaactagaagacaaaaaaaaaaaaattcctcaaatctttactttttttttttttcttcgagacaagagtctcgctctgtcgcccaggctggagtgcaggggcaagatctctgctcacggcaagctccgcctcccgggttcaagccattctcctgcctcagcctcccaagtagctgggactacaggcgcctgccaccacgcccggctaattttttgtatttgttagtagggacggggtttcaccgtctctggatggtctggatctcctgacctcggtgatccacccgcctcggcctcccaaagtgctgggattacaggcgtgagccaacgcgcccgacccaaatctttacttttaaaaatctgttgataatgacacaatttaacaacatcaaccatgtgaaagtgtgtaatctttattagcatccagaataaagtaatctaggaagtctacctttaacagtaggcaacaagttatcagatccttttgctacacttttgtttttcaacaaatttaagacacacacttcccacctcagtatcactgataagtggctttattaaaataagttaacattttcctattcaatacttctaacaatcaatattttaaaaatggaattttctcagaatcaactatctcatttacaattaggataatccttttttataattttaaacatccaggagttcatacagtggctaaactataagaccaccaacattcctggagtgtcaaaagtaactatacttctagaatacgcctcataatattaaaatattttgtgtatgagatcagagctggagtcccggtcaactgtggagaatggccaattccagcctccaaaataaaggcgggggtggcggtgttggggggggggaggggagtcgcgcagcagagaaaagacgtaagggtggagagggactttcaaaatgccccagtgccacggttaactataacctggttaataaaatctaagccaatgctctcaagacgaggagggccacaggcaggggaaaccgagaattaactcataggctgagactaagttattccactttccatgtaacagcgccccccacaactccccgtctgccccagagttaagattccaaggggcagccccccctcctcaaacacactaaagaagggacaccagaaaacagcaagtataagggccatcaaccacatcttttcctttctccctcgagagaacatgagtaataccctcaaattccaaatccccgccaaaaaataaagaaacgcgcgcatcatgggcctacaatttcttttcccgcccagagcctgcctgggaaagcccctgacccagagagttgggggaaaggcggcccaaaccacacgtgtgcgccgcaaggctgggcctgtctcagcccacttcccgtcgccacccccaacggcctgagctcccccggagcctcactcgggcctttcctcagrccctcctgtctgctccacgtggggcgccggggcctcgaaccgcccgtcccctccagccgagtttccccacccgccaggccaccgcggcrtcggggtcccatacctgatgctgttgtcgcycctgctggtaaggcttaattggcccctggtggcaacgccgcgtccggatcttgccgccaccgccccctccgactcctccggctcccgaggccatggcggagcctccgccgcttcccgctccggggcgggtaagggggcgggagaggcagaggcggaggccttagagagcctcccccgccgcccggccccggcccaaaagtccgcccgcgctgtccacacagtgggcacaagcaccccaggaaccgcgaggttgcgagcaggagcggagagagggtgagtgctggcagcggggaagggggtggcggccgcagaggccgaggaggctccggtccggccgcctctgcggacccccgcctctgtgtgtgtcacggtctctatggagatctcccgcagaggacagcacgaacagttccccgcggtgctgaggcctaactcgaccgccgactggtgggagttcttccgtcgccctagccgtagctgccgcagttgaagccgctggcgacgcccgcctacccctcccctgtgcgcacagcgcccgccccgccgccgtcgtcgtcgtcgtccctgcagcctccgccgccgttgcgcctattacccctgctaaggcggctgccgcggtcgcgagccagaatgtcgtcactcatcggcgcccgacgcatttgcatcatcatgctgcgacgagctgataggcaaagaggaagggctggtcgagtccacgctctcggccgcgcggcacgctgggaaacgtagttcaacaacggaacgcggcttctcggaaaggaagagggacggggaaggagatctccggggcgccgcagaggcacaaagccaaggggtacttttgctgttcttggctgtaaattagactttgaaaagacacttaacataaaaacagtaacctcttcccattctccttctccctgtcggttggttaagtaggcaggaagtaagcagacagtaaaatcaaagacaagagctaatgatttaagaaggaggaaaaaaaaatctgtggttgaaaaataaagtccatgatccttagaattagaaaatatatacggcttcattaatgtttctttaaacatataaaggttttgttgcagacacacggggctggaattctggttctgccacccaacctatttgaccttggatgaatcaaaaccgtctgagccttagcttcctcctccataaaatgggagctttaaaatccaccttataaagctgttgtgaggagcagacgtgatcatctatggagagcatgtatatttgctaatagacgaaaaatgcgatgaatgattacaattataacccatgcagtcagctaacattaggggtaagtgatatatccttaacaataaaagtatactatatttgctccaaatatttaggaaactgagtaagtgagctagactcaaagactgaatccacaaaatgtatattctaggagttgacgattagaaaggtcctggtgatcacatagtccaaccctctcattcaaccaaccagacaagatgtccagagaaatttaggtggcacaatcaatgacactgagatgggtaatcaaagccaggactataacccaacttttctgtaagagctaaagacaaatagccaaatgattagggaggaaaaatatgttgtgaaaaatcttagacttactataaatctttttttttctttctttctttctttctttttttctgagagacagagtcttgccctgtcgcccaggctggagtgcagtggcgcgatcttggctcactgcaccctttgcctcccaggttcaagctattctcctgcctcggcttcctaagtagctgggactacaggcgtgcaccaccacgcccagctgatttgtgtatttttagtagagatggggtttcgccatgttggccaggctggccttgaactcctgacctcaagtgatccacccgccttggcctcccaaagtgctgggattacccgtgtgagccgccacgcccagcctatttactataaatctcccacttactagctgtgtagccttggggaagttactgatcctgtttctttcttttttttttttttttgagacgaagttttttcctcttgttttgcccaggctggagtgcaatggcgcaatctcagcaacctccacctcctgggttcaagcgattctcctgcctcagcctcccgagtagctgggattacaggcatgtgccacgacggccggctaattttgtatttttactagagatggggtttctccatgttggtcaggctggtctcgaactctcaatctcaggtgatctgcccacggcctcccaaagtgctgggattacaggcgtgagccaccgcgcccagcccactgatcctgtttctaagcttcgtttttttcatcagcaaatagagcgaatattgacctcacagggtagtggtctggtgaaaggattaatgtatatctagttcatagtaactgcttagatagaaagcatccaatatcaaccatcaatcagatataaataattagttccaagacatttatactatctccacaatcaaactgcacaattcaggttcattgtttaaatcatacaagtgaaattgtaaagccagtcttctagtacctttgaacttgtacctttcagcgcctaaagaaactatgctataccaagcataggtgtacacatcaatggctttcagtggcacctctgaccataaccatcaagatcaagacaagttgccaaatatgataaacaaaattaatctattttccgctgtctcatcctagcttcatgcctcctcccaccactaacttcccactaaattctccaggtatgccccctcttcctcctgaagcacttcatctttcttaaagacagttgtttccctcaggtgctatcttcctcctatgcagaaatcctattcttccacaaatccatagctagatatttgacagccaagtaaagtaattcacgataagctaactcatagggaagatctgtacctgaatctttaattgggttatacgtagaggagattaaaccatagccacatcccatctgccctcttcactctatgagacccagagtttccaccacagaacagaggactgactggaatcaaagctcacccctttcttggaggctattctttgatgtgctggacacccttcacagccaacctttgaaaggaagagagacgcgaaagaattgggccaaatgtagacaatgcttcagaaatagaagattggtagaacttgaggagatatgggaaaatccacattccttttacccatgctctcaactttttacccatttccacaattattttatttcttggaagtaaaatagtatttgagggaactataatgcattaatctcacattcatgtgattgagtcattggaagccgtgccaggcttgagagcagagaaggaataaagagacaggaggaaatctgcattcaacctggacctagttttttcagccaaataaatggcatattgggagacactgcaattcatgaaaagcttgttgctacaatagtcctcctctgccaagaaacttctttattttgttccccatataatatagtagaaagtggccgagcacagtggctcacacctgtaatcccagcactctgggaggccaaggcgggtggatcactggaggtcaggagttcgagaccagcctggccaacatggtgaaacctgtctccacttaaaaaaaaaaaaaaaaaaattagctgggcgtggtggtgctcacctgtagtcccagccactcgggaagctgaggcaggagaatcgcttgaaccatggaggtggaggttgcagtgaactgagatcatgccactgcactccagcctgggccacagagtgagactccatatcaaaaaaattaaaaaattaaaacaacaaatatatatatatatgtatatatatatatgtaaccagctgccaattataaattagcaaataggctgctgacccatctctaatagataaggagtatccactaattaaaagtgaaatacaatttagtctaaacccaacctagattgaaaaagagccatcatacattcttcagaaggtactaatacaattctggccaaaagaatgtttaaagatgacaagtacaagaagttacgaaattttatgtagttattccaccttaccaaaacaaaatgaggtatctgctgtgatgtctattaaaacaaattatcacactcatgcacagcataacaatgtttcaatcaacaatgggcccaatatacaatggtggtcccataaagagctgaaaaattcgtattgcctggtgatactgtctttgtcctaaggtcttattgcaacacattactcacgtgtttgtggtgatgctggtataaacaaacctactgtgttgccatttgtgtaaaagtggagtatgtacaattatgtacagtacagaatacttcataatgataagtggctgtttctggtttatgtatttactataccttttttttttttttaacaggcactccttgccatttcctgttgctaccatactttattattttaaagtgtattcctggtcaggcatgtggctcacacccataatctcagcactttgggaagccaaggcaggaggatcacttgaggccaggagattgaaaccagcctgggcaacataacgagaccccttctctacaaagaaatgaaaaaattagttgagcttagtggtgtgcacctgtagtcccagctactagggaggctgaggcaggaggatcacttgagcccaggagtctaaggctgcagcgagctatgatctcaccactgcagtccagcctaggtaacagagtgagaccccatctctaaagaaaaaaataaagaaaatgaagctattgggtttatttattatttatttatttatttattgcctgtttgcttgtattttagggaaagaagggccacacaacggaaagatatttaaggatgtaaatcattatattctcattaacttactgtgttctctctctattgggaataaagtaatatttaagactaaattaactaatatgagcaaattttgattaactacatatatcacttgattccaacatgccatatatttcctcttcctgactacatgtatcaatgtatactagactttggtatatatgtgtttatgtacattacattatagtttaaggcatattttaaattcaatcttgaatggaaactcagttttattggatgaaataataaccaaatttaggaaggcaatcccatcctaacatttaagacagttaatgaattaactgagattaattcattaaaacacaaatatttattgagatatttatgtgttggtttctagtcttggcatttagtatgtcagtatacaaaactgtaaaacaatctctgtctacatattatgctacactttaccattttattgagttatactaaagtttactattttataatctattaatcattagcacttaacactgataattcaccttaaaaatgctacactcaagccaggcacagtggctcacaccagtaatccagcagtttgggaggccaagatgtgcggatcacccgaggtcaggagtttgagaccagcctggccaacatggcaaaaccccgtctctactaaaaaaattaaaaaattagccgagtgtggtggcacatgcctgtaatcccagctacttgggaggctgagacagaagaatcgcttgaacttgggaggcagaggttgcagtgagccgagatcatgctacggtactgcagcctgggcaactgagccagactctgtctcaaaaaaaaaaaaaaaaacctacacgtaaattctaaacacatgctgttgaatctatctcatacaagaaatcaggggcgggcacggtggctcatgcctgtaatctcagcactttgggaggccaaggcaggcggatcacgaggtcaggagatcaagaccatcctggctaacatggtgaaaccaccgtctctactaaaaatacaaaaaaaaaaaattagccgggcgcggtggtgggcgcctgtaatcccagctactcgggaggctgaggcaggagaatggcatgaacctgggaggcggagctttcagtgagcggagatcatgccactgcactccagcctgggcgacagagcgagactccatctcaaaaaaaaagaaaaaagaaaaaaaagaaatcaattggtttagttttatttattaacataattcatcagttacattacgaaactggacttattaaggttgcagtctgtaaaactataacctttgcaaaccttagtttgctaatactaagcttctttattttttaaaagcatttgtagagaatgctcaagtttatcagaccctaacttattaaggcattccttttcaaaagcatgcaaaccagttaacatgcaaacaaccctcacatacatatcaccccaccaccatcagacaagcatgaactacccagtttaaacaaacagtgacttttggcctcttgctgctactctgaccagcaagcaccagctgcagcccccgggagcttgttagaataaagcagctctgcccatcccaagccaacacaatcagaatctacattttaacaagatcaccaggtgaactgtattacattctaggagcattgtttcaaaaccatgccaccagaagttattaatctgaagttagattaactttgaaggcaagacaatgaggtacctgaagttcccgtaaagagcaggcttaggaacttctgttccttactaatctacaacaatcaacaatttaagaattgatgaaccaacagcttatacaacatgtagattttttttcctcttctttatcattctgtacctttctcctttaccacaaagtgagcagaaatggaatgaaccattttttaattattctttcattaactttttttttccaaaggaaaaaggtaatctagcagaagttattaacatctgaaatgttaagggtctaaaactgagcattagttatgaaatatacttaagcatagatatttcaagaaccccttgctaattcccatgtatccttttcttatacaaattt

SEQ ID NO: 10635 - DNA, 17247 bp, Homo sapiens
ccagctactcgggaggctgagtcaggaaaatcgcttgaacccgggaggcggaggttgcagtgagccgagaccgtgcagcctgggcaataagagcgaaactccatctcaaaaacaaacaaacaaaaaaacaaaacaatgggatagaccaatttctagtacttctaaactatggaatacgatacagctgataaaccaaaacacattagatctatgtgatttctcttaaaggatgttgattataagtttcaacttgtttagaacgagcccatattcatcaaaaattctgtatgcaccgatgtggtggctcatgcctgtaatcccagcagtttgggaagccaaagtggacagatcccctgaagtcaagaggtcgagaccagcctggccaacatggtgaaaccccttcttgtggagtaaaagttaaatattaaatttgaactcaattggacttgaacacaaggaatggttacgtgccagaaatctgtccctgggcacttgctcaggaacggatggacatactgattgttcttgataaatacatcatctgcctcgaggcaataaacaaaaccttgaaaataggctgacctttccgtgttccttgagtccaatgacaaaaggcccttgtgcctaggcctcatgccaaaaagaatactataaaaaggtcaggccaggtgcgatggctcatgcctgtaatcccagcactttgggaggccaaggtgggcggatcacctgaggtcagaggttcgagaccagcctggccaacatggtgaaacccccatcctactaaaaataccaaaaattagctgggcgtagttgctggcgcctgtaatcccagctactcaggagactcagacaggagaatcccttgaacccaggaggcggaggttgcagtgagccgagatcgtgccattgcactccagcctgggcaacaagagtgaaactccgtctcaaaaaaaaaaaaaaaaaaggtcagggtcccagactacgctgaagctccacgagacctctccttctctgtgcatggaccagtggctgactctggagcccaggctgttgcttcccggtctggtgatgaatcctccattgtctggtgagtgtatatatgctgattgtttttttttcctcactgctatttgctcaatgcaccttctattttatacttaaatgaacctaaagtagtttacaatctgcacttatgtgtgagtgctgtgtgtttgcttgtacctgtgcactccccacacagaacatgtctctactaaaaaaaaaaaaattagccagctgtggtgcatgtgcctgtaatccctgctacttgggaggctgaggcacgagaatcacttgaacctgggagagggaggttgcagtgaaccgagatcatgccactgcactccagcctgagtgagagagtgagactctgtctcacaaaacaacaacagcaacaaaaattagccaggcgtggtggcgtgcacctgtactcccagctgcttgggaggctggggcatgggaatcacttgaaccagggaggcagaggtggcagtaagtcgagattgcaccactgcacttcagtctgggcaagagagcgagactctgtctcaaaaaaaaaaaaaaaatctatatgtgggtatatttgacatgtcttgaagaaaactgtggaagggcactcgttaaactgttaacattggttatctctaagatatgaggaagaaggatggagacctcttttagaggattctatacctctagggaatgatcgttagcttgtatacatctttggattcctttacctgataaaaaattagttttgtcattaaaattaacaaaaatattaactttgagccgggcgcagtggctcacgcctgtaatcccagcactttgggaggttgaggtgggcggatcacctgaggttgggagttggagatcagcctgaccaacatggagaaaccccgtctctactaaaaatacaaaataagccaggcatgatggcacaagcctgtaatcccagctactcaggaggctgaggcaggagaattgcttgaatccgggaggcagaggttgcagtaagccaagatcaagccattgcactgcagcctgggcaacagagtgaaactccgtctcaaaaaagaaaaaaaaaaggaaaactataaattatactgaatgttttattttcctattgctgtggtaataaataaccataatgttagtggcttaaaacaacctaaatttaatatctcatagttctataggtgaggagtctcaccagattaaagtcaaggtgtcagtcacattttgtttctttttggaggctctaggggaagatccccaacactagctcatccatgtgttggccgaattcagttctatgatgtgggattgaggtctgtttcctggctgtcagctggaagccaccattagcccctagagttctttccctgcccttgcacataagcccctacatttctttctttcttttttttttttaattatttttttctttgagatggagtctcgctgtgttgcccaggctgaagtgcagtggtgtgatctcagctcactgcaacctccgcctcctggattcaagtgattctcttgcctcagcctcctgagtagctgggattacaggcggacgccacctcgcccggctaatttttgtgtttttagtagagatggggtttcaccaagttgaccaggctggtctcaaatgcctgacctggtgatccgcctgccttggcctcccaaagtgctgggattacaggcgtgagccaccgcgcctggcccgcccctacatttcagaagcagcaacagggcatggaattcttctcatgctttgactctctcctgagattagattgggcctacccagatacttcagaataatctcatctccagatccttaaccttaattacatctgcataattccttttgtcaccttaaggtaacatattcacaggttccaggaaattagggaatggacatgtttgggaggcgattggtttgccaaccataatgaaggacataaacaaaaaaccaacttaaatggcacatttaaaacttgttgtgataccctaccttgtttaaacctgagtgactctctcctagcagacagagccggacagactccattttagtttctttgcttgcagccctctttatccccctaagggagtaactagtgcaagctgactccaagcacatccaggaattcacctgctgataagatattgaggcaagctgtaccagcagctcctgggaatgtgctcggtggaaggtacctaaagcccccgcatttatctcttagtgatagtttaagcccctgtacctggaactgtttattttttgtaactgcttctataaccaattaacttttttaactttttgcctattctgcttctgtaaaactgcttcagttaaacccccctcccctatttagaccttagtataaaagaaaatctagccccttcttcagggccgagagaattttgagcgctagctgtctcccggttgccggctaataaaggactccacaatttgtctccaagtgtggcgtttctctatctcgcttggttacaacattgtcacattcttagatgggaagatttgctattgtaaagatgttatttctgcctacattagcctacaaattcggtgctagatgttctaataactaaagttgaatttttttcattaggtgagtggatagatgctcagagaatatatactgtttagagaaataaaggaaggtgactttgcagactttaactcaggtagaccgcgtatgtttttgagacaaatacaccagcattctgcacgagggcaaagtaatgtttcccactgtttccaaaatcctgttaatatccaggatttgctgggcacagtggctcacgcctgtaatcccagcactttgggaggccgaggcaggcagatcacttgaggtcaggagttcaagaccagcctggccaacatggtgaaaacccatctctactaaaaatacaaaaaaaattagctgggcatgatggtgcacgtctgtaaacccagatgctcgggagactgaggcacaagaattgtgtgaacccagtacgcagaggttgcagtgagcccaagatcacaccactgcattccagcctgggcgccaaagcgagactgtcttaaaaaaaaaaaattaggatttttctggtcaccattttttaggcacacattgactgatactttgaactgtctacggagacttgttccatcctttcctattcataaccaagagctcaaaactgtatcgtaagtatactttagttccccaacacatcatttttatacttgtcaaatgtgaaactcgtgttgttattattattatttgtttccagacggagttttgctcctgttgcccaggttgggttgcagtgttgcaatctcagctcactgcaacctccgcctctcaggttcaagcaattctcctgcctcagcctcccgagtagctgggattacaggcgcccgccaccatgtcaagctaatttttgcatttttagtagagatggggttttgccatgttggccaggctgatctcgaactcctgatcttaggtgatcttcccgcttcggcctcccaaagtgctggaattacaagcgtgagccaccgcgactggcctcgtgttatttttctgtccactcacacagctttatgagaactttcggcaaaggtttctgatggatgggcattgtatcttcactgtcttgagatttagagaagaaactgtttaagaactacttccatcatgatgcatcctcaggagatgtggatgaactgcggagatgtggggtgaagatgaacaagagatgagtgagtttgtgtctccctctaaagaaagtggcttttgtcaaaatgtacttgtaaagaagtgtataggctgggcaaagtggctcacgcctgtaatcccaaaacttcaggaggctgaggcggaagaatcgcttgagcccaggagttggagaccagcctgggcaacacagttagatcccgtgggtaaaaaagtgcaaaaattagcatggtggtgcatgcctgtagttccagctcttcgggagcctgggctgcagtgagccgtgatggccccaccacactccagcctgggcgagtgagaccctgtctcaaaaaaaaaaaaaaaaaaaaggcaattaacccacaattttcaaggcaattgttatgctttattacaagaagtgtttgaaatgcatcccatttgtagatccctagaagtaaaatagtcacctttgtttacactcacaccaaacacagtttttggaagagatatcgcagacttcattattatccccagattaaaggtcagttttgagtctttttattttgtctcgaccttattaccttcctagccaaaacatggaagtaaaacatcttttctacgttaatactgcatttccaggggtcttggggtgttccgggggagggtgaggtcccctctctgtcatggcggggtgtggacgcggtcgccttctcctggcgccgcggtacctaggacaggaggaagaggccaggaagggtccagggaggctcaggccgggtctgcgacttgccggtgggtggcggcaacgaccctgtgggcaccagcccgtcagacggccccagctccgagcccggctgcgagccctctccagcctgcagccgctcctctcccggccctactccccgcccggcactgacgtccagccccgcccgtgcagtgaggccagagcctggtgtagccccacgcggggccgttccatcttcgaagttttctggtgactgggtcggtcccgcaattatctcagatcaggggggaagccaagggcaacgggacaccctgatgtatcaaacacctccccctggagccccatcgcgcatgcgcaccctggaggcaagcgctcgaggcacagggcgcggcttggggagggaggaggcagggcggtggttgggcaagagaagagccgcgcccaccacggaacatctctgcgcatgcgccgggggccagcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggtwagttttctgctgacggggtctctcaggaccaccgcagtggtctctcaggagtgagggacgggaaacgtgccgggccccgcgtttggggaacgcagcgtttcgcttcaaggccgcggcctcagggcgccgagcggggtttctagggctcggttcctgtcgcggcggtcgccgcccgcgccgtggctccgcctcccggaggttccccgactgtggcttccgggtggccaggcgccggcttccgcgactcgacttgttttttctctcttggttttttaggaagtcctgagttgaggcttgcgggatcctttccggagaaagcgcaggctaaagccgcaggtgaagatgtccaactacgtgaacgacatgtggccgggctcgcckcaggagaaggattcgccctckacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgyacccggaggagcacagcagatggagggacagmtccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggatgttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttggggaggcggaggcggaggcgggtgggtcacttgaggccaggcgttccataccagcctggccaacatagctcactatctagtaaaagtacaaaaattagccgggggtggtggtagaaatacactttagtagtgtatcagtattggttcagtggttgtgataattatataaagaatctacagcagaaaaacctggttttcagaaatacatctttgaagagaaagcaaaataatatcactattagctagagaaaattaagtacaacaaaaagacaaaataataggacgctcaggcctttagtcaagaaaacaaaactaattgttgagataatttaagaattttattcttttcagcaagaaatgagctggagaatagaattttcagtgaataaagttacacagttgtccctctgttcactcgggggattggtgccaggatgcatatggaaccctcgcgcacacttggggtttacagtctctcaaacactgtggtactttctatctgcatttagtaagggggagaaaaaacaagtataaagtggaccagcgcagctactagtgttcaagggyaaccttagtttacctattataaaacaagtgacttaatatatttaataccacaaaataacatatttattgtgtaattctgagttctcttgggaaataactaccagattaatgagtattttaaaatctctctcttttttttttagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatgrtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggyactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgraaaacctacccagcaaagaagcatagcttttagctctaatgtaagtatatccaggcattgaacactcaaaaattggatttaggatgtatttttgcatctttgtgtttttatctttgtggtgatagttgggggcctactgacacactttttaaatagaattaaaatcatttgtttttgagccacttttataagtggccattataatgggtttgtaatatatataacattcacgttagttccgatattttgccattcttttaagtgtccccccttttttattgaaatattttaaagggaaatctttagaatactccttaatcacaatgttttaaaataagagtttcaaaaacgaagcctcaaaatcattataccttgtgtatcttgtgtatgtccagtgtctccctgctgccccagtatcttcacttcactttttgaatcaagctacaattaaggttcacactatgtgtttggttgataatccttttttttttgttttgagacagagtcttgctctgttgcccaggctggagtgtagtggtgcaatcttggctcactgcagcttctgcctgcctcctgggttcaagcgattctcctgcctcagcctcccgagtagctgagactactggcgcatgccaccacgcccggctaatttttgtatttttaggagacagggtttcaccatgttggccaggatggtctacatctgacctcgtgatccgcccgtgtcagccttccaaagtgctgggattacaggcgtgagccaccgcgcccagcaattgataatatctctaaggctcatacatgggattatttaatgtacttttttttgtgaaaaaagtgtacaatgtatgtttgggaagctgactgaatttgttcttttacagaattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattcttagtctttattgtatatatataacctaatggatctttatttaatgtagagatataaggtggtgtgtgttgattaaagccctgttaatcccaagtccaaggctgactggccctacctgagattttgagaaatgctgaatctcaagtccctaccctagacctgctgaattagaaactgaattttaacaatattcccaactgaggtcaatacttcaacttgaaaaattgccctaaaaaatttatggaatactgggcttcaaggcaagaaactaagccagaaagaggaggaatagaatgcctcattaagctgtaaaatctgaggtatagttaaaattattatgcttttaaaaaagcattctaagtaaactttttttttgagatggagtgcagtggtgcgatctgggctcactgcaagctccacctcctgggttcacgccattctcctgcctcagcctcccgagtagctgggactacaggcgcctgccaccatgcctggctaatttttttgtatttttagtagagatggggtttcaccgtgttaggatggtctcgatctcctgaccttgtgatccacccgccttggcctcccaaagagctgggattacacgtgtgagccactgcacccggccaaagtattctaaataaactcttaatttgaaatgtattggtgctactgtaactgggaatgatttttttttggagaccgagtctctctctgtcacccaggctggagtgcagtggcacagtctccactcactgcaacttccacctcccgggttcaagcgattctcctgcctcagcctcctgagtagctgggactacaggcatgtgcccccatacccagctagtttttgtatttttagtagagacggggttttgccatcttggcctggctggtctagaactcctgacctcgggtgatccaccctgctcagcctcccgaagtgctgggattacaggtgtgagccactgcacccggctgggaagaatatgaagcacgtttttttttttttttttttttttgagacggagttttgctcttgttgcccaggctgcagtgcaatggcacaatcctggctcatcgcaacctccacctcctgggttcaagcgattatcctgcctcagcctcccaagtagctgggattacaggcttgtatttttagtagagatggggtttgtccatgttggtcaggctggtctggaactcctgacttcaggggattcaccagcctcggcctccgaaagtgctgggattacaggcgtgagccactgcgcctgaccgttaagcacataaaattttaagtgggtattacactttatgaactggagaatcttgacagctggtctaagtaagactgatttttatagacactttattttttagagaaggggtttcttgctccatcacccaggctgtagtgcacagtcacagcttgctgcaaccttgaactccagggctcagggaatcctgccacagcctctaccatacaggcttatgccatcgcacctggctaattttttgggggtaaagatgagtgggatttctgttaccctaggctggtcttcaagcagtcctcctgcttcggcgcccccaaagtgtaggcattacaggcgtgagccactgtgcctggcctaaaataatagtttcaccaaatgttttaactttcttacaaggatatttggtttttgaaggatggcattttacagaatgttattaaagatcagtgtctatctccatggttttgttcccataaatgcacctgggctatgcaatagagcgtggaacaggaaagcacctgtaattgtgaccacttctggggaagaagagggactagggtgaatttcctgtagtcattgtcaccttcctttcactacctacatagcttgcaagaaaaattagcaccctacctctgaagctcccaaggtcaactctaggcttcacattaaacacaaacagaagacaacccaagtgaataatatacagataaacgtggaaatatacacattagaacatttctttacaaactacaaacgcgcacggacctggccaggcggcaggtctgagctggtgtccgagactatgcatccgtttccggcgcagcgcacgggatctgcgcagtctccgttcgcgcttctgggctccgtaaggagaagcgtcttcagacggggtggcttggcttccgaggccctctgctggcgacccagtcccagtgtctgcgtctccctctcccctggcatcgtctcctcctctaggacagacgtagccacaaacgtccctacctcgatacccccagggaagggcctgccacccatcttgtcagccacagtctccgccctcccctggcaacgcttccctccacttccggtaacaattaactggaaccccgggcctcacttttccggacgtaacccggcccttcctgggggacccaggcaatccccacccctggcagtcctgggctgcgtccgactgggctaggcctgtgcgcaggcgcattgggtggagaaacccggacctgtgctggagacgcgaggacgcagtgagctatgatctcagcctctcagcctgggtgacagtgagacctatctcaaaaacaaaactctgaaggcagactatccctctccttcctcagatttccttaaatgcctttctttagggaagccagctcaccactttaaaagtcagtttcctctgttacagctcttcatacatttttacattttcttctttgcagcacttacatacatgtaattacataagtgtggagttgcttgtttaatgtagttaatttggggtttttttgaaccccaaattttgaacggatctcgctctatcgcccaggttggagtgcagtggcgcgatctcagctcacggcaacctctgccgcttgggttcaagtgattctcctgtctcagcctcccgagcagctagaattacaggcgcccgccaccacgcccggctaaattttgtatttttagtagagacggggtttcaccatgttggtcaggctggcctggaattcctgacctcaagtgatccgcccacctaggccttacaaagtgctgggattacaggcataagccactgagcccggcctaatgtagttaatttaaatgagacatttcttaacctctattaaaatagcaaatatttggccaggcactgtggcttactcctgtaatcccagcactttgggaggctgaggtgggaggattacctgagcccaggagttcaagaccagcctgggcaacagagcaagaccccgtcccctacctctgaccctgccagcccctcaaaattgaagtattagccggacatagttgcaggtgcctgtagtcgcagctactcgggaggctgagatgggagtatcctctaggaggcagaggttgcagtgagccaagattgtgccactgccctccagcctagccaacagagcaagaccttgtctcaaaaaaaaaaaaaaaaaaaaaaaaaaaagcaaatatagcagagtaacaggaattttctctatgttatagatgatttgatagagcaatattacaggtatttacattctttaagaatacaaaaatgtcaattataaaccaggcatggtggctcatgcctgtaatcccaactactcagaggaagagtctgaggatggaggatcacttgaggctgggatttcaaaaccagcctaaataacataatgagaccctgtcttttaaaaataaagtcaattataaaattattttcagtaagatcacttatcagaattacaggttttgaaagttatgttactaggcttacatatgctaagtaattaaggagagcttaataaagggactgtttacaaagttgtagactgggtaagaaaaaccaaccagagtgaagcataccagcgctatcaacagggggatccctcactactactaccccaaaagaggcaaaagaagggagcagcaatgggaatccagaaagtatagggttaggccgggcgcggtggctcacgcctgtaatctcaacactttaggagaccgaggcgggtggatcacctgaggtcaggtgtttgagaccagcctgatcaacaaggtgaaactgtctctactaaaaatacaaaaatgagccgggcatgttggcaggtgcctgtagtcccagctactcgggaggctgagacaggagggatagaagatagtcttcagacataagcggtgactacggaaatataccaaatccgtaatccagccagggaataaataccttgacctcatttcttccaaacctctgatcttatgtaggtactgtgcattggcaggacccaagaaggtagagggcaagagagtttactgatgcagttcattcaggctagcactcagggacacagaacatggagaccaatggagagtagttctaacagggcagacagaaaatatgtagcacaaattctttttcaacaggacatggcaacaatttaaaaaattggagtcttataagaagtctgttcaaattatatttatacatatttattaacaaagaacagaacaagtgatgtgtctaattgaatttttctagatgctggaagatcttccattctatgtgctagtcttacaatgtaacattggcactccttctatctagaagtagagtctgtatccctaatccttgaatctgtgactatggagggagtgacactgtgaattctgagactaagtcataaaaagtgaaacagattccacctagttctcttgggatacttgttcttaaaacccagcccccatgctttgaggaagtccaggccaatggagaggccaggtgtgggcgttcaggcctacagccaacatcaaccacaagacttctgagtgaggaaacctttacaatgattccagccccagcccctaatctgactgcaactgcatgagagaccctgtgtgagaaccacaccaattctcagacctatgagagataataataaaataatatttgtgctaaggtaccaagttttgggatgatttgttatgccacaatagagaaatgatacagttcataacagttttttttttgtttgtttgttttattttgagccggactcttgctgtgtcgcccaggctggagtgcagtggcgccatctgagctcactgcaacctccgccttctggattcaagtgattctcctgcctcaccctcccgagtagctgggactacaggcgcacgcagtcacgcctggctaattttttgtatttttagtagagacggggtttcactgtgttgaccaggctggtgtgaaactcctgagctcaggcaaatcacccacctcggcctcccaaagtgctgggattacaggcgtgagccactgtagccagcccagtttttaaaaatcacacaaattatcatattgcacagaaaagcaatgttgaaaatcctgtgaatactcttaataaatccttacaaaatcagttgagcaatttttaccacacatctttcctttctatactgcttatcacttccagaaactttagttaattacaaacatttccatttttttaagtccagacttgcagattttaatttgcaatataaacaaattggtaatatagagcccaattttactggcaggaataggatttttttttttttttttcaagacagggtctcgctctgtcacccaggctgaagtgcagtggtgtgatcagggctcactgcagccttgacctcccaggctcaagcaatcctctcacctcagcctctcgagtagctgggactacgggggcaggctaccatgcgtagagatgaggtctcgctatgttgccagggctggtcttggactcctgcgctcaaaggattctcctgccttggcctcccaaagtgctgggattacaggcttgagccaccgtgccagccaggattcttaataacagtaaaataagaaggatgtaagcactactcttccccaataactgaaatccaagaggcacaaaaccacatgtaattgtgtggtttttttttttttttttttgagacggaatc

SEQ ID NO: 10636 - DNA, 13450 bp, Homo sapiens
tcagattgaaaagtacatcatgactcatctctataaatatgtgttctgtccagaaactactgatgatgagatgaaagatcttgccattcaaaagaggatcaggtagttgcttattttgttttgctttatgcttactacctactgatggaagaacatattgggggaaaataaggcatctgagtttcaaaccttaagagaaagcaacagctcatgtttctgcttccttagagtggaagctgctctgtggtgtcagaaagacaaggaatgtggtgacctcacctatccatctccctcaaggcagcttttggtaagtcgtgtttggtgtttgagattgttttcaatctctgaactctccaaggaacagggggactgtgttcttggtccattaccatttcctcaagcaggaagctgtgaatatccgtatcaaggcaggggatgtcggctgggcccggtggctcatacctgtaatcccagcactttgggaggctgaggtgggtggatcacttgaggccaggagttcaagagtagcccgggcaacatggtaaaaccccgtctctactaaaaatacaaaaattagccaggcatggtggcacacgcctgtgcttctagctatttgggaggctaaggcacgagaatggcttgaatccagaaggcggaggttgcagtgaagcgagatcgtgccaccacactccagcctgggcaacagagcaagactccttctcaaaaaaataacaagtcagtggatgtcctctttcctcattcctcccagtggtgtgcatttttcaccattccccagtcacatctttcactagcattggattgatgacatttcccacagcacccagtcttccaggctcactggggtgaaccccagcactgtgtactccagttgcggtggacactgaggaagagaccacccaagtgtgggaacagggccaaggctgagctgatgagttgttctaagaggagaggggactcggagtcccaggttccagacaaggggctggtacttgctagatctgtattggaagtttcacagctgaagtgaggagttgatactgggcaggctgaagttgtggagcccaaggtcaggagccagaagtaaccagaggggccctggaccaagatgcagaaggaaagcagtaaccaagcaagaggggaggcctgcagcagggtagttggagtgcagttagggtgggaccaggaaacacacagtgattcaggtatggtgatcctgcctgtggcgtcctacgcgagctccagtgtgccttagaaattgagggctgaggccaggtgtggtggctcacacctgtaatcccagcactttgggaggccaaggcaggtaggtcacctgaggtcaggagttcaagaccagcctggccaacagggtgaaaccccgtctctagtaaaaatacaaaaattagctgagcttgattgtggacgcctgtagtcctggctactcgggaagctcaggcaggagaattgcttcagcctgtgaggcagaggctgcagtgagccaagatcatgccactgcactccatcctgggcaacagagtgagactccatcccccacaaaaaaagtagttgaggactgagtgtaaaaggacattaacacagtagacagtgaggacaggcagcagccaattctcaaatcgtcactttcaaataccgagtgcatttcagtcttggtagcactgtgtaacgtcacttcagtcagcaaatggccttccattcttgtgataagtacagaagagaagtctcattttaggatcctagctgctttgtcatgtcatttgacctagtacttcgaaaggtgatgtgtgtgggcctgggattgtctgagtggtcagtgatgcctcaggctttccctaaactgaaggaggtgacaagacgaatggtcacggtttgtccttggagctcttgtttactgtctctctccctttagagcccttcactgggttacacctcagatgctgtgtgtccctgttaatgaagacatcccagaagtgtctgatacggtgttgaaggcaatcacaggtcagtgaaaccaagagcctttttattgggatgttttccccttaaagttaacattttactgtaatattagtgtataactttgtaaaatgcagattattgaaggtacattggaatgtagtaaaagtgatttgtaagattgttagttttatgaatttgatggcattcagaagagcaggttaactcttttccccctttattttcagggattatggtctcgtttcttgggcattgaactaaactaaggtcaaatacagatagaataattttttttgttctttttttatgtagttttttaaattcagctgactgttcccatgatagaacaaatttcttaagattcagttgcatttatatattcaaaataattttggagagaggaagggaactggtaaggcaaggtaatcctcacgctggagtaacgtagtaaaatgatgcctctgactggttgttagagaagcgctgtgagttatttttctggtttaatcaggaaataaatgaagttccccaggttgatgtggtgctgccgttctagacaggtccagcctcctaataaggtttgtttctcattcatgggaatgacccaggaagagtgcagcacaaacgtttcaattaaaaagaaaatcttaacggagagatggtcatctttggccagtgtctcctttattagaaagaggccttggaaaggcttgttcatgtagacattgttaatgaaattctactggaaaggaagtgggttaactgataatagtagtgttggaggctggccatcgagtaggcttcttttgttacaggaaccagagactcacccaagctacagaagaaatggagatttgcttaaggtattatcaggtttataaagaatctggtggagtctttcaggacctcagccccaacggtcctctagggagtgggctatcttactgcctctacgcagaagagggtctgctccaggcattctctgctgatgtgattcttccacttttcgggttctgcttctctttgtgtatcttcccatgtcaactcctgttgttaagtaaattactggtttctgtaatttcctgtgcacgttctgggggtagaatccaagtggcctaggtcaatactatgtgttttttttcttgcaagcttttctgctattctatggcataggtcatgactactctgccccccgcaccttttgctcggggaacctcataagaggttgaaggtgaaaaaaaaaaaaaagaggttgaagctggaggccttctaaaagcctgaatatggacctgggacttttgtttttcctgactcttactagaaagttcaagatcagctgctttacatttagagtgttccatgggagttttgtccaagccaacgtagcctttacgacctattgctaataaggaagtccccggccttcctggcctctttcacccaggtagggcatggttcattggggcgtcagctggtagcgagtgtttctgtgacccatcagtggtgaaagtaggggtgggttgcccaagggatcagggaagtgtagctgtgttccagaaatattgagacttgataggagaggctgcctgtcaagttacgcagtgtgggtcacattcttctagggctgagaactcatgttctgggctgacaagtaatacgaggtctgttgaagagaactgcataaaattttgagagtcatcaagtgctctgccctgaggtcgaacactcttcaggacttctgaaaggaagtgtgtgtcaccccaggaaggggaccagagagtccatcatcagctcctcttagctccaagagtttaggacaaagagagtgtcagggcctgtggctgatggtggaaatttccctttctctctgttttgtttttttaatttttaatttttatgtgtacataataggtgtatatatttatgagttccatgagctattgtgatcaaggcaggtaatgagtcgtaatcaccttaggggaaatggggttcatcctctgaagcatttagcttttatgttacagacaacccagttatattctcttaattactcttaaatgtacaattaaattacttttgactacagttccccttccgtgctagcaatactaggtcttattcattctttctaacttttctggtaccccttggccatccccactatcccccttgccccccactacctttcctatcctctgctaaccatccttctggtaaaacatccttcagttgttttaattttttagctctcacaaatgagtgagaacatgtgatggttgtctttctgtgcctggcttatttcacttaacataatatcctcctgtttcatccatgttgttgcaaatgactggatcccgttctttggtatggctgaatagtactccactgtgtatgtgtgccacgttttctttatccattcatctgttgacagacaccctttcccatttggctccgcttgcatgacttctgtgtggctatgggggcagtggttctcagccaggcactagtggtcctgggttcatttgacaacatccggagacatttttatttatttatttttgagacaggatctctctgtcacccaggctggagtgcagtggcacaatcatggctcactgcagccttgacctcacaggcttaagcgatctttccgcctcagcctcccaagtagctgggaccacaggccaccacgcccagctaattgttgtttacattctgtagaaacagagtttcatcatgttgccttgactgttctcaacctcctagactcaattggtcttcccacctttaccttccaaagtactaggattacaggtgtgagccacgaagccgggcctggagacattttaaaatgtcacagctgtggggtgctactaacatctagtgggtagaggccaagtatgctactaaacattctacaggcacaagatggttccctacaacaaagaattattcagccccaaatgtcaggagtgtccatgttgagaagccatgacctggaggaggtatagcctttgttttcacaccaccattaaagataagcctggacacctggatccagcagagatggagtgcacactcagctctatacttcctattcatgagaaggcagagccctgggagaagacatagagcaattatgcagggctctgaaaagtaaatcatagcaggcaggctggggagggaaattattagacagcagtgagtttcctgtatgttgctttcttctcacatatctcctagttgagactttgaagcagtgcaaatcatggaatcacacaccaggatgggaatccaaagagttccacgaagaattccttcaggccagaggatgctaggaaggggtctctgcaggatgaagcatgtggaagagatcccttggggtgtttgtcttcctttattctccttttccttcccttctctccctttttccaccccagccatgccttatggcaatagcagccacacatccagataaaacataattcactttttactcgctttcaaaatgtcagcaataaagatgaacaggatgccagatgaaagaacattgaaaaataaagattaacaagaaagtggtttaaactttaaaagaataaaaatcaccaataaaaggcagaagtctaaagataaatgaaggtattaaaaatggctttaaaaatcttacccaatcttgggccaagcgctgtggcttacacctgtaatcccagcactttgggaggccgaggtgtgtggatcacgaggtcagcagtttgagaccagcctgaccaacatggtgaaaccccgtctctactaaaatacaaaaaaattagctgggcatggtggcgggcacctgtaatcccagcgacttgagaagctgaggcaggagaatcgcttcaaactggaaggcagaggttgcagtgagccaagattgcaccactgcactctagcctgggcaataagagcaaaactttgtctcaaaaaaaaaaaaaagaaaaaaaaagtcggtagtggcttcgtcctccacttttctcttcctccgctgatgcctcccagctctcgtcagcctcctgctggccatctccttaacaccaaacactatgccttcaattcagttgcagagttttgatggagagatatttgcagttgatgtggaaattgccaaacaatctgtgactatcaagaccacgttggaagatttgggaatggatgatgaaggagatgacccagttcctctaccaaatgtgaatgcagcagtattaaaaaaggtcattcagtggtgcacccaccacaaggatgaccctcctccccctgaagatgatgagaacaaagaaaagcaaacagacgatatccctgtttgggaccaagaattcctgaaagttgctcaaggaacactttttgaactcattckggctgcaaactacttagacatcaaaggtttgcttgatgttacatgcaagactgttgccartatgatcaaggggaaaactcctgaggagattcgcaagacrttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaaagcagtggcaagtcaattgtattagcagaatattgtcctcattgcatgtgcagtttgagtacagattccaaacctatggctgagtttcttctagtatgatcaaaagtttcttttttttttttttgctctgaataaaactgaactgtgggttctctataagtggcattttgggttttccttcttttttgtaaagtaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagttaactaggatgtcttccagcctcctgcagtcaaggagtaccactgtaatgattagtctgtatgtagcagggctcccttcattgcatttgaggacttgttttctttttctttaattttatttttaatcctcttagttttaaatatattgcctagagactcggttactacccagtttgtggttttttgggagaaatataactggacagtttgttagcttttcaattaaaaagacacttaacccatgtgggatgtcatgtttttataatcattkttcccatgtggagaaaattattcacactacttgcatgtaaaaaataatttaactttttacattaaaatatgtggtaaaacccagaaagcatccatcatgaatgcaagatactttcaataaaaagtaagttataaaaaaaaagtcttacccagtcttacccaattcttatttataagttccatataagtagaaaagaaaaataaatagatcaagacatagtaacagtaattataacctagaattaaaagattaaaggaaccaaacaataaaataagcaaaagttatgtaattcacacagtagcctcataagggaataaaagcactcaaaagttaagataaggcctgtgcactgcccaatgtatctgtcccccacacgttgtctttcatggcagatgggccaaggagggttccccaggaagctgacctcagggatgatctaagagctgaaagaaccctttggtataccccactgcctggccagagtctgaaagttttattcctgctagtggcaagaatttggtgtaaaattaagctgccttggctcttttatgatgttccaagttaccggcagatgtgcacccatagaggcacgctgcctctccagcagtgctgtcaccacgtgcttcagcaccctttgctgtccgccacgcttgttggaaaaggttgggcattcatgagagcccactgcttggacttagtggtagtcgtgggtagtgaaatttttctctgggagaattaaaatgttattttgagattaaatttattaccttacttgatcccctctgccaattagcaggtgtgaatgtcgtgatttctgtagctagtgaaaatccacatgctgtagagttggccactgtaggcctaagtgtgttggattctagtagctgaattttttttttttttttttaacaggattttgctctcttgcccaggctggagtgctgtggtgtgatcatagctcactgcagcctcaatccctcgggcttaagccatccttctgcctcactgttttgagtagttgggactacaggcacatagaagcacgcttggctaatttttgtattctcacatccagtacaaagatgctttgtgtagcatttttgtatagcattttctgagatatttttttaaaaaggtcagttcagaggatgtgaagtgattttcaagcattgttttgttacagtggttattgattctaggcaagacagtatttaattatctgtaagttaataaggctgaatacttcccccccccccctttttttttttctttttttgctacggggcctcactctgtcacccaggctggagtgcagtggtacaatcgtagctcaccgcagccttgaccacccaggctcaagcaatcctctcacctcagcctgctgtgtagttggtaccacaggcatgcaccatcacactgggctaatttttttttttttttttttgagatatcgtgtctcactatgttgcccaggctcgtctcatactcctgggctcaagcagtcctccaacctcgacctctctaagagctggaattgcaggcacgagccaccactcctgacctgaattcttcctttttcttcctactaaactctgcttatttgctttcgactaaatgtactgtgaagctaatcaatttggagtggtgcagcttatggacttggttttctgtgctaagaccctgcgaagtaaggggtggggggacgggaagccaggatgtttagggagcatttctgataaattgcctaaaagatctcaaaacaggtacaaaaattagcttagcattgtagcaggtgcctgtaatcctagctcctcaggaggctgaggcaggagaattccttgaaatgggaggttgggttgcagtgagccaagattgcaccatatcaactgcataccaacttcccacaaaaactgactttttggggactctcacatatctttaaagtaggtcattgaattgatttttttggaggtttctcatattggttgaattattctggtacggactcttgccttatgtagaggtttctatttctcttaagtcagtgtcaatacaatggctggagtttctgtttttgcaacaagaaggtgttggtattttatgtagggtaaatgtgattagaataaacctttggaacagaagtctttattaataaagttttgcaatccacccctgttccaaaaattgatttgattctttcttaggaaaatatacattattattaatactctcatgctacaaaggttttctggttaagctgcagccatcatcattcctaaaaatgaaacattggagacatttgtcaagatactcagtcttcaaacagaaataaaagtagataaaaaaggagttaacataatcagtatagagctattattgtctggtggtgaggacatgaactctggagctggaagtcttggatttggttttgaattttattctgctacttattagctcattggccctgaacaaatctcatgtttcagagccctcagttgtgaaatggagttaataatattactgcttcatggggttgttgtctgaacttagaacaaataatagctattatttgtaaatggttattttatgtagataacccaagagaagtctgggtgttgtggctcacacctgtaatcgcttttggaggcaaggcagcaggactgcttgaggccaggagttcgagagcaacatcagaaacatagcgagacccccatctctacaaaaaataaaacactagccgggcatggtagtgtgtacctgtaatttcagctgctggggaggcttgaggggaagaccacctaagcccaggaatttgagcttgcagtgagctgtgatctcaccactgcatgctggcctgagtgagactctttcacagaaaaaaaaaaaaaaaaaaaaggaaaaaagaaaacccaaaagaatttatattgaaactatagaatttcatctccatcttagagatgaaattctaaaataaccataaaaactaactgtacaaaatgactttcctatatattattactaactacttagcaaatattatggagaaacaattaatttacaatagaaacaaatataaatcacctatagagaacaagagctttcaggatcgttatgaaaaacagaaaattgagtgagaagcacaaagatgtgactgcacagtgccctgtgcttggactttagggctctgtagctgccatcgtgaaattcttttttttctttttctttatgagataaggtcttgctctgtcacccaggctggagtgcagtgttgcaaacattactcattgcagcctggaccttctgggctcaagctagcctcccttctcagccacctgagtagctgagactacacatgtgtgccactgcacccagctaattttaaaattttttatagagacagcctctcacttttttttttttttttttttaagttggagtcttgttctgtcgcccaggctggagtgcagtggcacgatctcagttcactgcaacctccacctcttgggttcaagcgattttcctgcatcagcctcccaagtagctgggactacaggtgcgtgccaccatacctggctaagtttttatatttttagtagagacgggctttcactgtgttagccaggatgatctcgatctcctgacctcatgatccacccgcctcagcctcccaaagtgttgggattacaggtatgagccaccacgcccagctgtcctggcttgttttaaactcttgggctcaagcagtcctcccaccttggcttcctaatgcgctgggattacaggcatgagcctctgtgccccaccccaccgaaaaaagaaatttgtacttagtttttccccccaggatcctctgtgtgttaaaaaaggttgaatggggaacctgaaactcctccccctgctcttggaagtgtagggcacttctctttctccacagtgtcagtagaggttgggtggagactgaacttccagccctgccaggtgagcatgaattgtttgttcctgtcctctccaccatctctgtggtattggtgggggctgagaggggagcctggatttctgcctccacccatggtaatgaggtcgcaactcccttttcccaccagtgtgatgttggctaaagaatatttaaatcagattgagagcctcctaatataacaccccagactttcaagacacaataaaaaaatcactcaccatctgtgcgcagtggctcctgcctgtaatcccagcaccttgggaggccaaggcaggcagatcacctgagatcaggagtttgagaccagcctggccgacatggcaaaacccggtctctactaaaaatacaaaaattagccgggcgtggtggtgggcacctgtaatcccagctacttgggaggctgaggcaggagaattgcttgaaccccagcggcgaaggttgcagtgagccaagattgcgccctgcactccagactgtgagacagagctagactctgtctcaaaaaaaaaaaaaaaaaagaaaaagaaaaaagaaaaaaaaatggccgggtgcagtggctcaagcctgtaatcctagcatgttcggaggccgatgggggcagatcacctgaggtcgggagtttgagaccagcctggccagcatggcgaaaccctgtctctactaaaagtacaaaagttagctaggcacgatgatgggagcctgtaaaatcccagctactcaggaggctgatgcaggacaataggttgaacccaggaggtggaggttgcagtgagccaagatcgcaccactgcactccagactgcatgacaagagcgagattctgtgtcaagaaaaaaaatcatatctgaaccaaatgacacatatgttggaattacctgacaaagattttaaagaaaacatcataaaaattcaccaatgagtaaagagaaacatgcttcaaacaaatgaaaaarccccagcaaaaccactggagacatgaaccaaatggaaattttagaatcgcaactgataataactggaagttcttaaatttcgtattagagggccgggcatggtggctcacacctgtaatctcagcactttgggaggctgaggcgggtggatcacctgagctcaggagttcgaggccagcctggccaatgtggtgaaaccctgtctctactaaaaatacaaaaattagctgggcacggtggtgcatgcctgtaatcccagctactcgggaggctgaggcacaagaatgactacttgaactgggaagcagaggttgcaatgagccaaaatggtgccactgcactccagcttaggcgacaaagagagactccatctcaaaaaaaaaaaaaaaaaaattcatattagaattgcagtgactgaagaatggatctattaactgggatatagatcaatagaaattcccaatgtgaacaacagagagaaaattgaacctttaaagtgtaggcttagggacaggtgggacggtaaaaaaaaaaaaaaaaaaaaaatctatcattcttgtcactggagtcctagaaggagaggagaaaaatgcatatggctaaaaaattaaatagcagctgaagatctcccccaaattttcaaaggcagaaagctgtagatttaagaaggagaatgaaccacaaacaggataaattaaataaattatgcaaggatatgtcacaaacctctcagaattaaagacaaaaaaaaccttgaaagtagttaaacagcaaatgacagattacctatagtggaacgattgattgatggatggatggattttttgagacaagacctctctgtcacccaggctggagtgcaatggcaaaatcatggctcaaggcagcctcagctcccagactcatgcttcagtgaggtgtgactctgccactgtactccagcctgcatgacagagttagagtttgtctcaaatttatttatttatttatttttggctaggcgcagtggctcatgcttgtaatccagcactttgggaggctgaggcaggcggatcatgaggtcaagagatcgagaccatcctggccaacatagtgaaaccctgtctctactaaaaatgcaaaaattagctgggcttggtggcatgtgcctgtagtcccagctactcaagaggctgaggcaggaggatcgcttgaacctgggaggc

SEQ ID NO: 10637 - DNA, 162329 bp, Homo sapiens
  misc_feature (1)...(162329): n = A,T,C or G, or insertion/deletion polymorphism (see Tables 1-2)
caagtgatcctcttacctcagcttcccaggtagctgagactacacgtacgcatcaccaaacccagctgatttttttatttttagtagagacgaggccttgccatgttgcccaggctggtcttgaactcctgggctcaagcaatcctcctgcctcagcttcccaaagtgctgggattacaggcataagccactgcacctggcaaatgttttgttttgttttttaaggtaagcaattatttcatttccttggtgaaggggtggcctgcccctccacacctgtgggtatttctagtcgggtgggacaagagactgagaaaacaaataagacacagagacaaagtatagagaaacaacagtgggcccaggggaccggcactcaacacaccaaggacctgcactggcaccggcctctgagttccctcagtttttattgattattattttcattatttcagcaaaaaggaatgtagtaggagagcagggtgataataaggagaaggtcagcaaaaaacatgtgagcaaaggaatctatgtcataattaagttcaagggaatgtactatgactggacgtgcacgtaagccagatttatgtttctctccacccaaacatctcagcggagtaaagaataacaaggcagcattactgcaaacatatctcgcctcccaccatagggcggtttttctcctatctcagaattgaacaaatgtacaatcgggttttataccgagacattcagttcccaggggcagacaggagacagtggccttcctctatctcaactgcaagaggctttcctcttttactaatccacctcagcacagaccctttacgggtgtcgggctgggggacagtcaggtctttctcatcccacgaggccatatttcagactatcacatggggagaaaacttggacaataccccgctttcaagggcagaggtccctgcagctttccacagtacattgtgcccatggcttattgagactagagaatggcgatgactttcaccaagtatactgcttgtaaacattttgttaacaaggcacgtcctgcacagccctggatcacttaaaccttgattttatacaacacatgtttttgtgagctccaagttgggtcamagtggttgggtcaaagtggctggggcaaagctacaaattaacaacatctcagcaaagcaattgtttaaagtacaggtctttttcaaaatggagtctcttatgtctttcctttctacatagacacagtaacagtctgatctctcttttcccttcacttggcctgacagcattsacttcattacacaagaacttgcagctgacagaactgacacacagatttcccccaagaggaagaacccttttcatttgcagagatgaattgaaatgtcatgtctgagtgcaattcctgctccccactcccaccccacaaaatcctataagtgataataaatcaataaaatccccatgatttactaaaagtcatccctgcaaacctttctaactagcagctgcagtggataaccaagaagggaagcagctggccatcacatagcattcctgtgagtgtgagamtgaagggacagcagcatgggagcgagaatcctgaatgagtgagaggtatagataatctacctcacttcatacctgccccttccctacataagacatctctgtcctgatacatggaaaatactagaggagatggtagaagtggttttagtctgcaattggaaatgcctgaagcttattaaattccaaggtaggggtgagatgaggagcaccagagagaaagagcaggttagacagagatgctcaactcactctgtcaattccagtttaatgctatttaacaacaaaattatcttcttaatcataaccaccctcatgcctaacccctattttccaaagataagagatccctgtctaaatttctgggttggtgtctactgccgcccctggggtggtactgtgatgtttgtgagtgagattgcaactgggatgggagaaaagaagtgtgggatacggaagatcgggggccacgatgcatcaattacagtgggtctcttttcgtccccaggtatggcccactaccacaagtcccctttccctacctgtcttgtgcaactgtcaaaaacagaatctctgcccaaagagaagggagcacagggagttgctgctggactgccatcatctctgaccccaacttgtccacctcctgaccgacctttctatgaaactgcacaaaaattaaatctcaggaatgccataaaattacatcatccccattcctctatcaaagccaatccaacagctctgtcctgacatgctttctccctgggccaaggaagcaacaaaaaatatcagttgagcatgtgaaaatgcgttgacggtgtgtgcggtgtaaagtttctatatgtcttcaccttctgtctcctcycggtgggagccgccctctctttccccaagtcacacacacacccctcccctacccctaagtccaggtgcttccatctgctgggcttccaaccactcatttcccatagacactctcattactgtaggccacatacagaaaatcatcttcctcatgactgtcctcatatagttggcccatggtagcactagtgggagggatagtgttgttgacaaagaagaataaggcgtcctcaggtctcaggtggattctcttccggattaaaasgtagaactggccatcggtaaggtcggagggcactaggtacttcctcntgtccagawcaggcacccttgcttttggagccttctctacaatcaaggggaccctgtccggatatttcttccggatcttttctccttcctttttccgatactcaaagggatggacctcyttgtactggaacttcatggtgaatcacagggcttccgtgatccccgcgcagggcctgcctccttcgccgctgaccgctggccacgtcccgctccctccgccgacgtgtgcttagaatagctgcagaaatgtccgcttccgggtcaacagcactggtccaagtgtgcgggagggcagaaggtggggtgggagggggacctcgggtgcgcctgcctggaggtagaggagagccaggtggagaaataccggcggcttttccaaacagctgggagcacaaaaaccaaatatttggttttttaaaccaataaattttggggtaatttgttacacagcaatagataatgatagactctctctttaaaaaaatcagttctggcagggtgcgatggctcacgcctgtagttccagcactatgggaggccaaggcgggtggatcacctgaggtcaggagttcgagaccagcctggccaacatggtgacacccccgtctctactaaagatacaaaaaattagccgggcgtggtggtgcacgcctgtaatcctagctacttgggaggctgaggcaggagaatcgcttgaagccaggaggcagaggttgcagtgagctgtgatggtgccattgcactccagcctgggcgacagggcaagactctgtctcaaaataaataaataaataaataaataaatwaattcagttatagcaagtgctgaagtctttctgtcttttcatgctccttgaagtcctttcacagtttttcctggctcttctacgcctcctctcggccacgccctttagcacccaacccctcaacaggtaatgatcctctcttcacgtggccattgcgggtacatgattggtttcctgtactgactgctcttctcgtgagaccaagcttcctttcccctactccccacacacctgatcattgtgaacaaaccgccgagagaacaaggtaaggcagaaggaacagaagctgcagagagcggcaggggatagccaccagccagattctgtgactcttcattcatctccccactccagtcccagattgaagaataatcttcatgatctccttaatggcaaaatgctagaaagacttaccgaggggtctgaagatgccttcggttctccaggtcctgaactctgttccagttacaggaggactggcaatccctaggtttcctgggtgttactttgttactgacctcctctgagatttccattttcctcaatttcgtctaactaaatctaactacgtctaactacctctgctaaccagacatttgttcatagtcgacagagtttccgaaaatgcaatgtagttaccttgcagatgactataattgtgtagcaaaataactaagatgccactggctatatggaaaaaaaaattacttaggattttgataccttttatggtttatttccccttttggcctgtgaacttcatgaaggtaatggttatgtatgattcccgagtaatcacrgttcccagaacgatcttttttttttttctttctttttttcttttttgagacggagtcttgctctgtcgctcaggatggagtccagtggcgcgatctcggctcactgcaagctccacctcccgggttcacatcattctcctgcctcagcctcccgagtagctgggactacaggcgcccgccaccacgcccggctaattttttctatatttagtagagacggggtttcaccatgttagccaggatggtctcgatctcctgacctcgtgatcctcccgcctcggcctcccaaagtgctgggattacaggcgtgagccaccacgccctgcccccagaacgatcttgagaacagaatgttcccaataaatatccactggaaaatgcaccttatttttgttgaaggaatggtggaattagcatcaaagggatcttcaacattaactcgggccgggcacggtggctcacgcctgtaatcccagcactttaggaagccgaggcgggcggatcacgaggtcaggagatggagatcatcctggctaacatggtgaaaccccgtctctactaaaaatacaaaaaattagccgggtgtggtggcgggcgcctgtagtcccagctactcgggaggctaaggcaggagaatggtgtgaacctgggaggcagaactcgcagtgagccgagatcgtgccactgcactctagcctgggcgacagagcgagactccgtctaaaaaaaaaaaaaaaaaaaaactctatggctggtaattctaagcgttttataatacatcacaaaatgttcttttatttttctaaattgcactgaatcaacaaacggagtagacaggcacattttcttcactttaaggaaagactttgttgttttttagctaggggccgacccaaagtgatcactggctctcacatgagacccaggagcctccccagtttgaagcccgatatcacatttcccagaatacttgatgccctcgcrcgcctcctctggctatcaaccagacggaaaggggatgtgcctgggagtttgatgccaagggaaggatgcggaatgtctgttttctactaagggcttctgctgggcctttccaatgtccagtttgagttggtctgggacctggcctccgcaaacaccctgcaggctccggccgccggggatgaggtggaagactgggcagaagagaggccgcaaaggcccgagggctgagctgctctgcgctggggaggggcgaagtgccagagcgcgggagacctcatggtgggcaccaggctgctccgcggtaggtgggtgaggccaggagattcacatctgcagatgccacagtgaggatacagcatttagatccctcggctccaaacaggcggttccgggggaccggtagctggggaattgggtttagcactttccaacgcttggaactggacatccacggctccgagtcctttgaggtcttsctcgggactacgtttcccagaaggctaggcgataattgacagctctatcagcctatggacagagaaaaattctagccatggaaactgaaaagccaatagcaagaggatgggggcggtactttccggccgctggctgtcgaagccggagtcccacctgtgtccccacagccctgtcacgaatcccggtcgggttctgggaggcacmgcctcggggttgcgggccgggtgcggctcggcggtggaggactcacttcctgctccatccccggctgggccctggggcggtgagtgattcaaggagggagaccgcggcggcagcggcgcgctgctgaggggcgtggagggggcttgcccgccacccagacgttttctcagcggggttcccgcgctggcctttgggagcccccgggtcttgctgggctgtgggagaggtagctgtggtctctataccgtcggcgggataagtcattctcttaatcagttttcttgcttctcgatggtggtcccagggtttcagctgatctgtgaccctctgaccgccgcaccccggttagggcgcgagcaccgagaagaagaacggggttcggccccacgcgtgyagtcatgttcctattaataaacccggtgaacgcactggagcttctcacagtggcacttagtcacagcccctcagcgctgtggggcctttgaggtcacctgtgcatggggaaagggacgggctgggaaacagggtttctataaccgtggctaagacgtctcccctcctcagtggcgctgtctccagcaagtgggccctgcagctgtgttttgtaatgaatgtagaaataaaaattatactcaaaactcttttttttttttagacggaatttcgctcttgttgcccaggctggaatgcaatggcgctatctcctttcactgcagtctccacctcccgggttcaggcgattctcctgcctcagcctcccaagtagttgggattacaggcgtgtgccaccacacccggctaattttgtattcttagtagagacagggtttcaccatgttggccaggctgatctcgaactcctgaccccaggtgatccgcccgtctcgtcttcccaaagtgctgggattacagtcatgagccacagcacctggccaatactgaaaactcttattacaatttttactttctaattacattattgttgtttgttaaagttttaaaccagagagatggtttttagatccttaaaaactcaatactttataaatgaccaataataatgtctgtaaatacaaaaatatttcccccaaaaktgtgtgtgtgtgtgtgtgtgtgtgtgtgtgtgtgtgtgtgttccagtagtaaataggtgatttgtagtgggacaaaagatgtgaaagagtaaaacttcttcaccacagtctggtccttcctcccttgaaatgcaatattctttgtagtgggtggtcatgctggctgcattttttttttttttaagggagagacaggggctcactctgttgctaggctggggtgcagtggcgccatcatagctcactgcagcctggaactcctgggctgaagtgatcctcccacttcagcctcctgagtagctgggaccacaagtgcatgccaccatgcctggctgatttttaaaagttctttgtagagaaagaggtctcaatatgttgctgaggctggtttattggaaactttttaagggaaaaaacattatcttaatttctatgtgactcctatgcctggcaacatattaattgttgaataaatgactgatccatccagtaattcactcttgactatcctccaaaaagtaatgtttttcatgatattgctgtcgatttattaatatattaatgattggtttcagcccctaagagttgtgttttgtgcttattcccactttcacttatttttacaacctatccatgtcttcttttttttwaaaaaaaaatgtctttttcagtcttatttctgactccattaagatcttgaaatagaatggtatccaacacagttccctttggggttctgtataatctgtcccttgaggttgacaccaaatctgcaagccaagaagttagctgctcccataactaatatgagtatagttaaggccacaatttccttgcttgctgaggaaaatgaagttggggagaatcaaaagctttccagaaatcaaattacacctgccaactctctcctttgtttaccttgttcatcgtggacamtttgttcctcaaaaagtcaatgtgtctaaaagactgggttctgtcgatgtgtttgggaggcctaggcctctcttagtaatgggaaagttggccaggagaagacgtatgtaaaaacagacttagaaaagcacccctctgtggttgacagaatttacctcaggaccattctggtcaggtgtggggggttgtttgtgtacactggtggccattttttggctttcagacaatggtgagaatatctagggagctactgatgcacattgaggtctcttgctttaggaactgatgacgcttgataatgtggctggggacttcagggaagagtgggttacctggacactgcttagagaatcctctccaggaatgccacccagcacagttagaagaatgggctctcaaagggtaagaatgctactctcctttatttcatttatttatcttgttttttttgagacggggtctcgctctgtcatccaggctggagtgcagtggcgcgatctcgattcactgcaatctgtgcctcctgggctcaagcgattctcccacctcaacctcctgagtagctgsgatcacaggcatgtgccaccatgcctagctaattttttgtgtttttagtagagacaggattttgctatgttggcaaggctggtctcactatgctgtccaggctggtctcaaactcctgagctcaagcaatccactggcctccgccttccaaagtgctaggattatgggcgccaccatgcctgaccactgctctcctttaatttgagacttagatatttggagagggcccaggtctgaggagtttctggtatgttggcatcttagagctccagacctctgtaagattaattgttgcctccttgggagaaaaacaattacttccttatgcattttatggtttgcaaatgtctttgctatttattgtccttttaatatctcatcataactttttgacttatgtattactatcccccttttccagcctgggttggactctcacctctgccacttaacttctgagacttctgaggtctttgtggaaaaggaggtaattttttctgtcacttaaaaacaggctgggggcagtggctcacgcctgtaatcccagcactttggtaggctgaggtgggcggatcataaggtcaggagttcgagaccagcctggccaacatgatgaaaccctgtctctactaaaaataaaaaaattagctgggtgtgatagcgggcgcctgtaatcccagctactctggaggttgaggcaggagaattgcttgaacctgggaggtggaggttgcagtgagctgagaccacgccattgcactccagcctgggcaatagagcaagactctgtctcaaaaaaaaaaaaaaaaaaaaaaacaaggctgggcgcggtggctcatgcctgtaatcccagcactttgggaggccaaggcagggagatcacaaggtcaggagatcgagaccatcctggctaacatggtgaaaccccgtcttactaaaaatacaaaaaattagccaggcatggtggtgggcacctgtagtcccagctactcgggaggctgaggcaggagaacagcgtgaactgggaggcggagcttgcagtgagccaagatcatgccactgcactccatcctgggcgacagagcaagactccatctcaaaaaaaaaaaaataaataaaaaaaaccaaaaacacctccaatgctctttctcaaatatcatggctacccttcctcctgctttacttctttctttcttttttttttttgtggcagagtctcgctgtgtcgcccaggctggagtgccatggcrtgatctcggctcactgcaacctctgcctcctaggttcaagcgattcctggataattttttgtatttttagtagagatgggttatctccatgtggtcaggctggtctcaaactactgacctcaagtgatccgctcacttcggcctcccaaagtgctgggattataggagtgggcccagctctaatttttgtatttttagtggagtcgaggtttcaccatgttggccaggctggtcttgaactcctgacctcaagtgatccgctggccttggcctcccaaagtgctgagattagaggtgtgagccactgcgcctggcctacttcatctattatacaagtaatgtatactcattcaataaaaagtcaagcaaaatgaaaacaaacatcatccctaatcccaccaatgaagagttactatcctaccagcatttttctaagcatatatacaattttaaaagaagcacaaaagaataatattgggattatgctgtatattcagctgtacattctttcttccatgttgtattgtgagtatatctttctttacatcacttaaaataaccacctagtattttgttttatggaatacaatattattttgttgatgaagtcaaacattagattgaaccatatatctgacctttttttaacctataaaaatagcaattgcctgagctacttgggaggctgaggcaggaggatcccttcagcacaggagttcgaggctgcagtgagctatataattattcctttgttgtgggacatttaggtcatttctaaactttcaccaggttgtgataaacatcttttagctcgttttttaaaaagtattttttattgaagtataattttatcattttcttagaattctcagaattagaattggtgggtcaaagaacagatacatttctaaggtatttaatactttgcaaaatgccttccaagaagattgaatcaattgatttattcccacaaacattatatgaaagtgcgcatttctttatattctacctttcacagtgggtattataatttaaagagtctgggcctgggtgtggcagctcatgtctataatcccagcattttgggaggctgaggcaggaggaccacttgagctctggagttccagaccagcctgggcaacataatgagaccctgtctctacaaaaagttacattaaccaggtgtaggggcttgtgyctctggtcccagctacttgggaggctgaggtgagagaatcgcttgagccaggagctcgaggatgcagttaactgtgattgtaccagtgctctccagcctgggtgacagagcaagagcctgtctcaaaaacaaacaaacacacacacaaaacacaaaaaaagagtctgggaaaaatagcaataatagttaacatttattgaagttttttttggagatggagtctcaatgtgttgcccaggctggaatgcagtggtgcaatctcagctcactgcaacgtccgcctcccaggctcaagcaattcccatgcctcagcctcccaagtagctgggattacaggtgtgcaccaccacacgtggctaatttttgtatttttagtagagacaggatttctccatgttggacaggctgctcttaaactcctggcctcacaagtgatccaactgccttggtctcccaaagtgctgggattacaggtgtgagctactgcacctggccaatggatcttattcttatcccaatttttttttttttttttgagatggagtctctctctgtcgtccaggctggagtgcagtggtgtgacctcgattcaccataacctctgcctcctgggttcaagcgattctcctgcctcagcctcccgagtaactgggactacaggcctgtgccaccatgcccggctaatttttagtagagacggggtttcactatgttggccaggctggtctcaaactcctgacctcgtaatccgcctgcctcggcctcccaaagttctgggattataggtgtgagccactgagcctggcctcttatccctattttattgatgaagacattgagacacagagtttaagtaactttcttaaggccacacagcttgtaagaggcaggatgatgactyagacccaggcagtgtgactcttgagtttgcactcattacctctacactatattgcctcagtgtatcattgttataatggaatttctttgattatagtgaggttaaacatttttcgtatatttacaggctacttaacaactgtttgtctttttctcatggcttttttgactgctgccattctgggaaaattttaaagcccaacattatagttaacttccttcattgtttctaagggtgaggtcatggaggcttggtttctgataaaatcctctccatatttagctttagccttgtaccttcagaaatggttattgtatttacttcagagtttctgtcacctgagtctggttttttttctttatgggaggaaaagggcttttttttcttaacattttggggaaatcaccgtgttttatcactgtaccatggctgcacttttttaatgacaccaaatacacgttagagctccccaggtgttcttccatacctaggcagggagtagggcttggattttgctcaggccttgtgtgattggctcagactcacatcctatgtttacattcctgtgtagaatttccaggcctagtgtaatctcccagccggagcagaaagaagagccatgggtcctaccactccaaaactttgaggcgaggaagatccygagggaaagccacacaggtgagatgtgagtgctccccagtggaaggaaatctagcatttcagccttgtttagatgaagaatttggaatgctgccttagaattttgttcttactagcagacattttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccactagcagacatttaaatttgacttaatggtcagtagttgactaaataaagtcttcattttgattaagcatttcacttttgtctaacctatgtttttttttgagatggagtctccctctgtctcccagcctggagtgcagtgacacaatctctgctcactgcaacctccgcctcccgggttcaagtgattgtcctgcctcagcctcccaagtagctgggactataggcacccgccaccacgcccagctaattttcatatttttagtagggatggagtttcaccacgttggccaggttggtctcgaactcccaacctcaagtgatctgcctgcctcggcctcccgaagtgctgggattataggcgtgagccaccacgcctggcctaaacctataatatcttctaaagaaaccgcacaatattgacaatatgtggtctccgcttgaaggatatcaagattcatctggccatcttaaaatttaaaaagtttaggaattcacgtgttctgacagctcaatgaacctcaataaacttttcacaaagtgaaaacagagcggttgaattaagtgcagtctgctgcagaaacagggattttaatctttgtcactgctttctgatattccttcctgataactgataactttattctctgttacttacattaatttttcagactgtgagcatcaggtggcaaagctcaatcaggacarttctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatrtaggagagaagcctatgtgtgcagaatgcgggaaaagctttaaccagagttcctatctcataagacacctaagaacccacactggcgagaggccctatacgtgcaytgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttakgagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtckatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgyggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttttccaagaaaattttggctaatatttctttaggtattcctttttctctcatagtgagggattaaaaaaaaaaaaaactgttgaaaaattagggcgtaaaaatgctaaatgacatgactcatcatgggccacgtagttaacagaagagccagatttggctgcaagtcactagatttccagcctgcagtcctcctctgcaacaacagaccagctctgggatttgttacagtgcctgtgagacattacaggactggaggacccatattatatccattaaaccagtctgaatttggaaatgatggagggtgtagtctaagttgtagggagctttgcaagaacctgtgctggggtccttgatcctggtggaatgggggtggaggagtgagcgcaaatgcaaggggttaaggagggagctgggtagttatcactttttagagtgcaaagtggtggattaaaggtttcttttctttcattctcttccattatatggaatgccatctgagtgctgtggctcatgaaggatagaactcagctgataaccttacctcagtttttgaaagcatcattagataattgaccagaaaattttttttagttaatccagtgcagtggttctcaaactgtgagcccagtccagtagcatcagcattatctgggaactttttagaaatgcagattcaggccgggtgcagtggctcacacctgtaatcccagcactctaggaggccgaggcgggtggaccacctgaggtcaggagtttgagaccagcctggccaacatggcaaaaccccacctatactaaaaatacaaaaattatccaggtgtggtggcatgtgcctgtaatcccaccaatttgggaggctgaggcaggagaatcacttgaacccaagaaatggaggctgcagtgagctgacatcacacctactctcgaactcctcacctcatgtgatctgcccgcctgagcctccgcaagtgctgggtttcgggattgtggcggccgagtcttctagattttaggtctctgttttttttgtgttgcgcttcttcaggtctggtcttatagcctgtctgagccgcgtccgggggcccttccttcccctgtgtcccgagaagaaaaggtaagtatactaacagttaaaagagaagtactccatcactccaaacactgcagtcagggctgcagtgttatctgaagattcaactgaggtgcgcaagggagaacctgcttccaaactcactcatgttggctggtctttgctacatgaacctgttcgcaggatggcctcacaatatggcatccgatttccttacaagtgggcaactgtggccaagcggggtcacaaccaatatacttcactccnnnnnnnnnnnnnnnnnnnnaagtgctgggattacaggtgtgagccaccgtgcctggccacctatcattttgtttgtttttcatgttgttcagctattgtaagatgtgagggtttttttgttttttgttttttttaggtgaagtcttgctctgttgcccatgctggagtgcaatggcatgatcttggctcactgcaacctctgcctcccaggttcaagcgattctcctgcctcagcctccggagtagctgggattacagatgcatgtcaccatgcccagctaattttatatgttaagtagagacggggtttcaccatgttggccaggcgggtcttgacctcctgacctcaggtgatccacctgccttggcctcccaaagtgctgggattacaggcgagagccacctcacctggccacctatcactttgattttcatgttgtttggctatggtaaaatgtgagctctcgaagggcaatgtgagatttgctttgtggccctgccaatcccctccctcctccctgtcttcctgcccacccccccccactcccccgccagccatgagcagggaatatttcaatgctattgctgagagtggaggtaaccctttctatagttttcttttgtttctacctcatgactagatgattcactgcttgaacatgctccacacatccgttctttctcactccaaaattgaggtcatcaccaagccccattaattttacctcccagattcctctcgaacctatctgtcaaatctgtccatcttcactgccacccttcagtaccaaatgaccagtctcttacctgaattcctgtagcagcctccaaactgatcttcctgatatgatttttgctctgaaaaaactggtttcactcacagaaaccagagtgaacttttaaaatcctaaatcgaatcacatcacttctcagcagctttccattgcttttagaatgaagacccaaatccttacccaggcctaagaggcccttgtggttttgtcccctccccctccatcctcttgtgatatccccttccctctcccttgcctcacctcagcactcttgagttctctgctccttggtcatgccaaggttgtgtgctctttagacccttggtactaactgttccctctgcccagaatgttcctcgcccagtcctttgtgttgcrtcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattytttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcaccaagcaccagggcaggcaccacaacaaaaagataagatccctaacccttcttttacctcgaaataattcctcctagaccctatcatcgcattccttctcttccccttttgtcaaacttccactcacatgtagatattctsagggttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagcccaggagttcaaggctgcagtgagctgtgatcataccaccgtactccagattgcgtgacagagctagaacttgtctcttaaaaaaaaaaaaagacttaatttccacatctgaaggcctcttgttagtcttcttctgattcaacaactctttactgtttgatgccatttacatatgtttattattttttagagatggggtctcattcktttgctgaggctggagagcagtggtgcgatcatggctcactgcagcctcaacctcccagactcaagcaatcctcctgtctcagcctcctgagtaacagctaggactacaggcacatgccaccaagcccggccttttaaaatttttggtagaggccaggtgtggtggctcatgcttgtaatcccagcactttgggaggtccaggcgagtggatcacctgaggtcaggagtttgagaccagcatggctaatatggtgaaaccccgtctctagtaaaagtacaaaaattagccaggcgtggtcgtgggcgcctgtgatcccagctactcgggaggctgaggcaggagaatcacttgaacctgggaggcggaggttgcagtgagctgagatcgtgtcattgcactccagcccaggtgacaagagcgaaactccatctccaataataataataataataataactttgctagagacagggttcccctatgttgcccaggctggtcttgaactcctgacctcaagcaactctcccaccttggcctcccaaagcgctgggattacaggtgtgagctactgcaccaggcccatatgcctttttaaaaaaattatcttttccattggtgactatgaggttgagagatgattctcctacatttctggctgctcctcttcaagtaccttccctggctcctctggatttttttgttttgttttgttttgttttgttttgtttttgagacaaagtcttgctttgttgcccaggctggagtgcagtggcaggatcttggctcaccagctcactgcaacctccacctcccaggttcaagggattctggtgcctcagcctccagagtagctgggactacaggcccagctaatttttgtacttttggtagagatgggggtttcaccaggctggtcttgaactcctgcctcaggtgatctgcccacctcggcctcccaaagtgctgggattctaggcatgagccaccgcgcctggcctggctcctcttcttcttccactcagatatgcctgaccctgtcaacactttggttgaggtcttctttcttctttcttttttgctccgcacatttagcttatgacttcaaccatcatttctcagagcatgggtctggctcaacctctctcctgaatttcagacctacaagtctagctacttggtggagacctccccagaatgacctgctgcttcccaaaagcagactctccaaattacagtcagtatctcccccggaagcattcccccaggcatttctctttctgccttcaattccccattctcctacattgccttgccagaagcctgctggtcagcttggatttctttttgtccttttttttctatattttgctggtgcctagtcatgtagttgctgcctctacactttctcttctttaaaaaaaattattaaagcaccacgtgcttgttgtaaacatttccagaaaatacagaagtgctcaaagtgaaaaaatggaaatgccttgtcccttcctcattccctgccctaacctcacgccccagattcagctatgtaatagtctgtcatgccaagtcttatttccagctcctcttttccatccccactgccatcatctgaactaaacggattgttttccatctggtctccttggcttttcctttcagtgcagctcaacagacattaatcaagtgccttccacacaccaaagtcctaccctagatcctagaggttcagagacaagtaagatagttaaagagatccacattccagagctgtttaactttgggcaagttacttaatctctctgacccttacttccttatctgtaaaatgatgctaatcccagcacctttttcatgggtttggacgagcattaatgagatgatccatgtaaaactctttgtactaactacctggtacactgtatctgctccataaatgtcagtgacaacaatgataataatgacaatgtttggaggagtttatagcttaatggagagacttaaagcataagaattatctaggcgaagaatgatgagaaaatatttttggaaaaggaaaacaaacagttctactaaaattaaaaggctgatgtagagacttgggaaactgggaggtaagagctcggactgtgtcctctaagacagtaattcccgaagtgtgagcaaaagtccacctgcatcagtcttacttggggtgattgctcaaaatgaggatttaatggctgcacctccgagcaagttggtaatttacatatcggaatgctatccatcaaggaaaatgggcagactacagttacatgcatcaacacagacaagcttcaaacaatattgagtgtaaaaagcaagacatagaaatatatatttagtaagagtaaaaatacagtaaaggtaaaaaagaggcaaaactaaacaatatattgcttaagcaataaggatacacaaactaatgaaaatcaaaggatttactaatacaaacttcagtatagtaattaattggaatgggagagaargatgcaaagtttctatttctttttttgttttgttttgagacagtgtctcattctgttgccaaggcaggagtgcagtggcaggatctcagatcactgcaagctcagcctcctgggttcaagtggttcttctgcctcagcctcccaagtagctgggattacaagcatgcaccaccacacccagctaatttttgtaattttagtagagatggagtttcaccatgttggccaggctggtctcgaactcctggtcttaagtaatccgcccacctctgccatcaaagtttctgtttcttaagttggctgccgagtacacaggttttctttgtaaaataattatttaaattgttaatatgcattacttatatgcttttcatttacaatgtatttcacaagaaaaataaaacaaagcaaataagaaaacagaacacttctccagagattgatctttttcactcaaatctcattgagttatactgagggggaaaaagagtaatctgagtgcctgggccctgaacagacacactagatcagttccttcattcccactcaaacacatgcacacacacgcacaaacacacattttcttatatttccttcagcaaaccccccgccccaccaaccaaccccaaaacaccctctgctcctttatgtatataaattagagcagataaatgtccagaagattataggccatctttctataaacagccaatcttggacctggtgtctgaatgggggatgccctgctgcattaaagatgctcatgtgaacattttgttgtttcccagaaaaaaagtttccacattttagattattttcacagggtgagaacaattttacacctcccttacttgctgcagaatcttttttttttttttttttttttttttgagacaggtcttgctctatcactcaagctggagtgcagtggcacgatctcrgctcactgcaacctccgcctcccaggttcaagcaattcttctgcctcagcctctcgagtagctgggattacaggtgcgcaccaccatgcccagctaattttttgtatttttagtagagatggggtttcaccatgatggccaagctggtttcaaactcctgaccacaagtgatccgcccacttcggcctcccaaagggctaggattacaggtgtgagccaccacgcctggctgctgtggaatcatttttaaagtgattgtatcaatttacagtgttccgaacagtaaatggctactagtctcatcacaccctcatctttaaaaaagttttgctaatttaatagacatgattcttacatattgtcttaatttgcatttctttgcttaccagtgaggttgaacatttttttctatgttagaatctttcttgtatttcttctgttgttttcattagagtaactcagagcaggattgggaatctgaaaacatgaacatttgattttgaggaagtcattgttttcctgttgtcttccttccccctctctgctttattattttttacttcaggttcatttatagaaatatcagaaaatacaattaagcaaacagagtaaattccacttcccagagataaccactaccgtttgttgtatatccttttaagctttttctctgccaaaaatattcacaaatatatcgcttattctttctgagcctgtttcctcatctatcaaatggaatacttgttcttcaagttgataattaactggtgggagcacatgaaagtattttataaagtgcacaaatgcaagttgctgctcttatgacaaagaaaaaatgtattttattctgccaagcagaatgatgacactttgtttcctgaacacagcctgctctctccagtacaatttcttctctctagaatagcttcttgcttcaattcctcctgctgaactactatctactctttttttaaaaaaatcaatattaaaatatacaaaaattagtgtaaagagcaaccacgtacccactatacagcttaggaaaagagtctggcatttctcactcctatgcctttatatatacttgctttatttcctgtctctctatatatacatacatatatatttagtaagagcaaaaatacagtaaagatcagggaaggtgcggtggctcacgcctgtaatcccagcactttgggaggccgaggcgggcagatcacgaggtcaggagtttgagatcagcttgaccaacatggtgaaaccatgtctctactaaaaatacaaaaattagccaggcgtggtggctcatgygtgtagtcccagctattcaggaggctgaagcagaaaaatcccctgaacctgggaggtggaggttgccgtgagccaagattgtgccactcactccagcctgggcgacagagtgagactccatctcggggaaaaaaaaaaatacagtaaaggtaaaaaacaggcaaaactaaatatattgcttaagcaataatgatactcatacaaactaatgaaaatcaaaggatttactaatacaaatttatagtagttaattggaagcatatgtattatataaatatacatgtattatacatatatgtatatatgtatatatatagaaaaaagcaaatatatgtatatatacatatatatctatatatgtaaaatttttatttataaaatgtttttgagcatgaaatgatatatcattgtggtgttaatatgcgtcttagctgggcatagtaggtcacacctgtaatcccaacattttgggaggctgaggcaggaggatttcttgagctcaggagttcaagaccagcctggacagcatagtgagaccccatctctaaaaaaaaaaataaaaattatctggcgtggtggctgatgtctgtagttccagctactcaggaggctgaggtgggaggatcacctgagcactggaggtcaaggctgcagtgagctatgatcatgccactgcactccagcctggatgacagagccagatcctgtttcaaataaataaattaaattaagttaaaaagtatctccctgattagtggggaagttacccaactttttttttttttttttagacagagtctcagtctgtctcccaggctggcatgcagtggcacgatcttgtctcaccgcaacctccacctcctgggttcaagcaattctcctgcctcagtctcccgagtagctaggattacaggcatgygccaccatacccggctaattttttgtatttagtcgagatggggtttcgccatgttgggcagactggtctcgaactcccgacctcaggtgatcctcccacctgggcctcccaaagtactgggattacaggcgtgtgccaccgtgcccagcagttacacaacttttacaagtttattgttgttcatgttgcctcttcagggaattttgtttataaagtacctattcttcaaggccccattaaaacacctccctctccataaagtatttccagatctcctctatcaagcagataggatttcctttggacttctataatcctttctttctacatcttgggtttcactcacttcttatttcatcttgcattacagtcacttgtgtacttgtctaaagggcagtgactatgtttaactcaactttatgcccttgttcatactagtacaaaagtaaacatttcataaatctttgttgaatcaaatcctactcctcccctgcttataaaatcttaaatcatttcctattgtctacagacgaaagtrgaatctcgtttaatgtagaatttaagacccttccacgggctctagcatcaaccttcctttcttgctcttctcctgggaggaccttgctttccgccccagatactagattcttcatccacagtaaggtcccagtccactaatgtttggcttttctctctgtagctgggatggcaggttggtcccacccattttagttgcctataaaattcttttttttttttttttgagatggagtcttgctctgttgcccaggctggtatgcagtggcatgatcttggctcactgcaacctccgcctcctgtattcaggcaattctcctgcctcagcctcccgagtagctgggattataggcaactgccaccatgyccggctaatttttgtatttttagaagagacggggtttcaccatgttggccaggctggtctcgaactcctgacctcagatgatccgccctcctcggcctcccaaagtgctgggattacaggcgtgagccaccgcgccyggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagccactgcgtccagcccaaactctttaagagaaaatctcttgggatcttgaagccagragcttgcttttattactgagtttgccctgaatctgtcacttatgtactaaaaatacataaatttccttatccaggtgacttgggctcaactgaaggaaacctgaagcatctaaatgttagcacctaagcctgagtctaggtgccagcatagcctgtcttccctctccagagtcagaggcatgttacaaacagaatatatggacacacgtcgaaccccacattgtatctctctaatttattcaatttaattcagtaaacactcattacctcttatatccaggcctagttgagggtgctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgargtgatctcagctcaccacaacctccacctcctgggttcaagcgattctcctgcctctgactccccagtagctgggattacagtaatgcgccaccacacccacctaatttttgtatttttagtagagacaggcttttgccatgttggccaggctggtctcaaactcctgaactcaggtgatccgcctgcctcggcctcccaaartgctgggattacaggtgtgagccaccatgcccggcccagacacatagtttcaatacaagaagtatatgtcagccagagaagggctatcttgagagtcaaggaaggctccctggaggaggtatcacttatgccagttggtacatgaatgagtaaatgcaaacaagccatgatactgaaataaagctttgtttaattaaccttcacatgtaaattcagccacagragacattctgatacatgggggcattgccagtgattccacgaaactggataatgtcattgatgcttgtggttgagagagcttgtttctgtattgtaaggaaggtggtacaacctggcctttcttttaaaaaaaaaaaaaaattcaaactggacatgtgtcaatgaactgactggagtcttagggaggaacattgctccatagctatatgtctctcccgttttttcctgtgttagtctttttttttaatttttttaaaatttttttgagacagagtcttgctctgttgcccaggctggagtgcagtggtgtgatcttggctcgctgcaagctccgcctcccgggttcaagcaattctcctgcctcagcttcccaaatagctgggactacagatgcatgccaccatgcctggctaatttttgtatttttagtagagacagaatttcaccatgttggctacactggtttggacctcctgacctgaggggttccacctgcctcggcctctcaaagtgctgagattacaggagtgagccaccttgtctagctctttttttttttttyttttgagacaagttcttgctctgtctcccaggctggaacgcagtggtgcaatcacagctccctgcagcctcgacctccccagctcaagtgatcttcccacctcagcctccccagtagctggggccacaggcatgcaccactacgcccagctaattttttttattttttgtagagatggtgtctcaccatgttgcacaggctggtatccaactgctgggctcaagcaatcttcctgccatggcctcccaaagtgctaggattacaggcgtgagccactgtgcccacgtgttagtctttacataactgaatagtgactgaagtcttgcagtttctaccttgccctgcactggcattataagttgtagtagaaatgtcactcattgcttgtaatctcatgagaggcctagttagatttttctgtactctacttccagaggagcttataggaaggtgactttccataaaggatgtgagctttctaccacccaaatatcagtcgtaaagaaaatgaggagtgataaagaaagaaggtattgagaggtgaagccagctgggcttctaggttgggtggggacttggaaaacttttctgtctagctagaggattaaaaacgcaccaatcagcactctttgtctagctaaagtattgtaaatgcaccaatcagcacactgtaaaaacgcaccaatcagcactctgtgtctagctaaaggactgtaaacgcaccagtcagcactctgtaaaatggactaatcagcaggatgtgggtggggccaaataaggcaataaaagctggccagcgaagccagcagcaggcaacccactcgggtgcccttccatgctgtggaagctttgttctttcgctcttcacagtaaatcttgctgctgctcactctgggtccgcactaccttcatgagctgtaacactcaatgcgagggtctgcggctgcattcctgaagtcagcaagaccacaaacccaccgggaggaacaaacaactccagatgagccacctttaagagctgtaacactcactgcgaaggtgtgcggcttcactcctgaagtcagtgagaccacgaacccactggaaggaagaaactccggacacatctgaacarctgaaggaacaaactccggacacaccatctttaagagctgtaacgctcaccytgaaggtccgtggtttcattcttgaagtcagcgagaccaagcatccaccaaaaggaataaattccagacgcagtatttacagcccagtgtccacccattccccatgtagcaacccctggtacctgaggaaaaaggtcacagcctctgccaatggtggggcatctttccgaagaggttccacttggactttttgaaacatcatgtggctgtgctgtttgagaagcctggggtgaaattaactatacaagaatcagggcatgatcacacacgcacacacctttgcaatttttctggctttgtttacactgttactgcaacttgtgccctttctcacccttttcataggtcttccctgcaaagtctttttttttttttttttttgagacggagtctcgctctgtcgttcaggctggagtgcagtggcgtgatctcggctcactgcaacctccgcctcctgggttcacgccattctcccgcctcagcctcccgagtagctgggactacaggcacctgctacctggcgcagctaatttgtgtatttttaatagagacgggtttcaccgtgttaacgaggatggtctccatctcttgacctcatgatctgcccgcctcagcctcccaaagtgttaggattacaggcctgagccaccgcacccgacccatcaactgttctcttatctgtgctcctagatctctatcttgatgtctgaaagcttcttgagagtgctttgtcaggtctatgtccatcacattctttggtggatgtggcctcacaaatctttcaactcagccctctaggtcctcatgtgcattagtggagaatagcgttcacatatgtgggctttgggtccaatgcagtttgaatnctgagtatgtcactaactagttgtgtaatttttggaacattgttaacctttctgatttcagtttccttatccttaaattgaaaattctagtagttcctacctcataggattgttgtgaaggtcaaatgagatcaaatacttacaactggacctaaggggcactcattatgagttagctgttgttactagtaacccattgtcatccctgtagatgtttcaggggtttgccgtggggaaccctgccatgcaggcttgtctcaggttctgaccctgtgatggggtctggtgttccctgcctcgtttaccrctctttccccatactttggtctgactctccaatgagctcatgattcctatgagcgatttctgtctcttgatgaatctttagatttgtcctttgtcttaggccttgagactgcagtagaaccttgtggcctattctaaccccagcccggaaaccaatgccccaactccattctgggctgacttcctggcttcctcccacaacttccgggtctctgtttttatatattgttcctagactaggatatgggtgttcacaaatgtttgttgaaaggttttcagaggcaattaggcatatttaagaagtgaatgaacacctgctcattgatatgctgtccataaactaggacacggtgttgaatgatgatttgacagagattttagaatcagagagatggaagcttgatcctaactctgaatcttatggccttaagcaaaatatctaacctctttgtgcctgttttctcatttgtaaaatgaggataattatatttcctcatagggttattgtgaagattaaatgagacaatataaataaagcacctagcattttctggaacatggtaagcagttggtaaatagctgcaactaccaacaggtagttcaaaacttttcctccatctgaaaaaccaagagttgaagaaatggctgaagttggaatatctggcaggagctgtgcttaaacacaagatccggaatatctgaatatctttaggacaagatgaaataggtttctctcaaatgagttggttaaggagttaagcagtgataggtaacacttgaagtttcacaaagatgaaaactggtacttgacagacagccacttgatggtattctgaagtttactgaccctttgttctatttctagaacaaggtgttctatctctttgcccaaggtgttcaaagtatagagaaacaaagaagatcagtaattacatagaccaaatggagtatcggatttattacgaactacatctgctcaaaagactcatgaactatatggagttagtcctatcagagagaagcagggtatccagctagctcataggcctttttatacaaaagtttaccattagcatgtttggtaacattacttataagccaccccaaccccctccccacacactcaagtttccttaagtgtatgtattagttttctattgaagtacaggcaagcttgactgggttctttgctcagagtcttacaaggtcaagattaaaatatccactagattaaggacttatcttgagactgtgaggagaatctgcttccaagctcatttaggctataggtagaatcaagttccttgcagttataggtctgaggtccctgtttccttgctgactatcagtcaggggccactcttagcttctcgaggctgctctcaagtcctttccatgtggacccctccatattcaataccagcaatggcccattgaaccatcccatgctttgagtctctgacttcttttrccagctaaaggaatctctctacttataaatggctcatgtgatgaccaggataatttccccatcttaagatcaactgtttagtgccttaattgcatctgcaaaatcccttcaaaatagtgcctagattagtgtttgattgaatagccaaggattgggaatcttgggcagtcatctcagaattctgcctacacagcatggttacaatttcctgaaaagctatcctgtgaggcctgacagttatagtacaagcattggataaacattcccatttcagaatggagaaatcagccaacaagaaaggtgctacaggccccatgcaagtttgaaagctggaagggcagtcattagatcttaaagctctaacataatctttgactccatgtcccatatgctgggcatacyggtgcagtgggtgggctcccaaggcatggagcagctctgtccctgtggctttgcaggattcatcacccatgactgctctcatgggctcgagttgagtgcctgtggctttgccaggcacagggtgcaagctgctgttggatctaccattcttggatctggaggatggtggccctcttctcacagctccactaggcagtgtgccccattgggaactctgtgtggggaatgtgtattaatctgttctcacactgctaataaagacatacccgagactgggtaatttataaaggaaaggggtttaattgactcacagttccaccgtggggtggggctcacaaccatggcagaaggcaaatgaggggcaaagtcaaatcttatatggcagcagacaagagagcttgtgcagtgcaactcccatttataaaaccatcagatctcagggaacttattcactaccactagaatagtatgagggaaaccactgccacgatttaattatctccacctggccccacctttgacacgtggagattgttacaaatcaaggtgagatttgtgtggggacacagccaaaccatatcagtgtgccaaccttacaattccccttggcattgacctagtagaggttctctgtgarggctccacccctgcagcagtcttctgcctggacacccagacttgtccatacatcctctgaaatcaaggtggagggtggcaarcctcaagtcttgtgctctgtacaccgcaggcttaacactacatggaagccaccaaggcttttggcttccaccatctggaactgcagcccaagctgtacttgggcccctttgagctgtgggtagaggtggagcagcctggatgtgggaagaagtgtcccaaggctgtgcagggcagcagggccctgggcttggtccaggaaaccattcttccctcctaggccactgggcatataatgggagaggctgccatgaaggtctctaaaatgcctttgaggtctttttcccattgtctttggaattagttcttgggtcctttttagtcaagcaaatttgtctagcaaatggtggctctccacagcctgcttgaattcctctcctgaaaaagctttttctttctttgccacatagccaggctgcaaatttttcaaacttttatgctgtgcttcctgtttaaatataaattccaactttaagtcatttctttgctcccacatttaagttaggctgtcagaagcagccatgccacaacttcaatgctttgctgctgagaaatttcttctgctggccaggcgtggtggcttatgcctgtaatcccagcactttgggaggctgaggtgggcggatcacctgaggtcaggagttcgagaccagcctggtcaacatggtgaaatctcatctctattaaaaatacaaaaattagctgggcatggtggtgggtgcctgtaatccctgctactcaggaggctgaggcatgagaattgcttgaacccgggaggcagaggttgcagtgagccaagatgcaccactgcactccagcctgggtgacagagcgagactcagtctcaaaaaaaaaaaaaaaaaattcttctgtcagacacttagatcatcaccctttagttaaaagttccacagatccctagggcgtggacagaacacagccaagctctttgctaagacacaacaaatgtgacctttgttttagttctcaagaagtttctcacttccatctgagaccttgtcagcctggccttcattgtccatatcactatcagcattttggttgaaactatttaaccagtctctaagaagttccaaactttccctcaccttcctatcttcttctgagccctccaaactcttccaacctatacttgttacccagttgcaaagtcggttccacattttcaggtatctttatggcagtgccctactccttggtaccaattttctgtgttggtccatttttgcattgctagaaagaaatacctgagactgggtaattccttttcytttttctgagacagagtcttgctctgttacccaggctggagtgcagtggtgcaatcttggctcactgcaacttccacttcctgggttcaagtgatcctcctgcctcagcctccsgagtagctgggattataggcacacaccatcacaccttgctatttttttttctttttttagtagagatggggtttcattgtgttgatcaggctggtcttgaactcctgacctcaagtgatccacccacctctgcctcccaaagtgctgggattataggtgtgagccactgtgcctggctgagactgggtaatttataagaaaagaaatttaattggctcacggttctgaagactgtacaggaagcatagtggcatctgcttctggggaggcctcaggaagcttccaatcatggtggaaggtgaatggggaggaggcgcatcacatggtgaaatcaagagtgagagacagagtgccacacactcttaaatgaccagatctcatgaaaactcactccctatcacaagaacagcagcaagggaatggtgctaaaccattcaagagaaaaccgcccccatgatccaatcacctcccaccaggccccatctccaacactggggattatagttcaacatgagatttggatggggaccaatatccaaaytatgtcaacaattgtgttacttctccatctacttttctcctggtagctggctagtttctcttaacactgattgtaagacctatcctgatttcagaggcatttaaatataaaaaaaattgggacttatttcttgaaaatgttgtacttactagacagtaagacttatttctgaagatacctggtttctaaaagtactactgggaaatataataaatgaggaagtgattaattttgcctggggagtaggtgacatttgaattgggtctgggaggttcagtaggagtttcccaggcagataataggctaaaaggtattccaagcaagggaaacttctattatggtgcttatctcaagatatcctgttaatattgcttgactcctcctggcttgtaaattctttgtggtcattaaccaattttgactcccaaaatgaccatttacctcattattttgccgtttattcatttcatatttactaattttattcatatttatatttgctgacaaaatagtatttccagcagctcattttaaatacagacaagcaagcaagcaaaccccacacaaatccagtgtaatagcactgcctggagaagccactgttaatatattggtgtatatacttcaaggctttatctattcatatgcacatatccatcaatgtatctatctakctagctacatttaaaacaaaatggtatcatatttattagtcataatttgatatwttaacttaaccacaatattaaaatattgtactgccagcctgtacattttttgcctgcccagcctcccactgaaggaaattatgcccagctcatagttctctatgcttaattatctrtatctcctgatcatagttgattgaagtaaaggatcagcatccaatctaagggcagcctgcctgtgggtggtcagagatttacccacagggtggaaagctgagctgggtcaatcatatgccactctrtgggttatggagttaggcaattgagatgatcctcaatggagctgatgatgtaaggataccatgaccttcagtcaaagccatggcaaggcaagcagaaacaagagttgtgagggaacagaaaaaattaaatggagtaagctggttagcaaagagtggagagtagagccagcctgtggaaaagcagagatgcccagagaatgaaaccatgacttcaagctttcattagtcctgttttttttttgtttagtgtagttttgtttttggtgcagttccagtccatataggtctgtataagaaaggcctcccttccagccttttttcctctagaagtaaaactgtgcatgtctgtttcctgtagccagtcaagcctgaccagaccacagatcatcactgttcatggctatatggcattctattgtgtatagctgccatcactgatttaaacacctactgatggacatttgagtaatttccaaggagcatcttcatggataacttttgcacatttaataaaagcaygatatccttatgatacattccaagaagtgaagttttttggttgaagaatagatgcataatgataagctggtctttagaaagactatattaatttattgcctactaacattgcataagagtggttgctttttcacccccttgccaataatatcaattaaaaagacaaaccaaaatgttgctacatatgataggcaagaagtgatatgtggcatgttatcttttctattttttttttttttggtgatgggtctcactctgtctacctgggcaggagcacagtggcgggatcacagctcactgcagcctcaactcccaggctcaagcgatcctcccacctcagccttttgggtagcatgccaccacgctgggctaattttttgtattttctgtagagacggggtttttcattttgcccaggctggtcttgaactcctggcctcaagcaatcctctctcctctgcttcccaaagtgctggggggtataggtgtgagccgttgtgcctggccagcatgttattatcttaatgtctatttctctgaatcttgagtttattgactaggaattgggctttgtcattagacaggcctgggtttgagttccagctctgcctcttgctgtgtggcttcaggtaagtaacccagttctccattttcccaagtgtaaaatggacataatgggattattacaaggatcagctgagaaaataaatgtgcaacacttagtatagtaaggtaccagtgcagttggtaacttaacatctctgtggctttcacctcagacaaactttgtaattaagtaaagaaagcctttatggaatgaacaattggattaatatgttggagttaagaagaaatatttcggctgggcatggtggctcatgcctataaccccagcacattgggaggccaaggtgggcagatcacttgaggtcaagagttcgagaccagcctggccaacatggcaaaacctcacctccagtaaaaatacaaaaattagccgggtgtggtcgtgtgcgcctgtaagcccagctactcaggaggctgaggcaggataatcacttgaacttgggaggctgaggttgcagtgagccgaaatcacgccactgcactccagcctgggtgacagagtgaaactctgtctcaaaaaaaaaaaaaaaaaaagaagaagaagaagaaatatttcacattttatgtattcgcaatgtttaagaaaatttggccgacttgaatgacagcttttttgtaaatcattttaaatgtgtaattgagttagttttagacttaggtttttgagttgaaagcttactaagtttacacatggaatcaggccatctaagagaatgttagctttgttatgcttgtatgtttatttataggaattactaagttttgaaaaagttttaaacaattgaatgaattaaaaagaaaatctaggccgggcacagtggttcacgcctgtaatccaagcagtttgggaggcagaggtgggtggatcacctgaggtcaggagttcaagaccagcctgggcaacatggtgaaatcccgtctctactaaaaatacaaaaattagctgggcgcggtggtgcgtgcctgtaatcccagctactcaggaggctgaggcaggagaatcgcttgagcccaggaggcagaggttgcaatgagccaagattgtgccattacactccagcctgtgygacagagtgagactccgtctcaaaaaaaaaaaaaagttttgaaaaagttttatacgattgaatgaactaaaaagaaaatctaggccaggtgcggtggctcatgcctgtaatcttagcactttgggaggccgaggccagtggatcacaaggtcaggagtttgagaccagcctggccaatatagtgaaaccccatctctaataaaaaaatatatatatatataaaattagccaggtgtggtggcgggtgcctgtaattccagccacttgggaggctgaggcagaagaatcccttgaacccgggaggcggaggttgcagtgagctgagattgcaccattgcactccagcctgggtgacaagagtgaaactccatctcaaaagaaaaaaaaaaagaaaatgtaataggaaatctaatatagacaatataataggcacaatttattctttattattattttttatttttatttatttatttttttgagatggagtctcgctctattgcctaggctagagtgcagaggcatgatcttggctcactgcaagctccgcctccagggttcacgccattctcctgcctcagcctcccgagtagctggaatacaggtgcccgccaccatgcccggctaattttttttttttttgtgtttttaatagagctggggtttcaccgtgttagcctggatggtctcaatatcctgacctcgtgattcgcccacctcggcctccgaaagtgctaggattacaggcgtgagccaccgtgcccggcaattattattattttttaaaagacagtctcgctccgtcaaccaggctggattgcaggagcacaatctcggctcactgcaacctctgcctcctgggttcaagtgattctcctgccttagcctcccgagtagctgggactacaggcgtgtgtcaccatactaagctaatttttttgtattttagtagagacgggggtttcaccatgttggccaggctgctctcgaactcctgacctaaggtgatccacccaccttgacctcccaaagtgctcggattacaggtgtgagccactgtgcctgccctagtaggcataattttaaatatttgaagatgttgaattaactgagtgagacttaaaaaaaaattttcaggaaatttcagaatgctctatgtcctcgttgccattgcggctgcctttctcaagaatgcctggcctaaggagcgggtgctggtcctgttcctcaccatcgggggcctagctataaatctgaccccagtctgcccctataccatgtactccaccaggatcaactaggccacgccccacaacaacccagtgcccctccgagatgatgggaacatgctggacatgcccagccacccccaaggcccaagcatggagtggttgaagaaactgcaagcacttccattgacatggagaagaccatgtcccctgtggcccccaataaaaatgtgacccccccgcctccgaaataaataaatcattcagtttctgaaaagtgtttggtaaaatgtgctagacttataaatagaataatacaatttgtaaagtgaacttaaaagcttaagaatgaaataactttttactttgtaggcttaataaatgaaacccttgcccacttttctacaggggtgttttgttcttacaggttttcaagtatctttaatagtytgaaggaagagtgaatacattgaaaatagctggagcaaaacatctggagtcaggctatgatttggcatgctaaatcatgctgaacttggcccattatcttgaagggaggaatagaaaaaaaaatttaaaaagagaaacacaattgcatttgcactttagagagaacaccctgataactgtgaggatctagttggcagaagggcgactacagtgtaatcacaacagggatggagacaaaagtagacatctcagaaataaacacagattggatgtagggtgcgaggcaaggagcctggggtgttcccactgggaattgagtacttctgtgaatagagaatatagcaggagcagggtcagtatttgacacgtgggatttgaagtgtctgccctatacacaggtgaaagtgttcattagctgaaaatactgagggacttccagacgatctggtctggtgatacatatcgaggggtcctcagcagttataggcgagtgtagaaaagattactgagtaggcaaagaataaacggaagagggccgggcgcggtggctcacacctgtaatctcagcactttgggaagcagaagcgggtggattacctgaggtcaggagttcgagaccagcctgatcaacatggtgaaaccctgcctctactaaaaatacaaaaaaagtagttgggcgtggtggcgggcacctataatcccagctacttgggaggctgaggcgggagagtcgcttgaacccgggaggcggaggttgcagtgagccgagatcgcgccactgcactccagcctgaacgactgagcaaaactccgtctcaaaaaaaaaaaaaaaaaaaaaatgccgggcgcggtggctcacgcctgtaatcccagcactgtgggaggccgaggcgggtggatcacgaggtcaggagatcgagaccatcctggctaacacggtgaaaccccgtctctactaaaaatacaaaaacttagccgggcgcggtggcgggtgcctgtagactcagctactcgggaggctgaggcaggagaatggcgcgaacccgggaggcggagcttgcagtgagcccggatcgcgccactgcactccagcctgggcgacagagcgagactccgtctcaaaaaaaaaagaaaataaaaaaaaagaaagaaagaaaagaaaaaagaataaacagaagagggctgcggacagaataccgttgaataccaatatctgaagggcaagccacaaggtgcagggggcagaggcatccctgatacgggaaaagagttattttaaaaagaacttgcaaagaacaatgtcaagggatcyaaaggtagggaatttggacagagttcggctttagcatccgcatctcaaatacctgggtacctgggtaatctggtgactgctgccgaatctaagaggactgaggccaggttgccaaactgcggagagtggggttggagggctttcatggcagtttggggcctgcttgtgtccaacaagacaacctgggtcacctcaaagggtgtcttctccaaatattggtgcagaggttagctgggccggcaagagaagggagatgacccactattttgatttcaggcagcagacaccggcagcctttcggttagagttgcggatagggcagtggccttgggggcggggctataaacctgggcgggcattcccggcagggcaagctcagcgtgagcccgattggaggatgggctctaccttcttccttccgcctacggagaccatagcgggatgcagggcggggccgggctgagggggcggagttaggggcggggcacggtgactctggccccgcctctttccggccgctcagggcggtgtcgctggggcggtgccgctggggcggggcctgcggggtggggctgacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctgtgagtgcggggctccgcggcgcgggggcttcgggctgggctaattgcagacgaggcgcgattttcctgggggctcggccgggcgggtggggcagggcggctgccggcagctcggacccggaagagccgtcccggtggggcggcgggcggcgggcggggaggcccctggttcgcgccccctcggggtccgaggcggcggagaggacccccgaggcctcccgccttagctggggccgcggtagggggagccccacccagcgcctctcgccgcccaggctcggccgagattggggaagacggcctagagtgaggtggcaggatgaccgcgcagggcgtgtcccggggattgggggtctgggtacgcgggctctgcccgtttcgtggaaaggcgctgccctagtgttgcctgcggggtagacccaagggatagaccagggtccagacctgtccggtcccaggctagctacgaggtgccgtcctgggcaagtcacttcagttttctcgggcttagttccctcctcaagatttcaaaagtaaaatagtaataaagaaaaaaaaaagaagcagaaaatcctctgacttcctcattttctgttgtcggccctggacgtcattgaactgcaggcaggattggctaaaggaggaccctttgggattttgaggttttcggttttattttatattgtgggaataatgttcttttttaaaggatcaacatttcacgcatcaacagttatacgtgaggtattgtgccacgtttgtgaaattaaagatgagtaagatcaggccctgtctccaaagagcgttttaatcagagagtcaggtgtgcaagctaatgattataaggtgcaataatgataaaagatgctgaacttactagccatacagagtaatgtaggtaaggagaaggggcctggggaagacagtatgagcacgggaggtgacttttttttttttttttttggagacagggggtcttgctctggtcgcccagcctggagttcagtggtgcaatctcagctcactgcaaactccacctcccaggttcaagcgattctcctgcagtctcccgagtacaggcgtcggccaccacactggctaatttttgtatttttagtagagacagggtttcactgtgttggtcaggctggtctcaaactcctgatctcaaatgatccccacgcctcgacctcccaaagtgtgagccactgcacctggcctgaaggtgacatttgaacagagccttgaagaatgctgtgtagaaagtttgacaggtggccaggcatagtgactcctgcgtgtaatcccagcactttgggagtccgaggtgagaggatagtttgaggccttgagtttgagaccagcctgggcagcacagtgagactccatctcttaaaaaaaaaaaaaaaaattagccaggcgtggtggcccatgcctgtggtcccagctgcttggggctgaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttgggaactgagtgatgtagactgcacagtggtgggaggaagggaagaggagagtttccaaaaatagttgggaccagactgggaaaggccttgaatgccttcccaaggagttaggaatttattccacacctggtgcccatgaaggaagcagattgcttcaaggttaagctcaggctttggagacagactctccaggtttggattcaggccctgtcacttatttgccatggggctgagttcacccagcctcagtttcttcgtctgtaaaataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatkcttcatgaattttgatttatatatgaattgagtctcctcctcctatgacctgcrgagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaacaagtgtgtgtgtatgtgtgtattttaattctgaaaatcttaaaatgctacaagaaagtccagagaacagtacaacaaacatcattgtattccagaactaacaaatgttaacatttgagatatttccctttcctctaaaaacaaaacaaaacaaaaccaacatcgctacatttaaagtcttttttgtgcccctctggtcccattcttccttctcctggggcaaacactaacctgtattttgcatgccctcttgtgtctaggcttcttttctgagcttaaaacttccaggaaactggagcttgggtttcagtgatgacttaagtgaggaggataacacttgtctttctaaataatagaagatgacrtagcaaggcatgctatatcactagaaaagggggcattttctcatatgaagtttataagaaaacaaaaactgtaagatctctgccatttaaattgtggatttcaaggtttggaaggtcaaagaatttggaagctgcagctgttctgagagaccatcttgtgctctgtggagctttggtgattccactgaggtgacctgggggtgagagggaagagcttcaacacaccttccttcccccatccaaagtagctctgcttttgttttactgttgaatttcttgaataaaattcacttgttacagagggtgttttggctaacacctcccctcccccaaacactaccaataactagttcaactgctaatctagttcaaccatctcatttaatgaagaaactgaagcctgagttttttggtctacttgtagttttcttgattgaagaatgtttctatctttttttttttttttttgtacagtctcgctctgttgcccaggctggagggcagtggcgcaatcttggctcattgcracctccacctcccgggttcaagcgattctcctgcctcagcctcctgagtagctggaattacaggcatccgccactacgcctggctaatttttgtatctttagtagagactgggtttcaccataatggccaggctggtctcaaactcctgacctcaggtgatccgcccgtctcagcctcccaaagtgctggaattacaaacgtgagctgctgtgcctggcctcatcatttttttaactatggttgttaaccaggtgtgtgcattagaatcacctggggaacttaaaaaaaaaaaaaaatacacctatctgggccctaccatagagattgtggttcagtaggtcggggtgggagatccagacacatagtagtcccttggtatctgtgggggtttggttccaggacacctgcagatatcagaatccacagttgctcaacttccttatataaaatggcatagtatttgcatataaccttagcacattgcataatatatacttgaaaacatctctagattacttatcatacctctagattactctagatatatctctagattacttatcatacctgatccaatgtaaatgctacataaatagttgttacactgtattgttttatttatatctttctttatttttttctgactrtttttgatccatagtttgttgaatccatggatgcagaacccatggataaggagggccgactgtattttaaatgtctctagtgattccgatgctccttccttggcccccactcctccccctgttgagaaacaagatttaaaactctgccttatgctgggatatcatgacctcagyagaatkttacacttcatcctatttcttcatcaggttctgcattagccaggcattttattttcagctactctagagcgtctttttttctgtcaggtgtttttttccagtataggaaagtagcccatttcctttaaagaccacccagcaggcatgatcccctgaggtgttttttwgttgagtgcttttgcatacttaaggagtaactgacctggcccggtggctcacgcctgtaatcccagcactttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctattttatggaggcaatcataaaactgggtgtggtgatttttgttgttgtttaaggctttgattttaaaaaatcaaggttggaagcacctatttagattgtaaactagagaggacaaaggaaagaagcctgggaatgttatggtgagaaaagaggactagaatccctgtcagccacctatgtggctgctgccacccctaaaaagtgttgtgagtgcaccaaggacaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttytactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtrggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtataggagcaatgaataccgtttcactcagttgaaggaggtaacatttaaatatgtgaggtatgttcagtgcttaggtcttggacaggaggaagtaacagatcagaataaggttcaggtgaaaagaaccaagaagagaacgtgtcaggcaggacagaacagggaattctgcaagtgagaagaaagtacgattagtactggaaatggaagaaaattcagctaggttaaaggtcacaggaagaaagttaattccagcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccmcggtgataagtcgagcttagcactaagtagaagtatgtcactttctgtaatttagaggaattgaaaaggtatcttggaaagaaattagttcttgggaacaaagtcttttttgtgcatatgtctttactgttggcayagagcattttctgggatgggctcttcagatctcctctccctgtaagtgatttcagaattccatgaatgttgggatatgtccaggctggcaccctgggatcatgaaaatagaagttaagacattyaagaagcaagaaaacaaaatgggtaggtgaggtgactaggaagaatatcakgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtggcactaggagctgatccattcatttatttataattaccaaggggaagtatggggtgagatttattcttaactcttaaaatggtgacatacactattttaagaataaacctccattcttttttcggatattaatttagtgcaacggccttggacaggctccaccataagaagtgggttgcatttaaaagtgtatttattaaaagtggttgaagctgagtgcttttctgtattgtaacactgttgcaaatggggagtattcattcctaatgtggctgccgaaagctttttaccctaccatgtagctgaaaatttagcaaaaaaaattttttttttttttggagacggagtctcgctctgttgcccaggctggagtgcagtggtgcgatctgggctcaccacaacctctgcctcccgggttcaaacgattctccttcctcaccctcccgagtagctgggattacaggtgcccactgccatgcctggctaatttttgtatttttagtagagatggggtttgaccatgttggccaggctggtctccaactcctgacctcaagtgatccacccgcctcggcccccgcaaagtgctgggattataggcgtgagccactgcacccagcctagcaaaatttaaaattaagaaatgtaaagagttgaactagttagtacccattattattaagaaaagtcatgtggctctatattctcatagtacgaataattaagtaaaatagaaattcaaaagtatgaataaaatttctttgaaaatcttgaatgttgagatatcttgccacagtgaaaagaatcagactttctgttttggcaggtgtgagttctgattctggttttgcaagttgcttaacgtcagggagtgagcccaaatttgtcctttgcagaatgggaacgctatgcatcttacagagctgctgtgatggttaattgcttggcacagtgaaatacagtaggcactcaacaaacttttttttttttttttttttttttgagacggagtcttgctctgtcgcccaggctggagtgcagtggtacaatcttggctcactgcaacctccgcctcccaggttctcaccattctcctgcctcagcctcccgagtagctgggactacaggcgcctgccaccacacctggctaattttttacatttttagtagagatggggtttcactgtgttagccaggatggtctcgatctcctgacctcgtgatccacctgcctcggcctcccaaagtgctgggattacaggcgtgagccaccacgcccggcctgaactcaataaacttttatccaagcacctggataaaggatatcctgaattttttcttttctttttttttttcttttttttttttgagatggagtctcactcttgttgcccaggctggagtgcagtggcactatgttggctcactgtaacctctgccttctgggttcaagcgattctcctgcctcagcctcccaagtagctgggattacaggtgcctaccaccatacccagctaatttttgtattttttagtggagacgggggtttcaccatgttggccaggctggtctcaaactcctgacctcaggtgatccacccgccttggcctcctacagtgctgggattacagacatgagccactgtgcccggcctcctgaattttcacattaaatctgcaaaaggaaaagcagatttaatgtgaagatgacaggaattttctgggcactttcaaggtcctaaggttggtagccctagttttttcacttcagaccttagcttttatctgaaggaaaacaccagaaacagaagatacttctagggagtggaatgggggtagagggtgtgagatttcctttttacttaatactgtactatatatttaaaatgctttttacagtgataattttataataaaggaaaagaagggattaagtaaaaggaaaaactgtgtatataatttttagatataatcacaaattcagatttttaagttactacacagatgttcctcgatttaggagggggttatatcccaatattgtaagtcaaaatgcatttaatacacctaacctactgagtatcatagcccagtccaccttaattgtgctgagaatactgatgttagcttacagttggacaaaattatctagcacaaagcctatattacaataaagtattaagtatcttggctgggcgcggtggctcacacctgtaatctcagcactttgggaggccaaggcaggtggatcacttgatgccaggagttcgagactagcctggccaacatggtgaaacctcatctgtactaaaaatacaaaaaacattagttgggtatggtggcgtgtgcttgtaatcccagctactctggaagctgaggcacaagaatcactggaactgggaggtggaggttgcagtgagctgagatcacgccactgtactgcagcctgggtgatagaaccagacattgtctcaaaaaaaaaaaaaaaaaaaaagtgaatataggaaatcttccttgaaaaaacaaagatactcctacctcagcttctcaagtacctgggactataggcccacttcacctcacctaactaattaaaaaaaatttttttttttgtagagatggggtttctctatgttgccaggctggtcttcatctcctggggctcaggctatccttcgctaaagtgctgggatacaggcgtgagcagccacacctggcctgtattgtcttaatttactattttcagtggccatctaatgttcataatttatttaggtttattcctgtttaaagttctattgctttgattgctggagagtttaaacattttcttacatatttgtttatcagtattattttcttatgcaaattttctgtttttgttatgtgcctggcttctagggtcatgatgttaacttttgtgagctcttttataacatggacttgactttctctcgtatttgctacaaacattttcccttgatgtttcattgtatttgttttcttcattgtagttttaaattttattgagtttaaatgtcagtctttcgatttgtaatttcttctatcaactcgaagtctagatagtttaatttctctaaaaccttgccaaaattttcagtttaataatcgattggcttactttttatatatttgtagagatggggtcttgtaatgttgattgtaaggggaacttatcccgaacttctggccttaggtgatcctcctgcctcagcctcccaaagtgatggaattacaggcctctaatatcctttaaaaaccagctgtttattacctattagcaattcatgtctgttttgtcaaatattatgtatatatatatttctagttctggacttttaaattatggtgaaccatatttcatttttttgagaaaaatatatatgactttgttatacttcttatcattgagaaacaacatctgaagctagcttaattttaactctatgacaagtaacttgatttttttttccttttttcgtgacttgaaatttgtagaattgttgttccttgaggtataaacatttccccagttaacatgttagggttgctattggcttagcaattttgcctgcaatgtggagactcttcttggtttataatgtctcttgtttgtttattttagctttaggaaattgtccattatgcctgtggtgattagttagatctgtgtagtctattttatggctcttcttcattttgtttacgttaaataagcgttctaggtatgtgtctcacatacatcttttgttgcactgacttgattttctacagtcttgatattttttccttggttctgttaatggtagttgctttgtcctattgtagtttatatttttaattaattccttttccgtctccattcttgttaatagcttaaatgatctctttttagttcatgaagaagagtgtggcacaaaagatcctttcaaggtgaaaaaaaggagcaggtagccaagatagttgggttacatagtttaccacttccctttataatccgtaggtgttgaaatagatgtggccatgaaaaaccagtgttaatcgggcagctgagtgtatggattgtccaccagtcaaggttggggaaaaaatctggctgggctaagtgtggcccgttagtttgacctcatttggcatgtatttcttctggtcttacaggtcagagcaactgtttttatatattttaatgtccctaatgacaaaatagtaaaaatacatttgaggacccaagttggcatgttctaggaatttcattttccggcttagtgtggtgacctgcctctgattgctgtacaattccttctgcttcacagtgtcacatctggggataccagttggtagtggaacctgttttggacatttttaagccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaattttttaaaaaaatagttgtatgttgggaagaattagttatttcaataaggcattttattctagaaacctcagtactttaaggcagctaaaggaaagccaaaataatcccccaaaacaaaaaaccaaaaacctgcaatttgcaaggcagtcataatctaaaatattttctgtctgtcccaaagtcagtgtattccccttgcctctccccctcttcctcattgtcatgattagtaccgtttattgcatactttctacatgcaaggcactgtgctaagcactttatatgctttatctaattagctattcttgaagccctgtgaggtgcttattatctacatttaacagataagaaagcaaagctcagagaggttaactcattcatctaataagtggttgatccagatttcaggtttggcaagaactctgaagtcctttctcttaactgccatgttagtctgctgctgctatacttctggttctaaaaataatgacaacagtagtaactactgttaattaagcagaatgatgatgaaatttacatattacattattgtgagataggcattatttttattttaaagagggaaaaaaatagagttgataacacttttcccaaggtcatatattggaattcaagcccaggtttgtgacaccaaagctggtgctcttaacttctgcagatgctgaagtggcaacatttaagtctaacctctttaactggtgcccagagacattaagtaacttgtgtagttttcaagtcagtgagggaactccatcaatttcctgccacttattttggagtctcttccacctgccacctgagggaaagtctccagttgtcttatgtatttttgtgtctaactagcttgttggacccttcctaattgcttcccttcttcataacctggtatctgctttgaattcagcttagaaaggtgttccttcctaccactttcttgtttgttaaagagttacctcatacagacaggagtggcaaattggattggaaattgctttggatcatttggcaagaactgtatttttggggttgtgggaggaggagaggcctgtctaaaagctctatttcttctttactcagaataccttcctgttgactcattggaaatcataacaaaaagcagaaggaatattggagaggcagctgccagcctagggcttggcttctgttggggcagctgtttggggatttagacacactgggctctaagaactgtgaggtttctgcagcagaaggaaatagtattactctgataggtatttattcataaggttaaaaagtgtcagactattgcttgggattattgatgagcaacataagaaactaaaaatattttctcaaatagaattaactggtgatcctaaaaacagaatgaattgaggaatacaagagggagtgggggcaaaattagaaaaggaaaagttgaaaagaagagaaaaaaaacttacaatcattaaaaataggaaaaagataacatttaaatagaaaaagtctcacagatatgcatgcagtaggcattaatcagcaggtcattttactgtaagtaacatacatctcagatgacctttaaaacagctaaaagtaaacaaaatttgtcttttatttaaatgactattataacaaaatgtttttttgggctgggccctgtgattcacaccagtaatcccaacacttacggaggccgaggagggaggatagcatcaggccaggagttcatgaccagcctgggcaacatattaagaccctgtctctacaaaatataagaaataaaaaaaagccaaacgtggtggcacacacctgtagttccagctactcgggaggctgaggtggaaggatcacttgagcccaagagttcgaggctgcagtgagctacgatcacactgctgcacaaaaatgtgtttcttccctgaagacatgctatgtcattagtttgggcaataccttttcataattgatagtttaaaaaggtagtgtttgacaatggcttgacttttggggttttccttaaaaatttgagaatccccataggaatgttttttagatagatttggtcttaatttaaaatttttaaatttaaaacatttttttcttagaaataggtaatacacagacgtgatacataattcagagactatgcaagtatataacactgaaaaaaagtctatatccttagtcttctttctctagctattcagttattttccccacatggaactgctatcatgattgtgtctctttccggagatattctgtgcatgtaaawacaaattactttgatttgtttagaagtggttgcacactgtacattttgctttacatctttttgttgttgttttttgagatggagtcttgctctgttgcccaggctggagtgcagtggtgtgatctcggctcattacaacctccacctccagggttcaagcgattgtcccgcctcagcctcccaagtagatgggactacaggcaatccgccatcaggcctggctaatttttgtatttttagtagagacagggtttcaccatgttggccaggctggtcttgaactcctgaccttaggttatctgcccgccttggcctccctaagtgttgggcttacagacatgagccaccgttttgctttgcatcttaaaattcattccatatgagtgaatgtggaatgaagtgcctctttttttccttcacagttttagttttcggttttgaagttaacctgtcaayggacattttctcctcagcttttgctgttataaaaagtcactttgtaggtatgccattgtgcatgtatgagtattcttgcaggataaatttctaaaagtgtaatttctgggtcaaagggaatatgcatatttagttctcaaaaatattgccaatttgctctcgtaagaggttgtaccagtttgcacatctgcctgtcaataatgtacatataagaaggctgtttccgctttaattttaccaacccagagtattacagattttttacatttgccagtttcataggtgaaaatggtatttcattgtagctattttggattatctaattatgagtgaagatgagcatctttacatgtgtttaaaagccatttgtatgttcttttctgtgaactttttcggtagaatcctttgctcatttttctattggattattcatctttttcttattcattgtggtaagagctctttatatattgaggaaattggctcgttgtacaccgtgggtgttataaatattcattccactttgtcctttaattttttttttttgagaaagtctcattctgttgcccagcctggcgtgcagtggcccgatcttggccaggttcaagcgattcttgtgcctcatcctcccgaggaactgggattacaggcgcgtatcaccacactcagctaatttttgtatttttttagtagagacagggttttgccatgttggccaggctggtcttgaactcctgatctcgggtgatccacctgcctcgacctcccaaagtgctgggattacagccaagagccacctcacctggccattgtcctttaaattttgactttgtatttcaaataaagttttaaaacatatttgaacttactaatattttacttttagtttttgaattttttgcatgatttttaaagagtcttatctatactgagattatataaaaacattctcccatgttttcctctagtatgtttaggatgtaaagtgttttaatatttaactctttgatccatttggaatttattttggtgtgaggagtaagatagatcctgcttttttgacttttgaatcgtattttacattttgagtcttagcagtgtcttaggaaatgtgctctggagggtgtcttgtgctctagtttatgaactgatatcttaatttttttcagaacaaggcagcttcaactgttgagctttttgaaacatatggcttaactatcattttagggaatttggttaggattttccagagtgctttcaagcaagttatattgtaatgctaaacagattaatatcgtgtagtaaagttggcgttgagaaaacaggttttgaattaacagctttgacataaagactgtgaagagattactagacttgccaaactaacataatttattctttgtgtaaaggagagtgcaaatttggagtttgaaaaactgtgtggctgactttctagatcagtattttttgaggtatattgtgctgtgacattaaagaaagggtttagtggtgaaataagcttcagaaatactgagttaaaccaagccaaatattattcaagtggcaaattatttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccrttgagttatcctgttcttggcttatagagcttaaattaaagccataattgtactaattggataggtataattgctcagtgatctttaaggcattgcaaaggacgggagtgtggtttttaaaaatgaggggtgcaaatgtactaattattaaaaaggaaaagataaatatgacaaattctggtctagtaaactagtttctggccaaacattggaccagaaaaattccagagcacattgtcagatgcataacttatgaacacttagcgagaaaagtgatgcttgggagccaacatgggctccctaaaaaaagccctgtcacattaacatcatttccttttggacagggtcaccagattggtgaatcagagaaaaacacacgcctggcaattttttgtatttttagtagagacggggtttcaccgtgttaaccaggatagtcttgatctcctgacctggtgatccacccgcctcagcctcccagtgctgggattagaggcgtgagccaccgtgcccggccggggtttgtttttggttgatgaaagtgttctggaattagatagtgatgacggttgtacaacattgtgaatattctaaaagcaactgaattgtatattttaaatgagtttacgttacgaatcgtatctcagcaaaaagagctgcagatttttagttcagagaaagcacttttagggcatgttatttgtaaacatttttattgggacttactagggcgtcagtgatgtgtcagtgaagttaggattttacttgtttctagagagatagttaatatattgtaaggcacattttgctttcaatgtaccgtgaatctaataatgaaattcaatagtaataagtgtgatgtcctacattggagttcaaaaagtgtataggataagggagagaagtagcgttagtgggaataacgttggtgggaaacgaaaacaaaatgaaagaaacctgagaagttcattaactcattagtagatatatggtatatgcagccaaggaaaagatggttccactgtcctctggactaatcagaggcttcctgaaattggtgtttagttctggaggccatactttaagatggatctcgtagtctagagcaaggatgttagatttgtggtaggttattttacacccacagcaagcactgctgatagatcagaatccttttcaacgtagaagctgaggaaccactcccaatcagtgggtgttggttgtccattagttgagacttagttgttgctctgggatgagagcgtgttcgatgagtatgaccaggatgataaagggtctaccaattatgatctatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccrtgttgcagattttcaggtttagactgtgtaacagtttaatggaagattgttatgttctaacctaagtattttctcgttatttaaaaacaatttttatttcatttcctgtgttattaaaaactatttttattttgaatgacttgatactattccattgctcattttttctaacatggctaagaagttgggaaaattcctccaataaaataattactttaaagcaagtaaaacacgtttttagctcctccattgttcaggacactctgggagaactgaagaagatgcgaaagtataaaacagtcctgcccttaggagcttacggattaattgaagacagggcataaacatttgaaaagttacccaacatcagagaatgagaggtctcagtgtcacaaggcaatatgtaattgctgaggaaatgatgcaaatagttaatgtgtgagagtttagacagggaaagattattttatggctgggtttttcaggataagctgacattgtatggtcaggcgtttccctttcaagggaaagcataacactatgtatacttgtcttgttctctgtgctcctttagagttgaagctctttccacttcctggtacccaatggcacctctcaccacagtgctttttacaaagtaggtgcttggggatattgttaagttgaatgagtacagagttgtgtggtatgtgggggttgtggtaggaaaaagaatttcagtgttatggtgataagagcttggggtaattttctgttttggtttttgtttttcttttattatttggttataattgagaccaggagtaatacggtccctaagcaagagagaaagagcagtgtgtgtctttcagtagagtctttctaatttattcaaagataaattagaaaaggattctacccttatgtacataaataactattaggcgataaagagatataaagtgccataagaaagtttagaggaagtttggaacgagaagagattatttctgatggtaggtcatgaaaaggttcgtggaggagaggtgacttttgaaggtaacatttgaattggcagggatgggtggggctgatcacctaaaagttatactaaaccttgtattctttgtgggcatccctgtctctaccttcctgcatcgtggcttgatgacatctattttctctcaaaacttcttcacattttggccctaacaaatttaccccatctcatttaacatgctatcacttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacrtatttttctcctaacacttaaccttctatgtgtgatctagatcctatcccttcttgtcttctagggttcttattccaatattrttttcccaactrtaacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggsttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggccttaatttttacatttttttgtagaaacgggtttcactgggttgcccagcctggcctcgaacttacgaactcaagtgttctactcaccttggcttcccaaaatgctgggattgcaagtgtgagccactgtgccctgcccctatattcacttccttaacttaactcatttggatgtaattcctgtgccttccttttccccattgaaatttctcttgcttagttccaccaacagtgtaaaagtgttcctatttctccacatcctctccagcacctgttgtttcctgactttttaatgagcgacattctaactggtgtgagatggcatctcattgtggttttgatttgcatttctctgatgaccagtgatgatgagcattttttcatgtgtctgttggctgcataaatgtcttcttttgagaagtgtctgttcatatcctttgcccactttttgatagggttgtttgtttttttcttgtaaatttatttgagttctttgtaggttctggatattagccctttgtcagatgagcagattgcaaaaattttctcccattctgtaggttgcctgttcactgtgatggtagtttcttttgctgtgcagaagctctagtttaattagatcccatttctcaattttggcttttgttgccgttgcttttggtgttttagacatgaagtccttgcccatgcctatgtcctgaatggtatttcctagttcaaccattgtggaagacagtgtggcaattcctcaaggatctagaactagaaataccatttgacccagccatcccattactgggtatgtacccaaaggattataaatcatgctgctataaagacacatgcgcacgtatgtttactgcggcactattcatgatagcaaacacttggaaccaacccaaatgtccatcagtgatagactggattaagaaaatgtggcacatatacaccatggaatactatgaagccataaaaaaggatgagttcatgtcctttgtagggacatggatgaagctggaaactatcattctcagcaaactatcacaaggacagaaaaccaaacaccgcatgttctcactcataggtgggaattgaacaatgaaaacacatggacacagggtggggaacatcacacactggggcctgttgtggggtagggggaggggagaggggggagggacagcattaggagatatacctaatgctaaatgatgagttaatgggtgcagcacaccaacatggcacgtgtatacatatgtaacaaacctgcatgttgtgcacatgtaccctagaacttaaagtataataaaaaaaaaaaaaaagaaaaaacattcccaagatcccctcaaaaaaaagaaaaagaaaaagaaatttctcttgctcatatcaccaatggcctaattgctatgtcccatggaaatttttctagtacttaatctctgcagcatatgtcactctttcctgttcaattcatggagttttcttccttttaattgggtatcttttttatgctttttgaatttcgaactgtgtattgaagtattgacctgtgtaaaaaatatattgcctatctaagaaaatcagttagcattcctctgggaaactcacttggccatccatccttaccccaggtctaagttagatgttcctctctcatgtatctttattataacttttctctttcctaatgcactgttagccttagaaggcaagtactacgttctttctttctttcttttcttttcttttctttttttttggagacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttagtaatgattaggctgtagagctgctcacaggttagtaatgattaagctgtagcttctgagacttagctatcatctagatttaactcagttttggaatttcatttcatttcatttaagattaaaaggtctttcatgctccatggtaagtggtaaactagggatggatggatagatagacagctgaccatggtaatgtttcaccagactctggatctgaagacttgatcaaggagtaagtaatctattagccgagacttaaacaaacgaaaaactttattggagtttaatacacatcccacaaaatccacctgtttttttaatgtacaattcaataatatttagtaaatttgctgagttgtgcaacccatcactatgatctagtttccatttctccaataagaccagggactctattaaaataaaacaattagacatgtaattttgacaagtagacttgacctattctatctgattatgctaagaatgaagtgatttgctcaggggtctgtattagatataaatacacacagaagttaaatatataacttgaagcaaaaacatttccctgtttttcacttattcctatagcttttcagattggcctaatttatactcaggtttcctttaaaacagatactatcaagatttctcattttgcttgtatggtttgaaaaacaagccttttttgttccttggctggattactgcaatactttctttagtgtctcctcacttctctctagccctttctcctacaactgctcagaatggtcttttgaattaaatcttattctttaattcctgtgtaaatccttccaagggtctgcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagngagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaamaaaataaaaagacactttcccaggacatgtcaccatctcagactaactccttctccgttccccctagtttttcctcttcctttcttacacttctagaaaaagaagttggctgggtgcagtgactcatgcctgtaatcccagtactttgggagatggagaagggggcggggagggagttgggggttggaagtcaagaatctcttgagttcaggagttccataccagcctggacaacatagtgaaaccttgtctccattataaaaaaagtaataataataaaataaaaattagaaaaagaagcctacatttgctgcctctccttcctacttttagttacttttctagttattttaaatggactcctgtgtcaccactccactaagactccccttacaggagccaaagatgaccttgcttgtgtgccacattcttttctcttcaccacccgcctctctgcagcattgaaagctggtgacctctaccagtttgctgattttttccttccgtgattgccattgtgtgattctctcctggttcttaacttgatcacagacgctatctttgtctctttcacctcttaagtgttggtgttctctgaggcacagtgcttcagcttttacatttttctccacagcctctttctctgtgggcttatctactcttgtggtgccattttccagatttaggtcttcagcaacaggtrtccctcctgagacctgtgtttccaactgcctacaagatgccactgtctggacgtcccgttgacatttcaagctgaacatgtttcaaccgtgaattgctcatcctctccggcttttgtgggtgtccccattcttgtttaatggcatcatcttttatgtagtcatccatgccgcaagtcaccaaatcatcttttaaaaaataagaaaaaaaccttctcttttcgttttatagaagtgtttgtaagtttgctgtagatggtatatggtgccggattttctcctagaattgtgtgtcagaatgtggggcttctcgacacactggacaacaatgttattttaaaaaatctttgctagtctgatagctgaagatggtgatattgttactttactttgtatttctttggttagtagtaagattgagaaattttcttataaattactggctatatgtatattttatgaatttttaaatttgtgtttctagcatatttttctagggaaatgtttgccattttatttcaagtgtttaaaatgtatatacatgtaaagattatggaatattgttagctctttgttatatgttgtgattttttttcctccagtaacctttcctgttaaagttttatttagttttttaaaaatggccttacagaagtttaaatactagccaatttatcttttcctttctgatttctgcttctgtagtagtgtttgtaaacttctttctcattttaagagtatataactattttttcttttttaaaaaattctctaatccatttggtgtttaatgttagttgtgaaccgtgaggtctggagctaactgcttccccaccctccatgccccctgccttttcagtcatctgtgagatttcacatctttcccactgcccttctaatccccgtgcctcatctaacagattgtcaaatggggtcaattctacctttgtaattgttaatcattctctttccaccattgtcccagttaaagactgtattaccactcacctggattaccgaaatgtttgcctgatatttctcccttgaatctgtcgtccatgctgctgtccaagttctccttctaagtctacttgaaaacctcccatggctcccattcctgcaggttagattactaatccagatacttttacacctacttctctaccacagtgacttaccgttccctgaatgtgccatttgttttcagcctttttttttgtcctttgtattatgctgttccttttttgttttttaatttttttatttattatactttaagttccagggtacatgtgcacaacgtgcaggtttgttacataatgtatacaggtgccatgttgatgtgctgcacccattaactcgtcatttacattaggtatgtctcctaatgctatccctcccgcctccccctaccccacaacaggccccagtgtgtgatgttcccatgtccctacaaaggacatgaactcatccttttttatggcttcatagtattccatggtgtatatgtgccacattttcttaatccattctatcattgatggacatttgggttggttccaagtctttgctattgtgaatggtgcygcagtaaacatacgtgcgcatgtgtctttatagcagcatgatttataatcctttgggtacatacccagtaatgggatggctgggtcaaatggtatttctagttctagatccttgaggaactgccacactgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacgccattctcctgcctcagcctcccgagtagctgggattacaggygcccgccaccacgcccagctaattttttgtatttttagtagagatgggagttctccgtgttagccaggatggtctcgatctcctgacctcatgatccacctgccttggcctcccaaagtgctgggattacagacgtgagccgctgtgcccagcctgtttcytaactttttaatgatcactattctaactggtgtgagatggtatctcgttgtggttttgatttgcatttctctgatggccagtgatgaccattttttcatgtgtctgttggctgcataaatgtsttcttttgcaaagtgtctgttcatatccttcccctactttgtgatggggttgtttgtttcttttaaatttgtttgagttctttgtagattctggatattagccctttgtcagataagtatattgcaaaaattttctcccattctgtaggttgcctgttcactctgatggtagtttcttttgctgtgcagaagctctttcgtttaattagatcccatttgtcaattttggcttttgttgccattgcttttggtgtttcagacatgaagtccttgcccatgtctatgtcctgaatggtattgcctaggttttcttctagggtttttatggttttaggtctaacatttaagtctttaatccatctcgaattaatttttgtataasgtgtaaggaagggatccagtttcagctttctacrtatggctagccagttttcccagcaccatttattaaatagggaatcgtttccccatttcttgttttggtcaggtttgtcaaagatcagatggttgtggatatgtggtattatttctgagggctctgttctgttccattggtctatatctctgttttggtaccagtaccataccatgctgttttggttattgtagccttgtagtatagtttgaagtcaggtagcatgatgcttccagctttgttcttttggcttaggattgtcttggcaatgcgggctctttttkggttccatatgaactttaaagtagttttttccaattctgtgaagaaagtcattggtagcttgatggggatggcattaaatctataaattaccttgctcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaagtatttttatgctgttcctttatgttacatgtctccttttcccatttttcactattggaaatagaatttatttgagcaaagcctagttcagatatcatctcctattgtagctagctgttaaagcataactgttaccagagagtaattcccttgaaggtgctgactggtattcagcacaacgttataccactgataagtgttccacacagtagtcagttcgaaatgtttcctgaatgaatacgtgggtgtcagaatagacacctttttttttttgaggaattgacttaaaatacttaggaaaaaaactttaaaaaatagaataaatatgaaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatccyaggaggttgaggccacagtgagccgtgtgattgggccactgaactccagactgggtggcagagcgagacrctgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggctcacgcctgtaatcccagcactttgggagggtaaggcaggtggatggcttgagcccaggagtttggaccaccctgggtaacatggtgaaaccctttctctacaaaaaaaggcaaaaattagccgggtgttgtggcacatgcttgtgaccccagcttcttgagaggctaggtaggaggatccagaggatcgcttgaaccctgaaagtcaaggctgcagtgagccatgatcacaccactacatagactctgtctcaaaaaagaaaaaaaaaaaaaaaagccagagtatgggcttcagaatcacaccaacttgggttcaagtgagagtttacttgccagataatcttggaatatactttttggaacccacagtttatctgtaaaataattacaataatacttcagaggttgttgcaaagattgagataataatgcatgtaaagtatttggcttcatgtctgccacatggtgtgaagattattttttaagtgtcatttatattgaaaatgagtcattytatgttacttctttcctgtttagtacttgtgtttcagatctgacatcacctttttaaaaattttgcatttgantgagatttgctaaagcagttctggggttaaacttgaagagaaaatattgaatatttatatttaatatcccatgtgagaggagagattaagaaccctgttgtctgcttgttacatctcttgtgaaaaacataaaaaatataagagttttgttactgaactctacttgtggttttggtcgagtctatcatgaaggtatgttgtggagattagtgcaaataatgatttaaatatggaattataaagtttagcagctctatattcggggaaaaacgagtctctgttgattgaaaaagcataataaaataatttattctgaggctttgtggttatgcagtgtcagaatgaaaaagatgatactcctgttccatttcaggctggtcagaccatacctggaacacagtgttcagttggagaaagttcagagatgagcaaaagacgtgagggggcagagatgatgtctaacactgctaatataatacctggtaacgttttgagtacttactctgtgccaggcactgttcttagtattttatatgtactatcatctctttaatcctcataaacattctgtgggtaggtgctattattattctgtttttatgactagtgcttgaaggagctggaatcattttacttatggaattgtcagcatgtgactcatcatgaggggataggaggaaaggcacaaatatttttttcaatacccagccaagcactgtgctagctctatttcacttgcaatcttatttaatcctcaatgacaaaccttggaagatcctgttagccttttttaacaaatgaaagaactggtcaagtggcttgctgtctttctcggtaagtgcsagagacaggacatggaaccagatctttccaagtccatggccagtgctactcacattatgcttttatttttacgttctcttgctccaggaggcagcttagggtgccagtagagaattgatgccggcttagcaaaaaccttctgactactggagtccagaaatgaactaggttaccttgaatgtttgattctctgtcagtattcaggctcagcctgcttcctgatttggctgagatgttttgggaacatcaaattggggatggagtagaacatgtgaggggagtggaggaattgagatgggctgaaagatctttaatgagccttccatccttgagattctatgattattgctaggacagggttaaatatgagaattggtgaaaagttgtgttggccagtgatttttcttttgtgcatagattgattgattttgagacaagagtttcactgtcgcccaggctgggaatgcagtggtatgatcactgctcactgcatcctcaaactctcagactcaggcaaccctcccacctcagccatagttttatttttaaatgtctttataggccgggcacagtggctcacgcctataatcccagcactttgggaggccaaggtgggcggatcacttgaggtcaggagttcaaggccagcccggccaacatggcgaaaccccgtctctactaagatgtacaaaaactagccgggtgtgctgatcccagctacccagaggagacgggagaattgcttgaacccggaagccagaggttgcaatgagctgagatygtgccattgcactctagcctgggcgacaaagcgagactccatctcaaagaaaaattttttttaataaagtcttcataaagctaaatttataaaaaagctagaggctgggcgtggtggctcatgcctataatcccagcactttgggaggccgaggctggtggatcacctgaggtcaggagttcaggaccaacctggccaacatggtgaaaccccatctctactaaaaatataaaaattagccggttgtggtggcacaagcctgtaatcccagccacttgggaggctgaggcaggagaattgcttgaacttgggagacggaggttgcagtgagctgacatcatgccactgcacttcagcctgggcaacagagcgagactccgtttcaaaaaaaaaaaaaaagctagagatatggtttagcagctctatatttggggaaaaaaggagtctctgttgattgaaaaagtgtaataaaataatttaagctgaggctttgtggttatggagtgtcataatgaagaaggtgatagtcctgttccatttcaggctggtcagaccatacttggaacacagtattcagtaggagaatgaattcagccaggtttgtttgtttgtcttttaagacagasacttgctctgctgttgcccaggctggagtgcagtgatgcaatctcagctcatgcctcagttttccaagtagtggctgggattgcaggcatactccaccacacttggctaatttttgtattttttgtagagacggggtctcaccctgttggccaggtttttctccaattcctgacctcaagtgatccacccgcgttggcctcccaaagtgctgggattacaggcgtgaaccactgcaccggttctaaatatttaagttttataagaaaggttttgtgtctaagttgagaatcactggtggatttagttaagctaaaatacctttaattattaaaaagtaggcagaatgtggagagataccagcctttttccttcttggtatttctgcgatttttccctttttagacagcctgtggagctcaaccccttttggcttttcaggtgatatagtgagagcaagagtgatactgtgaggaggattctaaacctagcaatcagtcttgttattccatctttgccactagctattggatgaccttggatcagcctcattcttatttgtaaatgggaggaagtgcaaatagattattagcctctgagcaggcttgtggccagttagattctttttcaatgtttatatttttaattttggagttgtacttctaaggacctttactaaggaattaattctaaataaagaagaacaccgtgcacaaagatattccttgcactattatttaatggttgaaaacatttagaaatgacataaatgtctaagataggtgacttattaaggacttggttaaatttttatgtaaacttaaagtcttcagaaactatataataacatggaaaatataaacatttcagaaatgtttaataattgtctcattcatatatatatatatatgtatatatatatatgtatatgtatatatatatatgtatatatatatatatatataatktttgagacagagtttgtatatataatttttgagacagagttttgctctgttgcccaggttggagtatggtggcacgatcataactcactgcagccttgacctcctgggctcaaacggtcctcctgctgcagcctctcaagtagctaggactacaggcatgtgccaccacgcctggctaatttttaaattttttgtagagacagggtctggctgtgttgccaggctggtcctgaactcttgggctcaagcaatcctcctgccttggcctcccaaagtgctgggattacaggcgtgagctactgtgcctggccatttttagatatatattatattaaaaacaaacaaagggattttccctagaagtgcatttgcttcctggctctcaggttttctgattctgtgatttagtagaagaaggggaaatctcatgtgagctgtagagaaagactgaaagaagtgtttgttgtgtcatcttggaattcgagtagaatccaaacttctgctaacattaaaaatgttaacatggcactttacttttcaaagcagtttggtcctgatttgttcgtttgtgacagggtttcactttgtcaccccagttagagtgcagtgccaccatctcaactcactgcagcttctacctcccaggttaaagtgatcctcctgtcttagcctcccaagtatctgagactataggtgcacaccaccacactggcaaatttttgtatttttagtagagatggggtttcgccatgttgtccaggctggtctggaactcctgacctcaagtgttcggcctgccttggcctcccaaagtgctgggattacaggtgtgagccactgcatcctacctagtcctgatttattttataaacaaaccaggtgatactccattgtgaaatagctcagattggtgggcaagccacatatgtggtgaggtgacttggaaggcagcttcaggtttgagcagttgtttagaaacaatgtattttgcctccctgtttattctagctcattctttctntttaataactttcaccaaatcacagttggcctttcttctctgacctgacacctgtgttatataaagagcattctacccagctataggaaacatctaagtcaggactgttttatagcagttggactagggaaaggaaatataaagaatgctgggagatgttaccatgggctctccttttatttttgtctagaaatctcagaaaagaggaaaacctaaatacctctggtaactggctctgattcaaggcaaaagtatctactgtgctctttatccgtagttttccctgtgtgtttacttcattttaaaaagaaaaataagtaactttttttttttttggtactgttacgtgcttgagggccatttttggcttaggctgaggttgttaggttttcactgttaatgagaacccaagttagattgtcccctgagagctggagttgccagtagttgtttgccagaatgattttatcaacatcctttttagcagtaaaaagatgagatgtgtccttgaactacactattttccgtaccgacaactgccaatcttttccacattgccctttgcatctttaggctgaatagaggtatagtttagatttttgtagccatttcaaattggtatctcatttattatgacaactcttctggaaaactcatttgtttcatttttcccctttctgacaatttaagttctactatttgaaagaaagaaaagacagcagagaagcttatcatcgagtataggaaacaaccagaaaattatctggcccattcatatacccatcaggcttcatgtgttagagagtacgctgcctaatttaaaggtagagtagatttaaaagcaagactgagctgggaacggtggcttacgcctgtaatcccagcactttggaaggccgaggtgggtggatcacctgaggtcaggagttcaagaccagcctgaccaatatggtgaaaccccatctctactaaaaataccaaaaaattagccaggtgtggtggcacaggcctgtaatcccagcaactcgggaggctgaggcaggagaattgcttgaacccaggaggcagaggttgtagtgagctgagattgtaccattgcactccagcctgggcaacagagtgagactccaacttaaaaaaaaaaaaattgagtgaaataattttaaattaggagttttaaatctagggttcctagagtcaatgaagtctctgaaattacatgtaaaatttaagtatatgtatatttttccaggggaaggttctatagctttccttcgatattcacaggattctgtggctcagtggttgaaaactgttgccatggtccgggtccagtggctcacacctgtaatcccagcactttgggaggctgaggtgggyggatcacttgaggtcaggagtttgagaccagcctggtcaatatgacgaagccccgtctctactaaaaatacaaaaattagctgggcatggtggtgcatgcctggagtcccagctactcaggaagctgaggcaggagaattgcttgaacccgggaggcggaggttgcagtgagctgagatcatgccactgcactccagsctgggcaatagagtgagactttgtctcaaaagaaaaaagaagaaaaggaaaaaaaaaccattgccataaatgatctttagttacctatgtttccgttggtagaaaatacatgtaactaaactttcctttgttttatcttaggctttcttgaaatgtactaagagatatttgaaggggaaaatacagttttctttttttctttgttttattctttttctttttggaaaatagttttcttttcctatcctttttacaacctcctccctgcctccaaaaatctgagaattcattatttactgcttccataggagtttcttttaatattttagctgaaataattgagtctgttttgataacccccaagcaaccttaaaacttggacctagaaattcactgtggattctgagttctgcaactggaagagaatgtcagcaacaaattaaagcttctgaacagttgaaarggtggcttcagttaccaatggcttttcttaggatttgttaaagagcaacttaaggactgagggaaagggtctgaggttctgggagcagtcaggatctggggagccagctggctgtgttgctgcagcagaggaaagtggggtggagaagaaagtggcattratgctcaggaattttcctaagttccccgcctctgagatctgactgggccaggcagggwaaggatgtgtgtggaactgattgtaaaagagtgctattatgttcagtttaagcttctccaaggagaatggaaataaagcttaaaatctctaaggaaaagttctgaccttccctttctttttttgcatcctctctcctttkgtgcaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggtgagtccttccttgctttgtgcttagatttctgtcaacttgagaaagttagcatgttttattttgtgtaagagttattgagaagtctgtgtaaggtgtgtttgttgcaacaaattatagcctttaaaatgcctggcagaatggagaaatttgtgcaaaggcaatatgtactaggcaaatattattacatctcttttagaatttatctggaaagcccgcctcccccctaccctgtccccccacaaaaaaatatgtactaggaaaagaactttagctgtctttgtttctggtagaattcttatgatgttatatatctagaaattttcctagttgtagatgaattttttaattctttagaaggtagaagaaataactaggggaattaccactttaaatctagttttggggccgggcgcggtggctcacgccggtaatcccagtactttgggaggctgaggtgggcggatcacaaggtcaggagttcgagaccagcctgaccaacatggtgaaaccccgtctctaccaaaaatacaaaaattagccgggcgtggtggtgcatgcctgtaatcccagctactcaggaggctgaggcaggagaatcgcttgaacccgggaggcagaggttgcagtgagccgagatcatgacactgcactccagccctgggtgtcagagtgagactccatctcaaaaaaaaaaaaaaaaagaaagcctaattttaggctgggcacactgattctcacctgtaatcccagtacttggaaggccaaggtggtaggatcacttaagaccaggagtttgagagtagcctgggcaatataatgagaccctgtcttacaaaaaaaaaaattagccagacatggtcacacatgctgtagtcctggctacttgggagactgaggcaagaggattgcttgagcctaggaggttgaggctgtagggagttagtattgcgccactgcactcccacctgtctcttaaaaaaagaaatgaattttaagcactgagatttgttggcaaattgaatgcaaaagtaacttcatgaaaaaacatcaccctgcgttgctggagttcaaggtacaatgggaaagtgattcagtttcagaaaattgagataagtgagagggtttgattcctgtatctcaaggtgctataaaaaagaagactgactgcttaattaagttggaatgttgggccaggcccagtagttcatgcctgtaatcccagcactttgggaggttgaggcgggcggatcacttgaggtcaggagttcaagacaaacccggccaacttggtgaaaccccatctctactaaaaatataaaaattagccaggcttggtggcgcacacctgtaatcccagccactcaggaggctgaggcaggagaatcacttgaacccaggaggcgggggttacagtgagctgagatagcaccactgcactccagcctgggcaacagagcaagactctgtctcccaaaaaaaaaatggggatgttgacaaggaccaaattttcttgtctacagaggttacctgtgaayccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggwcttgctgtgtcacccaggctagagtgcagtaatgccatcatggctcactgcagccctgacctccctaggctcaagcaatcctcccacctcagcctccctagtagttgggactatgggagcatgctactacaccaggctaatttaaacaaattttagtgtagagatgggggtctcactatgttgcccaggttggtctccaactcctgggcttaagttatcctcccaccttggcctctcaaagtgccaggattacaggcatgagccactgtgcccagccctttgctcagttttgaatacacagttattctgaagacaactctggagctattctgtaggcagaatgggaagatagtgtaaaaggagagcggagactctgcagcaacaataaaaaaaaaatggctgggaggagtggctcatgcctgtaatcccagcactttgggaggctgaggtgggagccctcacttgagtctaggagtttgagatcagcctgggcaacaaggtgaaacctccgctctacaaaaaatagaaaaacaattagatgggcatggtgacatgcactcgtagtcccagctactcaggaggcaaaggtgagaatatcgcttgagcccaggaggtgaggctgcagtgagccgattgtgccagtgagccgattgtgccagtgcactgcagcctggacaacaaagtggagccctgtttcaaaaaaaagcagacattgaagtttagaggggatatctgtatatatagaatgaaagccctgattgattttttttaagacagagtctcattctgtcgcctaggctggagtgcagtggtgccgtcttggctctcactgcaacctctgcctcccaggttcaacgattctcctgcctcagcctcccgagtagctgggattacaggtgtgcaccaccacacctggctaatttttgtatttttagtagagatgggatttcaccatgttggccaggctgatctcaaactcctgacctcaggtgatctgtccacctcggcctgccaatgtgctgggattacaggaatgagccaccgtcccagcgtggtatttttatacagcattttgtgaacatctatgtattcagacaccatactaatttgttcatgtgcattatctcacttagtttttatacatacaaagcagctgttctagatggtaaaactctgtccctaaaggatgaagtggcttttccagtgtcaccagtagattactaagccagtaattgaatccaagataatttaactccaaagaccacatgttctgttgagcacactatacacaagaaggctctccaggtagttgctaagtgagaggagctgagatgtggatttggctttttggtattggaatgtgagcataatgacatcaaaattaaggaaaatttgtcaaatctcttgaggaaacttttgcgaagagagtttttatttaatatttgcttcaatacagccaataatacctaattttcttttttttttctaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctcatacctgtttcatcttaccctagagaaattccctgtgatgatatctacttttactacatcaaattgtagacttacattttactatttttccttagatagaattcacatgctgtgagattcaccattttaaagaataccaaatcagtggtttttatttattcacaaagttgttaacattaaaatttgacctttggaaatataaggaaatattttagaaatctgtagggagtatgaagggtcattttttattttaaattgtagaggtggtagaatgacgtttacttcctggatctgtttttggtcatggctgcagttttgtttggagtgtacatcttctgggtgttctgctcaggagtttatttagtgttgctttcagtgaaattgccatcccagtcctgtctgaatctataactgccacactgtatggtcactcttagagacatgaatggattgattgatttcattctttcttttgttctcatttttttctgtttatatcctttgacgtaagaattccgcttctgggaagttatccgaagtaaataatcagaaagcaccaaaaaaatgtatacagaaggattttttagcattgattatgatagaaaaaattgatagcaaagtacatgtttctttacaaggggtattaattgtgttacagccaaatactagtgccatttaaaaggatatcaacccaagtaaagggcctttgatgtattaagtggggaaaaacggttgaaggttataggagtttgtgttctagctaagatcagatcactatttttgtgtaaaaataaagtgagtgttcttgggaaaaatttgtaaggagataaaatggttttcatttctgtgtgatgggattaagggtggtttttattttccttgtactttcctgtagagttcaaatttttgtaaccaaaggaaaatttattttaaaaaagtgaggtgtagggtatcagaaggtggctaaaaccattttwtattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatmcaatatataattacatattgtaatatataatcatatatmcaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgtcaagttcttacagctacgtggcctgtctgtgcacctgtaatttcctttccctgttttttaatatagtataaaatactgtgctatatagtgtaaaatattacactgtgcacctgtaacttcctgtttctgttttttatatagtatattgccagtgggcaatgacaataacctcatttgaatgttactaagagctttgttaatatttgcaattgctagtagtgttgttactacgagatgcttttttaatgatgtaattttgttaccttttttggtttactaacagtagtatattgtcctggactacaattgcaacaaacacagaatgtattaaaggctttcaggaacaacttgataatcatggctgtaagccttgaattgtccaccctacgtttaggcccagaagacttctgagtaataagaactaatgataacctaaaaatgtattgttgttcttaatataatgtataatacgtaattgacaatacgtatatggtgtttattgggatgtcttttctaatctctttatatggtacatgctggcctattatagaaaattcatgcagtcattttttggttcttatcctttttgactctttattataattggtactgttggctgccttttccctgagatatttcttagtttgatttttaaaattgtttttaatctgctcaactagtcctgttttctttaattattctaccttccatgtcctagtgatggacatactttaagatgcaatccttgttagatacattttcccattttcatggtttcatttattctcaagacttgctgacataagataaacacggtatcttcagttggctgctggacatttctccttggatagctttctgtcacctagaatttttcatatctaaaactaaatctaccttttccccaactgaacttcccttcctctataataaatggtaccatgtcatcattttcccagtcatccagtctcaaaaccttggagataccttgaacttctaaatctggtcattccctaagccttctccatttatttgaaatatctcttttatccatctactgttacaacagcctcccagcatacctccccagctcccatctcccattattcaacatatgctgtgtcctgtctccagtcagatctccccagggctctatttttatccttagctccaaagctaggctacttctttatgtcctgcttatcaagttcagacttgtctgactttcaagttgcttataataatctgattttatcctacctatccaaccttatttttctgttattttctagaacgtattcygtagattttaaaaaacaatagggtatattgccttactgtctcacaaacacatcatgattatttttgctttatttattctggctatttctcttatttggaaggccttttgctctctatcatgattcactcatttctttagtttatgatttcacagtcttaatataggcctttattgcttatccaaattcttctcacctcattattcagtcttttgcttctccgaaccactgtcaccccttatttccctaaattacagattgaattgtatggtgccacatgactgtgagaataggccttgaagttcaaggctattcccagtctaaatctactctgttcctatcctacctcattcactaactcatcgaatgtagagcttccatgaccctggctctgggcttgatatcaaagatatggcagttaataaataacatagatctagccctgccttcgtgtggcttatagtctgttggagtagccaaacagataaacacaaatgatcgattttggtaagtgctaccgtggaaaagtacttgtcttccaaattccctcatacatgctctattctagctacttcatctgtgtagcttcccatttctcctaagcattaaacacattttaatattttatagtttttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttakgtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattagctgggcatggtggcgggtgcctgtaatcccagctactcgggaggctgaggcaggagaattgcttgaacccggaaggcagaggttgcagtgagccaagattgcaccattgcactccagcctgggcaacaagaacgaaactccatctaaaaaaaaataataataatcataataataataataatttttgtaccaacacaaacatgatagtaagaaatgatacaaaatatatttttttcccataatgtcatggtaaatttggaatgtgacttaattttcaggtccccagaacactaaattaaataggaaggaaaagatgcaagtctggaaggatggtgggatggcatattagtagatgcttatacaggttgaatatcccttctctgaaatgcttgggaccagaagtgttttggattttgaagtatttgcattatacttaccagttgagcatgccaaatctgaaatgcagaatgctccaattatagcattgagggtcatgttggtgcttaaaaatttttagattttggagcattttggattttggattttcagatttggtatactcaacctgtggtacagtagtgtagtattttagcagatttacttgatggccacaggactaaagaagaagatggcagagcaagtgggacatgagtgagatatttgcttgggctgcacttcttatatggcatcctctatgtgtgcttgctaagtgttaattacattggagtaggtatataatactgatctataagaagactattgtctccagtttcttgagcaaacatgtactagatctgtggtatcattggaatcagtgtgaaacatatgaaagaatgaatatagctgagaacttgtggatctcgtgttgagaatgtagcaatttcaaatatgtgtctgaggctgggtaggtacagtggctctcacctgtaatcccagtgctttgggagaccaaggtgggaggattgcttgaagccaggagttagagaccatcctgggcaacgtagcgagaccccatttctacaagaaataaaaaattagctaggcatggtggcattcacctgtagtcctagctactctggaggctgaggtgggaggatcacttaagccgaggagtttgagactgcagtgagctatgattgtgctactgcacttcagcctggatgacagagcgagactctgtctctaaaaaacaaaacaaaacattaccaaatatgtgtgtctgagtccagatcagattaattctgagtattttgtttggcttagtgttgcatgagatttgtccatgttgataatcttgtgaaggccttacctgcaatggatatctgaacgtggaagcagaattcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatagagcagtgtgtttcgtgatttatggtttcttttttatggtgtttttcctgaagggtggattggcaacatttgataatatgtaggaagtatttataattgctgaaagtgccttcttttaccacaaaacacagccatgttcaaagcaggttcctcaccttgctatattggataaggctccatctccctttggatcaacagtgacagaaaaatactacctctctgtctcctccctgcttgcctttttttttttttttcctctaaagtcttgattggcattattccagagatagtcactgtactttaatcatactaaattacttttgtagataacattccactctcagataagaccccagttttccattctcaaaatacttgtatactaagtttggtgtaagctcatttgtctccttagtatgattatgtttgtgtgtttctctgcagaaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatatttgtagaagtaggcatgggagagcaggagcaaagattggaaagtgctgttcaccattagggtttataagtttcagtgtgaagctaagtacttttgattgtgggtaagaggacttaactggccgttttgaatcctttcatagctccagtgtctccataaaatactcgtaataattaaagagagttaaaagaaagatggtgcccatgtctactttttatattagccagtgatacggttgtagcacctttaatttaccactgaaagacattaaaagctaagtcagtgttcctggtactgtgaaagcaactgtattagtccgttcttgtactgctataaagaaatacctgagactgggtaattcataaagaaaagaggtttaactggcttaaggttccacagcctgtacaagaagcatggctggggagacctcctcaggaaacttacaatcatggtagaagacaaagaggaagcagtcacgtctcacgtggcaggaacaagaggaagagagaggtggggaggtgcttacatacttttaaaaaaccaaatctagcgataactcactcactgttaggagaacagcaccaagggggaaacctgcccccattgatccaatcacctctcaccaggcccccacctggggattacaatttgacatgagatttggacagggacacagacccaaaccatatcagcaacattcttgaactttcttaaaatttcttgttcgctatttccaagtaggaataaatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgtttttctattatacatttgggtttattatatacaatttaaattttgatcagttctgtgattgcagtgtacatgatgcgtgtttgtatttagatgatattgaggtttatagattatttacaaaaactgtataccactttaagtttctatgatttatttcttatatatttcttatttccctgcttactttaaactgtcaatatcttgcttttgtcagtatctgtaaagtacccttctgatctcttctaatttattgattctgatcagttagggctttagaatccacttaataacacaggcttatggacattaatttatccgtccatccatctgtcaaatattgattaatgtttattaatatatgctaggctctgggtaaacattagtgaatgagccctgtattgtccctgctttcatgaagcttagagtctagttgatttttttttaagtttaaaaagtaaaaataattttcaccaacctgataattaaaaagtaaaaatatatgaaatattctttatctaaaactgttaaattacctggattaaacttttccatcagtaatatgaattcagtttaagtaagatttgccatctgaatcatttttatgaagcttttctaaaatgtcttattatttaaaacttattgattacaggaaggcaaacaaatgaagagacacttcacattatattaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaactaaaaaaaaaaaactgaggtaaatagcgtattgtaactacaaaggagactgtcgtaggtactgggagtctcagtgttcagaatacttctattttatacttcatgctgattttcgccttttaagggtggcagctaggcacagctgggaggcctaaccttttgcatattgtatcttctagtttgtacctgttcaagctaggcctggcccctcagattcaagacctatatggaaaggttgacttcacaggtaaggagttagatacttggcaggaaatgcttgaattatgtggaaatagcctggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaarcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacctggggaaaggaccagaccttacatgttttctttatcatttggctttctgccttagaaatgaaattgttgaatagcagctaatgattgtaaagactgagataactgacttagtttgtgattcacttattgttgagctcacgttaaagctgttccatttataagttcattgtaggaaatgccataagtagcaattttgaaaaactatttcctgtaggaccttctcactttatagttatttttgatgcccttgataataataacgtttgactacattttatatactagttactgtgttaagtgctttccatacattgtatctttatatccttataaaaccctaaaaggtaaatgccattttatcccattgcatagttgaggaatatgtttccttctcttggttatggaagggtgcttagcttgantgactgattattaattccctcctgtagaagaagaaatcaacaacatgaagactgagttggagaagtatggcatccagatgcctgcctttagcaagattgggggcatcttggctaatgaactgtcagtggatgaagccgcatgtaagaagagagaaattttgtgggttcaactgggattgttgccactatttccaataattaattctatagtgatgatctaggacattatgaatcttgccagcaagtttaagtccacagatgtagttgtaaacacatagtcttccatgctgttattatttggaaatacatgattaattctgattaaagtgaaagcatttagaaaggaagtcctggctgggcgtggtggctcacgcctgtaatcccagcacttcgggaggccaaggcgggtggatcacctgaggtcaggagttcaagaccagcctggccatggtgaaaccccgtctctactaaaaatacaaaaatttagccgggcatggtggtgtgcacctgtaatcccagctactcgggaggctgaggcaggagaatcacttgaacccaagaggcagaggttgcagtgagccgagatcatgccattgcactccagactgggcaacaagagtgaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtggaagttagttaaatgattctgacttgaaaaaactgaatctgaggatctcatttcccgaggtcaggagtttgagaccagcctggccaacatggcgaaatcccatctatactaaaagtcaaaaattagcccagcgttgtgttgggctcctgtaatcccaggtacttgggaggctgaggcagcagaatctattgaacctgggaggtggaggctgcagtgagccaagactgcaccagccaggagacagggcgagactccgtctcgggggggaaaaaaaaaacttcacacaaatttatccaccccttgttaaaattagtggttgatgacaaaacgaagacaatcctgctctcagaacattctttgtatctcttatcatagagcagggatttcagtttcccagttaggtgccaaactggcctgcaggcaagtagctgctgccctgcctctgcctatgtcaccagtgagactccaggattgtggatctgtatgtgcccattctgctcagatctgaggcaaggatgtgctgcccctaatcccagcactttgggaggccaaggcgggcagatcacttgaggttaggagtttgagaccagcctggccaatatggtgaaaccctatctctactaaaaataccaaaaaaattaactgggcatgatggtgcacgcctgtagtcccagctactcaggaggctgaagcaagagaatcacgtgaacccaggaggcagagtttttaatgagccaagatggtgccattgcactgcagcctgggtgacagagtgagactctgtctcaaaaaaaagacagaatctcgctcagtcacctaggctggagtgcagtggcacggtcataactcactgcagccttgaacttctggggaaagcaatcttactgtcacagcctcctgagtagctgggactacaggcatgtgccaccacattgggctaataaaaaaaagttttttgtagagatggggtctcgctatgttgcccaggctgatctcaaactcttggcttcaagccatcttcccaccttggccttccaaagcactgggattacaggcatgagttactgtgcctgctttgttctttataaagggtcttaagctacacccatattcttggtagtgttatggtgcaggaggagcacacgtgtatttatgtggtcttcttagacaccttaagctaacttaattacgctttttactcatcctcagacagaaaactcagagagagaaagagatgtttatgaggagctgctcacgcaagctgaaattcaaggcaatataaacaaagtcaatagtaagtatgttcctgaatcaggcacctaaagggatattataatataatgtgaatgttgatctattctgggacttacaacatagtttgatttacttactttagacattcgtggatttgtttagcaataattgcttgttaacaatcttttgtgtttctatgcctccrttttaattatttatcttcagtcagccgcttgttcctacactgacagtagcatcatagtagtctgtttggctacagtttcactctttcaccctattacatgcttttaaatattattttcctggccaggcacagtggctgattaatcccagcacttacatatctgtaatcccaggactttgggaggctaaggcgggtggatcacctgaggtcagaagttcgagaccagcctagccaatatggtaaaaccccatctctactaaaaatacaaaaattagccgggcatggtggcgtgctcttgtagtcccagctacttgggaggctgaggcaggagaattgcttgaacctgggaggcataggttgcagtgagctgagatggtgccactgtactccagactgggcaacagtgagactctgtctcaaaaaaaaaaaawtatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaackgtgtgtgtgtgtgtgtgtgtgtgtgtgtgtgtgtgtrtrtrtatwtwtttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaacatatttaaacaaaaatgagattatacttttaatattgacttttatatatgtgttacttttgggaaattaatttattgaaattatcattttgtcactactctgctaaagaactcaccatgactacttcatacttgccagacaaaatgcagatccctagcctagtgcagttctttatgcaatatttcatgcatacagctctttgtagaagctcatttgcctaattacctcccatactcattctgtacattttatgacttaaaaggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttwaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgactttcaaatctcctgtgtcgtacacaggctcatccctataaatttgcacttaattatatattgtcttgtattgcttgatctttatttctgacatctttgtaaactccttaaagtagagattacgtattctgcttcttttgaagtcctcctaattcctagcataggtttagactcaccaaaaaaactaaaaggtttgatttcaaccaactaggtcaggcttaatcttgttttgctcaagatactcataacaataataatagtaattgttctcattgttcatttggagggccaaatttctcatttgaactaatactaataactagagaggatttagaagattttaccaattgcataggattggagttttaagtcctgaccagcattctttttttttgggttttttttttttttggagacagagcccaggctggagtgcagtggcacgatctcggctcactgcaacctctgcctcctgggttcaagagatttcttctgcctcagcctcctgagtggatgaccagcattctttgtattctgctaccttctggttcatttaggataatgaccttcctagcagaataatccattcaagtgtggatggtatcttgtgctgaatctgtattaatccttaagtcagcaaatataaactggagtgtccttatggttggttctctgtgagaagaaagtccacgatgtttcctgttgcatagagtacataaaatattttttgttttactgagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttckgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttttattttattttttgttaagtagactaaggaaaattagagttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcancatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactktgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgktttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcwgggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtraaatacacattgtcttcagctcacttttgcttttagagctatgaatcctcttttaagataaacagacaatacccacccatccccagtctaatcactccttcacttcagctgtctctctctccaactaaaagacattggggaaaacctgaatatttttgcattcttacgtcaggaatttgcactttaaaaaaaaactgcaccttattagtttgctctggccaaagctggaaaagtacttactgtgcagtcagggtagcttgtgtgggattgtatttcgtgggttttttttttttagaacaaacatgaggggctttcttttttgtctaaataagggcaagtatacattttacaaatatccagcgtacgttggtcaaagtaagtagcattaacgtgcttaagattctacaaacactttttccttagaactttttgaggcttttcatgtaatatgtttaagaatgtactggtatctgtaaagtcactctaccccagctttggcaaaggcatttggctctacctggggctgccaccttggctgcatgtagcctgagctgtcacttatgactrtggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacrcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctccccactacccttcccagcttytgggaaccaccagtcaactctacctctgtgagatccacttttttagctcccatatatgagtgagatcaggaggtatttgcctttctgtgtctggcttatttcacttaacataatgaccttcagtttttatggctgaataatattccattatgtgtatacactacctttttttttttttttttttttttttttttttttaccatttattcattgatggacscttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagyggggtaatttattagctcacagctctgcaggctgtgcaagaagcaaggcaccagcatctgctcagcttctggtgagggcttttgtgctgcatcaaaatatgaaggagaagatcaaagggcaagtgggctcatgygaagagagactgatccccggggtagtgagtaggggtcctggctttataacaacccattctaatgagaactgatccgttctccccaagaaccaatccaatcttgcaagagctcactaccatgagaatggcacaaagccgttgatgagacatttgctcctatgacccacacagctcctactaggccctgcctcccaacaccaccacactggggatcaagtttcttctttttttttttcatacccttagggtgatgtcaggtatcagatttcaatgtgagatttggtagggacaaataaaccaatccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgyatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacacaggattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaagtgagttcactaaacctgtcctgtttgtgagcaaagttgggtggacgtgagtgtaatacccacttcttyctgtggttaggtagaacttttttgcataaacttggttttcttacagttttattaaacttataactccctgggtcttggagaatgtctttcctcactgttttcccttctgtccctttctgtacagcataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtgggtgtccagagtgaagggaataaatccattacgtagctgttaaccctgtcttttgtatgtcagtgctccgattttctttgcaggcattattactttatcatggtcatacttttgtttggttctactttgattcacttaattctttgttatgctgaaaaatatgacattccgttcctaaatatataagtaggcttaaatatgttacatagtcaaaataacactatctctgacaaagttaaataatactttttaaatatcatctaaccctagctagttcattttcattcttcatttgttcccaaactgtcctttatagctgttttgttgaaaacaagatctagcctaggaacatgtattatatctggctgttgtgtcccttgagtatcttttaatctagaattgtccctttcttcatgagactgacttgttaaagggatgggaccaattgcctattttatggatagttctagttgctttctcatatttgccttattcctgtaaattggaaattaaatttctaggcttgtcacgattcagttcaacatttttgatgatgtgtatttcatattgcctcatatcaataggcatataaaacccacttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggarttaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgactcacagaactcaagaaaatgctagacttacgattaaaattttattacaaaatatgtaaatcaggatcagctgaaagaagagaatcatcaggcaatatctgtgagagtccccaatatgaagcttctgtgttctcaggatgtgtcactctcctggcacattgacgtgtatcaccaaccagggaaacacacctgagttttgggtgtccagagtttttatttgggttcgttacatatgcgtgattgatagtattggctttgcgattaaactcaattttcatttggcctctgctccctggagaatgggaggccaggctggtatcacgtgactctatacctcagtggttgatctttccagcatggccagcctccatccttaaactctcatgaggccaaccaggagtcattggttggcataaattcaggtgtgggcggaggggcccaccatgaatcacagaaacatacctatcactcaggatatcccaagggtcttagacgctcccccagagacaaagaccagccagactttttattatacagcagagtccttacaaaagcagtacggctgcctaagatacctggggagtgaacgttcctaattttaatttgtatttcctgggagaaatattcaactgacttggtgggaagagccttgcttcgcattagggagccctgcgcttggatctttcttctgccatttgtttgctgtgtaatcttggagaagagattgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcktcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaattagaaaaaaaaaactttctgtctctttatatttagggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggtgagtggcatcggaattgttctttatgttcagagcacctcagccctcctagaacaaaggtagaggtaggaatatcttccttgattcattcagtgaatgccttctgggcacccttagattcaaagcactggagggacacaaaaatgtgagagacataggctccacctactaggagctcatgctgttttacacatttgggtttttgttcttttgtttgttgttgacagtcttttgtgtctctttcagtaaattctttactgaaatataagatccagggctgggcgcagtggctcacgccttgtaatcccacagcactttgagaggccaaggcaggcagatcccttgaggccaggagttcaagaccagcctggccaacatggtgaaacctcatctctactaaaaaaaaaaaaaaaaatacaaaaattagctgggcgtggtggtgcatgcctgtaatcccagctacttggtaggctgaggcacaggaattacttgagcctgagaggtggaggttgcagtgagccgagattgcgccactgcactccagtctgggggacagagtaagactccgtctcaaaaaaatatatatatatatatatgtgtgtgtgtgtgtatatatatatatacgtatatatataatatacgtatatatacatatatacgatccagaaaaaaaaatatatatatatgatccagaaaaatgaacaaggtagatgggtatgcaattgcataaattttcaaaaggaggcacacctgtgtatttggcagtcagattgtagaacccattaccagcaccacagagaccttcctcatatccccttccacccttagccaccctccatttggtggtaagcactattctgatttctattaataacaccacagttcatttccgtccacttttgagctgtatttaagtgggatcataccttatgtgctcttttgtgtctggcttctgttgccctaaataatgttaatgatatgcatccatgtggttgcatggagccatcctttgctcattctcattgttgtgtactatttcattgtgtggttatatgttattggtgaagttttttgttgttttgtttgttttttcagactgttgtaaatagggcttctttgttttttttttgagacggagtcttgctctgtcacccaggctagagtgcaatgacgcaatctcagctcactgcaacttctgcctcccaggttcaagcaattctcctgcctctgcctccccagtacctaggattacaggcgagagccaccatgcctggctaaaattttttttttttttttttgtattttttgtagagatggggtttcaccatgttggccagtttggtctcgaactcctgacctcaagtgatctgcccgcctcagcctcccaaagtgttgggaattacaggcatgagccactgcccatggcctgtaaatagtgcttctatgaatttttaattttggttaaaaacatatatgtgcatttctgttaggtatacattttggagaggagttatggccatagggaacacatatatgaagctttaatagataatgtcatgaaggttttttgtgacaacttaattgaaacgtaattcacgtatcaggtaattcagcgtcagtggactttagtacgttgatagaattgtgcagtcatcaccacagtcaatttttgaacatttcatcaccccaagagaaactcagtacccattagtagtcactcattttcccttaatctcccccagccctgggcaaccatcagactgctggtttgtctatgggtttgtctattctgaacatttcatataaatggagttatgcaatgtatggtcgtttgtgactggcttcttttagcttagtttatccaagctgtagcagtagcacttcatttctttttgttgctgaataatattccattgtatgactgtaccacattttatttatttattcatgagttgatgacacatggattatttccactttaccacattttatttatccattcatgagttgatgacatatgaattatttgcactttattcgtgatttgatagacacttagcatgagtgacagctatataagttgtatcttcaatctacttccctttttagatatggaagccgacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccragtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaatacactaaagccttggtctgtttttatacgtctggctactcagaattaaaaatttcttttagcccttccgcttgctgcctcacttcaggagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaraaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgttttttgtttttggcatcacctgagcatctaagtctccatcagccatttgggagtgtttttaaaaatatttatcactgagttacaaatttagagagcaaaagatcttaatttaaatttggtctgtagttttattttcttctgatatctttgtgtttggttttggtatcagggtaatactggcctcatgacttgaagtgttccttttatattttcaaagagtttgtaaaggattagctagttctttaaacatttgttacaagtcaccagtgaggccacgtggtccggagttttttgtgtgggggatattttttgttttgttttgagctgcagtactgtgtaggaaaggggtcccgatgcagaccccaagagatggttcttggatctcacacaagaaagaattcagagagagtccatagagtgaagtggaagcaagtttattaagaaagtaaaggaataaaagaatggcttctccatagacagagcagccctgagggccgctggttgcccattttatatttcatgatgatatgctaaacaagagctttatcagatcttttctgagcatgtgcacagcccacacatgcactgtggcctcctagatcccatccaggaatatgtcaagttgtcagagctctccatgaacatctcattctccagcttttccttataaggtttttagttagtctcttgtttgcctaaactgttatccttaatgtttttgacaattgcttttggagaaaaggctgtttgcagtggatgagctcttggtcaggtcaaataaagacagccatgcgagtgtgacctctgaacaggtcagctaatgacagttctttgggaatggggctttgaagggatggtaggaggggcagattggaataggggagtttaaagcaccacagaactcactgttcttactgagtttcagctgtttttcttgaatgcattctccaatttctgcaagcctttggttaatttctaccgtattgaaaaaactggccgggtgcagtggctcatgcttgtaatcccagcacgttgggatgccaaggcgggtggatagtttgagcccaggaatttgagaccaggctgggcaagatggtaaaaccctgtcttaacgaaaaataaaaatattagctggacacggtggtgtgcacctgtggtcccaggcacttgggaggttgagatggaaggatcacttgggcctagggggctgaggttgcggtgagccaagattgcaccactgcactccagcctgagtgacaaagcaagaccctgtctttaaaaaaaaaaaaaaaaaaaaaaaagggctgggcgcagtgcctcatccctgtaatcccagcactttgggagtcccaggtgggcagatcacctgtggtcaggagttcgagaccagcctggccaacatggtgaaactccatctctactaaaaatacaaaaaattagccaggcgtggtggcaggcacctgtaatcgcagctacccaggaggctgaggcaggagaatcacttgaacccaggaggtggaggttgcaatgagcaccactgcactccagcttgggtgacaagagtgaaactccgtctcaaaaaaagaaaaactgatgctggtgattgtttgccagtgtaccaatgttttttgtttgtttgtttttcatggtggagaggattttcagaggtctttaccattttcactaatgtcacgtttctcttcattaaatttagtgtttgtgggactcttgataaaagtggattactagtcgtgagtagtacagtctgaatgcaagacatggatatcagggctcctcaagaactcattttataattaagaatatgaatgacttaggccgtgtgtggtggcttacgcctataatcccggcactttgggaggtcaaggcaggcggatcacttgaggtcaggagtttgagaccagcctggctgacatggcgaaactccatctctactaaaaatacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacmcaaaaaaaaaaaaaaaagaaaaagaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgtaccagttgttaggacattgaaattcttttattttgtttggtacattgttactgtcccaaccctcccatatctttgccatcactccccaactctaattgaaatcccactatatggcaactaaaccagcagtgaccataaggactctgctccatcctgattggtcagtgcttatgttgtgtagttgataaacgtgttgtacagatttgtgtatgtgtgtttatgtgtgtatgtggtatatatgtggttatatatttatatatgtaatattgggtctatcatcacacatgcaaaccaagccacatagtaagtaaagtctttttaaaaagttttgagtgatgagaagtgccctttagaggggtgtgtgagtgtgtgctttccatatatacatgtacataacatagtcattcctttgcctcttcccccttttcctgtgtttgtggcttcttcacctcttctacctccaatcattgcccactctttttttaaattctgacttctggtccctatctctttacctcttctgaaatgcaatcagcgtgtttctaagtgtcagagttgttagggagctgtgcttgaatatatcttagatagcatttttacagcaaatctgttttctctccataatatctagcctgggctttaacactctgctcagtcatttgagttaatctttaggtaatctctttaaaacaaattttaccagaaggatttgggttttgtcattttattcagtctaattggagcagaaagaacctgttctttcttcttacactgggatgaggtgtagtgtatgctgtctctctttccttcttcattctggtgaggggcttttctgtattaatgtttccctgaaacacctgagacacccatccattcactttttcttgcctttcatactattgctctattgcttatttcttaaggagtatgtatgaaaggttttactttaatctgcatggggcagggaagaaagaattctgaatgcttagaaaggttctacctttctcaatgcaagggaggttgtgctaagtctcacaactttgcttacagcagattctgctcagatatctgttgtatgattatcccagaagtgaacccaaaatggcttgattctgtggaaatgcttctgtttttatgatacgaggatttttctgctgcttctcttggagactagaccatcagccctctcgcttatgacttcacaatttaagttgtcacaagcctgcagctgactcattgtattgtctcacattggaactattgtctagtatttccagtagttattcttaggactctaggggatggtgtgtggtcattttctattttcagtaatagaaagcgactagtggtaggaaggtactaggttctgcagcttttaagtgatttatttgttcttgcattctatttatctgtttactctttccctttcccaagactgtgagcttcttaaaattgggacagtgcctcttagaatrgtaaggccagcacctaccataattaggttaaatgatctttctaaaagactgcatttaagagaaatcactgctttcaatttcagatgctttcctttggccttatcctgtcacctgcactctttataaattgcagggattgtggctgcttcactatatggagtgaaatgttgtgtctttctctaataaaacaggaggaaagccaagccttccctaaggttttgtgacttcaactgttgggcagtgaaacgtttcactttgcctcaaagctcagaccctgcctcatttaggcacatagttatggtgatttactaagttctttattctgcctcattcatgccttggcaaattatattcacatcgagcaatctaaatgaatttttgagctgctatttataccaactgctgttagctcaagcctcaggagtatgttaattttgttgggtctgcgtagatcaccacaaacatgactctcacaacctggccactttaaaacctgaagtgccttgtcttttctagagaagattgccccagtaatctgctgaattgatgctctctgtaaagaccttacaggcatcttaataaagaacccccactcttttgagatcgttgaaacctacataacctcagtatgaccatggaaatctaatggggtatcagcagtggtttctgattctatcacactgagagtaggtagaagtagaatcctattgtgctaactctcagtaacagtagtgactacctggggctaatccataagctacttccccaaattgaaatatggcagccacattcttgaaaattggaagataacggccaggcgcagtggctcacacctgtaatcccagcactatgggaggccaggacgtgcagatcacaaggtcaggagattgagaccatcctggctaacatggtgaaaccccgtctctactaaaaaaatacaaaaaattagctgggcgtggtggcgggtgcacgtagtcccagctactcgggaggctgaggcaggagaatggcgtgaacctggaaggcagagcttgcagtgagccgagatcacgccactgcactccagtctgagtgacagagcgagactctgtctcaaaaaaaaaaaaaattggaagatattagaggaaggtatttctactaatctaattctgtttaaaatgccattcagagcaaatggtcaccaataagcgcctttaaaaaagaaacttgtcttaacgaatttaggaagaggaaagtaagtcacctccactacatcatacatcatctctatccacaatagtcaactcagactatgctgtgaggcttttgttagctgtactaaggaaagtaatcacaacattcattatatttctgtgtgaaaatttgcttttaagttcccagcaactgatttaacattcaagttttaggatatcagctagtgagaaatgtagattgcctgtagtgacttctggctttaaatgtgatgagtcaaagattctggttaaagtaagacttgacagtcttaaaaacattagtagtcatagagaacgttaacttcctctgaacattgttggcaaaggaggctttcaaataagtactgcatattcatatatataccctggcccttgtcaccctgttaaagtctctggaccccttcccagtctgtctgggcctcttgccccttctagctgttcacaacttcctgaaccacttaaattcatctttatataatcttcacctacatgtgagccatttcccttatcttatgacctttaccagtttgtttgtttttggagaccggtctatactcttgactggagtgcagtggtaagaacatggctcactgcagcctaacctcctgggctcaagcaatcctgcctcagcctccctagtagctgggactataggcgtgcaccaccatgcctggccaagctatgtttgtttgtttgtttgtttgtttgtttgtttgtttttagagagacggggtctcactatgttgcccaggctggtctcgagctcctgggctcaagcattccttctgcctcagcgcccccaaagtgttggattacaggtgtgagtcactgcatccaactttttaccagttttttgatgcctccttcttccatttgactaacccacgtgtctcatattttttaagcctgttcttccatatttaatkgagtctaggaagcccccttcttcacatgtrtgttacatgtacccygatttcatgactttaatattttgcttttaatgatatgtaggaaatccaggatgagtcagctgtgttatggttggatgaaattcaaggtggaatctggcagtccaacaaagacacccaagaagcacagaagtgtatgtatcacctgttttatttctgttttggtggaggctggggtgacaaggtgctccrtacagcttgaccaagataggtatgggggaacaatttgccagtagatatagttaggtgaagcagtatgtgaatttagacactctctaaactattctggtaacarttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagaccttttagcatagatgtacagtacttaggctcattttaaaggagataaaatccctatttttgaaaatatccttccccccccccttgtggacagctgtgttaataaggccaattttctgagaatgtgggaaagattaaaatatttaactgtttatctttcacagagtagcagtagctctgattaagcctataggcaattaaaagtagtttgtctgtaaaaagagggaaagaaataagatttcttaccccattttatggacttttaaaaattaaaaaactgggccgggtgcggtggcacacgcctgtaatcccagcactttgggaggctgaggcgggcagatcgcctgaggtcaggagttcaagactagcctggccaacatggtaaaaccctgtctctactaaaaatacaaaaattagctgagtgtggtggcgtgtgcctgtaatcccagctacccgggaggctggggccggagaatcgcctgaacccgggaggcagaggctgccgtgagccaagatcatgccactgcattccagcctgggcaacagagcaagactctgtctgaaaaaaaaaataataataataaattgaaaaactggagaggctgaatggttgcacattttttaagacagacaggccttaaactttggctttggagtgaacaaagttaatcatggttaattccataattggacttcataggtattttcttcttatagacataaatgagctaaattagtcattacaaagccataatttaatgggagcttagcatgcccctttactctcacagatccaaggagcagcttttggagtggtcttcatttagactrtgagactaactaataatcctgcagttctggacgtacagctggggagtgtggctctggatgtcttctatctttcctttattttctgccaggagataataacagcaagtgggtgaagcactgggtaaaaggtggatattattattaccacaatctggagacccaggaaggaggatgggatgaaccnccaaattttgtgcaaaattctatgcagctttctcgggaggagatccaggtaggttacctttcttcacgtaagaagaagctgagagaaagtgttttcaagctataatattaattaagaggaacagggcatgtggtcagaagccctagactaaaattgaggttatgtaatgagctgttttgcggtaatttttttgtagtagttgggggagtgactgaggcctgaatttgtaaaacatctgaattatagaattaagtgatataaaccatatgctaagaaaagttagatgatctataaaagaaaaatgaaaagttgctaactccattaaatgcaactattttaatctctcccagtttatattttcagtctctcttctaactgttccacaaattatattagctacaacctgcactttcaaataaagttagcattttcatagagcttttaaagtactttttcatcttctgtgtctttgtgtctttgcttatactgttccattcaacagtttttgtttgtttgtttgtttgttttttgttttttttttgaaacagagtctcactgtgtcacctaggctggagtgcagtggtgcattctcggctcactgcaacctccacctccctgggttcaagcgattcttctgcctcagcctcccgaatacctgggattacaggcatgcaccacacctggctaattttgtaattttagtagagacgaggttttgccctgttggccaggctggtcttgaactcctggcctcaagtggtccacccgcctcagcctcccaaagtactgggattacaggcgtgagccagcacacccagcccattcaacagttatttgttgaatacctcaaatgtagcaggtactcttctaaggaatggggatatagtcatgaaccaaacaaagtctctgctgtcatgagatgtctctcccctgccatctatatctgtcaaaattctttccttccctttgtactgattgttggtatcataaaagaaaaaaattcaggctgggcatggtggctcacacctgtaatcccagcactttgagaggctaaggcaaaaagactgcttgagcccaggagttcaagacaagcctgggcaacatggtgaaacctcatctctgcaaaaaatacaaaaattagctgggcatagtggtgtgtgtctgtgattccagctacttgggaggatgaggcagaaggatcacttgagcccgggaggtcaaggctgtaacgagccatgatcacagcagtgcactccagcctgggcaacagagcaagaccctgtctcaaaaaaaggaatatttaatttaaaaattcagtcctccaagcacacccatctcaagtcacctcctctatgaatctttttaaaatttcctttccttacccccttcatcttcctttgaagctcccaaagaacttggtattcattcagaatttaatgtacttggattcgaattttagtgacatttgtgcttgtctatgccccctagtagtttttaaggtgagctgctaagtttgcagtactttctcaaaggggaagttacattgtcattgatggactgttgaggacttttaagttttaacttggtgctgcactcctgttacttaaaccagagttgtttaatgaatgttaaaggggaggaatatatactgggggaagatgctcagtaagctcctgtaggtcgttagacatattactaacagacattcaggattcctagagaaaaacgacagtaaaagattttcaaaaggtcatttacttccctttggcaatatttcccaaatcgtgtgtggaacaagtcaaaaatacacctgtggaaaaactgaaatagtccctttatttaggagttaacatcagatgggtgatttctaccttgtggttaaagttctctttatatggtgggttacagtctcttacccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgaggaaaaaaagaaaaggctgttctagacagaaagggaaagttaaggatgagcttgctgaaattataaaaaggaagtaggagagaaaatagaaaaggaaaaagcacagagtactgaaaggacatggaccactgaaggagaggcgaatggtgtattacctggcacgtggtaggagtggcaggacaagaggcccaggttgaagcttgagggcctaatgtgctgtgctaaggaattcagggtacaacttctagcagagtgatttttaactcttgttagttcagggacacctttgagaatcttattaacctccacagaaacactcatgtttgaatagtgttttgcatatatggacctaagaatttaaacagggaagggatgctacctcattttcagcatgtgacctgacctcttacctctcctgccaacaatagtggcgatcacatatagatcctcccactctactcaccactctgtactttgaacttacttggattttcactgattccttcttcattttctctctggaggaaacagctatcctttctaaagctcattattgatcttactgcttgatttcatcctctcccagttccttgcagaccttgtactttttgtgctcttcctccagtgcttgtcaggatttaatgtctgtctgaatcacctgggatcttgttaaaatgaaggctctgattctagtgcgaggtctgagaaaatctgtttctgacaagctttcaggtgatgttgatgctgctggcccaaggactgtattttaagtagcagcctacatacttaagcatctttatttcccacatctttgaaaaaataataatacaaaatttttttaaagcccatggaatttccctgatctggcctcacctacattcatactcttgctaagggccttgaaagttagtctactcgtcactaattcactctctgttaccatccacttcttggctcacagcagtgtggtttcctgtccagcttttacttagtaaaactcttattttagaattcatcaataaccttttaattgccaaattcaattctgagcactcatcatatttgacttgtcaaaagtctcttcctcaaaccctcaattcctttggcttctgccatccaactctcttctaattttcctgcttctaaatgttccttcttaatctctcttgctaccttcctttctcgacctctgcttgaattatacaaagagtccattggctgccttctcctacacattcttcctgagtgatctctttcaagcctgtggctctagcccttacccttgtgcttgtgactcctaaatctgtacctccagacgttagcccttttccccaccaccaggtttttgcccttcattttgcagtccagaagtccagcagacacctcaaacacagtttaacaggaaaaaaccagaggctgcaatagtgtataaggttgtatttttatctcacatgaaatgattctgcagttcagcagtccagggaaaatgtggcttcatggtatcatctgtcccaggatccttcatctttgtgctctgtcattcttagcatgtggcttccattctcaaggtcaccttgtcacctataatgacagtttggagctttgaccatcaagttagcagtccaagcaggaagtaggaagaaggggaaggagagcaaaaaaggtgtactgtcagctgtctgtttctctcaaggagctttctcaaaggtcttgccatactactactgctcacagcgcatgacctcgctctacctcatgaagtcttttttttttttttgaagcggagtttcgctcttgttgcccaggctggaatgcaatggcgcgatcttggctcaccacagcttccgcctcccaggttcaagcgattctcctgcctcagcctccccagtagctgggattacaggcatgcgccaccacacctggctaatttttgtatttttagtagagatggggtttctccatgttggtcaggctggtctcgaactcctgacctcaggtgatccacccacctcagcctcccaaagtgctgggattacaggcgtgagccaccacgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttgttcaagcccaggccatctgtcacttggatcacaatagcagcattgtaattcacccacttggttgaagtctcttstcactctaatctgtcagctgctttcctaacagtattgtttttctaaaaataatctccaccctgggcaatataatgaggactcacctctacaaaaaatattttttaaaaaattaaaattagccaggtatggtggtacacttgtagccccagctactcaggaggtgaggtgggaggattgcttgagcccaggagtttgaggctgcagcgagctgagattgtaccactgcactccagcctggatgacagaatgaaaccttgtctctaaagtaaataataaacatctgattgttttattcctttgcttgacaaaatttcctggctstccagtatctttagtaacagtccaaaccctctaggctacttttcaagaccatttgcaatctgcctggagaagcaattttcagtcctcacctctggtctctccccctgagatgtcctgcattgtgacattctaggggtccctcggtacgtggcacacagccctgttgggtacctgtcactctgttcttgtctacagtgaccccagatcagccagcacagtgcccagcctagtcagtgttggrtaggtagataagtgagatgacatatgaagtaaaagaagatcaagtttttgtttatgaagtgttttctaggtgggaggacgtgtgtgagaacaacctagtcctaaaaaacagacctgagggctttattcctgttatgtagctaatgatctagtatagacttaggaagcaggaggtgttagcttgtgtgctgtggatgatacttcgtgaaaacctgcatccattcttgcctgtgaatgtctttgaatgtgaccactgctttttcagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtcaccattgactgtctgagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtcccyatctgtaaaaggggaatgccccattgtatcttatcttcctcacctggtttgttgtaagaagccagtaaatgaatctgtatggctgcactgtaaaaggtgtgcagggctgtgctgaygttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatgtaagcacccttggatcatacaggccattaggngcaattttgccatatttttggtagacagatgaacagagaaatttcttcttttttgttccttagataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggggagagggtgtgacctgtgacataagcccctttgctaacatgtggctaggtgtcttgttggcttgttgcattaacctttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggygcatgccactacaccctggtaatttttgtatttttactggagatggcgtttcgccatgttgaccaggctggtcttgaagtcctgacctcgggtgatccacccgcctcagcctcccaaagtgctgggattacaggcgtgagccacgacacccggcttttttgcatttttagtagagacgggggtttcaccatgttggccaggctggtctggaactcctggcctcaagtgattgatccactcaccttggcttcccaaagtgctgggattacaaacatgagccaccatgcccggccatcataagcttttaaaaaagttatgtaagacaggtcaggcatgatggctcacacctataatcccagcactttgggaggccgagaagggcggatcacttgaagccaggagtttgagaccagccaggccaacatggtgaaaccctgtctctactaaaaattaaaaaaaattagctggacatggtagtacatgcctgtaatttcagctactcaggaggctgaggtggaagaatcgcttgaacctgggaggcagaggttgcagtgagccaagattgcatgactgcactccggactgggtgacagagtgaaactctatctccaaaaaaaaaaaaaaaaaaaaaattatttaagacataaaacaacttaattgacaaaattttgatagagaaaagaagataaatgtcttcccctaatttcacctaccccagtcattttgtatcttacattcttacttcatattaaaggataagactctttccctatgataagtagtcataatttttttttaattttattttttgaaacagagtttccctctgtaccccaggctggagtgcagtggcatgatcatgactcactgcaacctcgacctcctaggctcaagtgattctcccacttcagcctctcaagtagctaggacgacaggtgcatgccaccacgtctggcaaattatatttttataagagatagggtatctttgtattgcccaggctggtctcaaaactcctgggctcaggtgatcctcctgcctcagcctcccaaagtgctgggattacaggtgtgagccgctgcacccagccataaatattatttttaacagtagcatattagatttttagaagatatactatgatttacctctttttcccctagtatttgacatttaggttgttttccaagcgtttattataaataacattgcaattaatgtttcaatatatatgtagcttttattgtatttaagacttatttttataatagactgctggaagttggtttgccaattcagtggacattcttatggctcagattctttgttggaacataggaatggatttgactggtgtactgaaaacaggataaagtgtagtggtttttaaatattcagtgggaatctgccagtgcagtacaccttcatgtgagtttgcacatgctgcaaaacctttcctcaatgcccagaggttcatctttgaaagctttctgatctatttattggtttttgtttataggatgtggtttcccacagtaaaaarcttaccaaaaaaaataaggaacagttgtctgatatgatgatgataaataaacagaagggaggtctcaaggctttgagcaaggagaagagagagaagttggaagcttaccagcacctgttttatttattgcaagtaagtggctcctggaatcagtgttataaaaatttagtgaatttatttttccacaagaaagccttaccatcgatctctctggaagtatttttgacttccactgaggggtgagtgaggggcactgtaacatgttaatttattaatcttttttctcatatgtattgtagtccttcaattttaaataattgaatatatcttgccagcctttatattacctacaaatgacttatcccttggttttatttcagaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtatgaacagatttcctcagggcacaggccccttcccactatcagaggggctcccagtttgagattcatgccttcctgatcttttcttgatctcaattaatttatgaaaaatacttactctaaagaagcatctaatttttaaataactgatataaaatcttgctgcttctagggaagggataaattaactttaggaacattctgtattaaggtataatttcaaaaagtaatctgaacagaaagaattcacatttttatctagtagcggacccaatcatgaccacgattgagcgtgcagctgcaggaacattctgtgagtgctggggaatgtttcgagagaaactgtttcagggagataggatctttaagcaggaaggatcttttaagttgatgggttttgtgacaagtttaaatttttatctgatgttttataggtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaaggtatgttaaccataatgacacttttctttcatgttgttatagtctttccctcttttttcccctctctttatttataaactaatattagttcaaatagtttttcttttcttttctttttttagacagagtttcactcttgtcgtccaggctggagtacagtggcataatctcagctcactgcagcctccacctcccaggtctaagcaattctcatgccccagcctcccgagtagctgggattacagttgcacgctaccacacctgtctgatttttgtatttttagtaagactgggtttcaccatgttggccagactggtctcgaactcctgacctcaggcaatccatctgcctcggcctcccaaagtgctgtgattacagctgtgagccaccacacccagcctcaaatagtttttctttagaaaactgtgctttctaagttgttgacctagtaataaattcacttatttagcaaatatttattgagtattaactatgtgccaggcattgtgttagagatgtgtacagtaatgcaataatgagtgaaacagacatgcttcctgccctctcttcatagttcattgggtggaagagacaccaaccaggtacataaaaataaaagcataattaaacattgaagaaagttttatgaagttttatgtacggttctttaatggagactttataagagggagctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcattaaaggaaaaagaaaacggtgtggagtgagcttccctgaaatatcgtgagttgggctaattaaattaacgtattacaggagatagctgagctagggccatagcgtaaccaccaacattcatttatctaaagcaaaagtgtgccaatcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagscatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaatcatttggcatctgattggttctcagtaccatgtaggtctgttatcaggactcagatcattgcaaaagtctttttaatttttttgcctgcatacctgaggcccacatccaggaatgtggtcagccaagtgcaatacttgtctgggaagttttgcctgcaacccagggcattccttgccgatagccccatgtacactggctccgggcttctcagttatttcctctgatggtccatgagtcagtcattttcagatccaaagcccgctggacatttcaggattggttttcttgtgggtacctataagaaactggtgtcttattttgcctttcataaaatggaaattgagccaggcatggtggcatgcaccagtagtcccagttgctcaggaggccaagacaggaagatcgcttgagcccaggagtttgagcactgcctgggcaatgtagaccccatatcttaaaaaaaaaaaaaaaaaaaaaggaaattgatttgaactctttttaagataccagtgactgtgagggatggtggtgtggtggggatctgtcctgcaggtaagcatcacaggtcccttagctttcttcttttacttcagccaccatacacgtagcaaactggaatcttgtcacctcttgggaatgttctttcctaaaatctcaaagttaatgttctgttctatcaccaacgttttttagcatattgattcccttgctggttactacttttaaaactcatataaataataaaatatacaatattctttattgttaagttccatgtatttatttatttctcatagaatgtttctgttgatttttgcagaatttttgtgttcatagtctaccaattttaatttagccatgctatgacaaatgaagaggggtatccctatctacttgtatttttctttttgttgttgtggttgagacagagtctcgttctgttggtcaggctggagtgcaatggtgtaatctcagctcactgcaacctctgcctccctggttcaagcgattctgctgcctcagcctcccgaatagctgggattacaggcatgcgccacacgcctggctaatttttgtatttatagtaaagatggggtttctccatgttggccaggctggtctcaaactcctgacctcaggtgatccacccgcctcggcctcccaaagtgctaggatgacaggcgtgagccaccacacccggcctctacttgtattttctaaggctgccataacaaatcacctcaaattgggtggcttaaaacaaccgaaagtcatggtctcacaattgtggaggccagaaatttgaaaccattatcatgaagtcgaggtgctggaagagccacgctccctgcagaggctctagtggaaactctgtttcttgactcttagagcttgtggtgactgttgacatccctcaacttgtggctgtgtggttccagcctctgcctttgtggtcacattgccttctcttccccttctgtgtgtaccaaagctctctctgcctcttttttttttttttttttttttttttaagacaaggtcttgctcaagcagtcctcccacctcagccttcctagtagctgggaatgctagcatgtgctgctgtgcctggcatagcactcctatccttgaagacctccttctggtttctaacaaagtccagatttgtcagtatcatatacggggtctgtcatggcctgctccctgtctgcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatmatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacycccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacarttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttgggaggtggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcrtgtgtatatgtatttttyatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaattaacatctagttttgaattcagtgcttcagagcactgtcttagagatagaattggttctcctaatggtgtctggaaacttttaagtcatggtgcaatggttcttatgggtaaaactaaaactacaaactaggtggagaaagaagttattcgaaccactatcccaaggttgtcaagcacagcaaacacacagcactttctcttgaagtaactgttgactggcttctgtttgcactcattgtgtgagaggtttgtgaaatgtcctcttgccaacttcatgtgtatgtccctttttggggggctgcctcctgtgcttatttcagacggtttttccaaactgcttgtgatgtcccagagcttcaggataaatttaatgtggatgagtactctgatttagtaaccctcaccaaaccagtaatctacatttccattggtgaaatcatcaacacccacactgtaagtatttttctttaattacttaatttcattgtccttaattattatccctggctgctgcttatcatctctggtagccaggtgtctaaccttcctgtaatctaactgacaatgcatctccttgatgtctctttttttgcttgttattcttttttgtttatttatttattttttgagacagagtctcactgtgttgcccaggctggagtgcagtggcgcgatctcggctcactgcaagctccacctcctgggttcacaccattctcctgcctcagcctcccgagtagctgggactacaggcacccgccaccgtgcctggctaaattttttgaatttttggtagagacggggtttcactgtgttagccagcatggtgtcgatatcctgacctcatgatctgcccacctcggcccccaaaagtgctgggattacaggcgtgagccaccacgcctggccttttgcttgttattcttaacagtatctactgctaagtttctaaaaggtcttcccaggccacctgcatcagaatcctatgggctgatagttaaaaatgaagtttcctggacaccgccccaggcctactgaatcaaaatcccactaaatttatctattgccttaataaaatagtgcttttactcttctttctttttaccctagctctctgcgttatttttctaacatgatctagaatactagctttctctgtgtagccttggagtggatttttcccttggaagctggagctccatgtttcttcagatttttcaaatcattttttcccctctggggacatggacatgtaaaacaggaacaagggcatatgttaaaatgtaaatgaaatttcaggttactgtcatttctgagggcatcactggggataatggcaccttgaagactttgttgagtgcccctacaataattataacattgatttggtatacttttctctgaattaaatcatgtcatacactggaaacattaagtaaaagcgtgcacgtgacttatttgaactggcagtagggtacattgatgactttgggtattgaactttgagtttcagtgttttgtgggttttttgtgtttgtttgttttgttttgtttttttgagatggagtcttgctctgtcactcaggctggagtgcaatggcgcaatcttggctcactgcaacctccacctactgggttcaagcaattcttctgcatcagcctccctagtagctgggattacaggcacacaccagcacgcccagctaatttttgtatttttagtagagacagggtttcatcatgttgtccaggctggtcttgaacgcctgacctcaggtgatccacccgccttggcttcccaaaatgctagaattacagacgtgagccactgcacccagccagtgttctttctcaaacagggcacatttgaatcctttatggccatgaggttaagagaataccagtatttcctcttcttatatcataacataagtcattcaacagagcctggtgtggtgccttatatatcatattgtttatttgggttagtttgctgaggatttgcttgttgtttctttgaatataggaactttgttggaacctctttgtgcagatcattgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgkgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgtttttttttttttttaatagagatggrgtctcactatrttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatyttatatttgtattatttccccccaatatctcctctctttattacrctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagccaccagtgaacaggtaaaatttagggtctaacatactcctttgtttggtagataagctctcccgataggcgcatgtcagagaaaggaggggagacacaaataacagttggtagcctaggggtgagcatgaatgtaactgggggacagtggtagttatggctcgtctgagaaagtttttgcttcctgagtccaggtgatgtcctttggacaggaagctcactggcacttgcatgcagaatcattgtgcccatcccgtatatccatcccttggtatccacaggcgattctttccagcacccattctccccacccccggccaataccaaaatccatagatgttgaagtcccttatataaaatggtgtagtatttggccgggcatggtggctcatgcctgtaatcccagcactttgggaggctgaggtgggtagttcacgaggtcaggagattgtgaccatcctggctaacacgtgaaaccccgtctctactaaaaatacaaaaaattagccaggctaggtggtagatgcctgtagtcccagctacttgggaggctgaggcaggagaatggcatgtacccaggaggcggagcctgcattgagccaagatcgcaccactgcactccagcctgggcgacagagcgagactccgtctcaaaaaataataataaataaataaataaataaataaataaataaaatgttgtagtatttgcatatacttacgttctcccatatactttaaatcatctctagrctacttataatacctactacaatataaatgctgtgtaaatagttgttactgtatttttaaaatttgtattattttgtattgttgtatttttttttcaaacagtttcagggttggttgaaaccatgaatgtgtagggttcactgcaatttattgaatattatatattttgaattctgttacatgccttggtagatagaagaaaagtacagaatgtggctcctaaactcagtgaacccatggtcttgttggggaaatgtgacatatatacctgaaacagtgatgaactgtttcaaaattaactatgttactgactgaaaaataagagaagtttcaggaaagaggccagtgaagcagtgcattaggaagcttcctaaaagaagtggaaccggagccagatgtataaaggtggaaaggatttgggtgtgcatgtaagacaagagagggcattcgaggcaggagagcgatgtgaacaaaggtacaaaggagggaagagcatgatgcgactagactacatgtctagaatggagctgtgggtggaggtgagtagtgagaaataaaacatgagaccaaattatttagaactcacaaactagatgggaatttgtcactgcagagataaggaataaagagcctctgtaaggttgaagaccatttaataaaagttaattaattcagcagtgctattagagcagatgtagttgagtcatataggtgtgtgataaggtccagtggggtgggcagatggttgggtcctggcattttgtagggttggatgagtcatgtcatatctaagacccttgtttcttttttttttttttttttaatttgagacagagtctcactctcactcaggctggactgcagtggcgtgatcttggctcactgcaacctccgcctcctgggttcaagcgattctcctgcctcagcctcccgagtagctggactacaggtgtgaaccaccacacctggctaatttttgtatttttagtagagacaggatttcacgatgttggccaggctggtctcaaactcttgacctcaaatgacccacccactgtggcctctcaaagtgctgggattacaggtgtgagccactgcacccggccatagacctctgttctcatttgtcaagtaaggaaagtaggtcaagtcattcattctcaaattttaagcatggtaatctgtttcattaaatgacaacttagctaaaagcccagtatatagagcaggtactctgctactctggagctactctgatagccagcaatagggcatctgaaatccagccctataggactctgtgatgcctctggcaaactcttgaggctgcacagagaactatttggaaaccattgttttcaatgaagtctcagctgtcagttgctatgactgattactgattagatatgtgtgaaaggcaagtaaggacatgtaaaccaatacttgaaacatgttgaacctagaaagaaatttgaaataaggaaggaggagccagtctttattgagaacctagtatgtgtttggtgctctcacctctgttctttaatttaatccttacaatattcccatgagtcgagtcttttcatccttattttgcagatgaggaaaccaagacccttacaggttaactggctaagatcatcagcttgcagtgacagaaccggaggtggatccagttctgtctgcctccaaagcttatgctgtttacattatgtgatgcagagtagtcttgacattagaaaaaaggggactattgggaaagggaattgctccagttagggggaattacaagtttgaactatgagccatcccgaatgtaaacatcccagtacaaacagctcagaatatggcaccagagccatggtcacaaagatttaggatctgtcaacacagaggcagtcaatgaagtattgagagtaaacagagagaaatggtcacagatcacatagaagtaccaaaccatgcatagagcaagaagacagtgcagagaagatgagcaaggtgacagaaaaggctttggattttggacaggggaatggtaattggtgataagagcagtaaagaagaaagtgctgaaagaacgaaacagtgagtgtagatcatatgttggacagggacagacaatggacggtgactatgaaggatggcgactatgaaggatggcagtatcaagggaaggtgtttccctgttagattgtggtgtctgcagaatgtttgaaagcagaggcaaggctcgagcatgattccaccttgtgacaaagtgacacaaagaattagcaaggatttactaagcackggtcttgttgtattagtatagttataacatttatacagctatgtttttaataaaattaaatggcttccatgtctcaaaatgtggtagagaaaaatgactttgtagccagtagagtccagtctcggtgattgtacctggagtccaggaaagaagccctaagcacctaagcagttgtgtgatttgtttgtttgcttgttttttgtttttttgagacggagtctcgctctgtcgcccagactggagtgcagtggcgcgatcttggctcactgcaagctccacctcctgggttcacgccattctcctgcctcagcctcctgagtagctgggactacaggcactcgccccatgctcggctaattttgtttttgtacttttagtagagacggtttcaccgtgttagtcaggatggtcttgaactcctgacctcatgatccgcctaccttggcctcccaaagtgctgggattacaggcatgagccaccgcgcctagcccagttgtgtgattttgtagatatcatctcttctaggtggaaagagatgtgcctctgcttcatgcaatttttcatctatcatttggcagggggcagaatttgtttccttctgtttcraggttggagtttaagaactgtataagttcaggtgcaaatgtgctatataaattcaagtttaggattagtgtggtaaacttgctaagaacttctttttcccatscgtaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccagcatgagggccttgcccgacctgaggtggcttattccatggcctaaattactagggagaggaccttaactggagcctcctatgaccttaaagaatttgtcttcagccttaaagaattcttccagatctttttcatgattactgtgaaatataaattcacatcaagctgattaaatcgttgatttgtatgaatcatctcaagcgaggggctttggtgaggactaagagtttaggtgttctgtgctgttgcactaagataatattatgcacacctgagaactggtagttgatgtattatagttctctttttctccctttcccaacaaaatatttaagaggtccaaaccagctttgcaagtaaattctaaaaatgtgtaagtctaaatgtaacacatttccctgctagaagatacaaatgggggaagaaaatttgagatctgaatttctctgttaatttgtgaaaacaaattactgcctgttgaatgtatggttaggtcaggcaccgtggctcacatctggaatctcagcactttctgagaccaaggcaggaggatcgcttgagaccccatctctacaaaaaaaagttttttaattagccagatgtggtggcatgtgcctgtaagtcctggctactctggaggctgaggtgggaggatcattttagcctgggaggctgaggctacaggaagccgtcaaccactgcacactcgagcctgggcaacagagtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtgggggatttcatggatgcttatcgctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagarcaagactctggaaaaaaaaaaaaatcttcttggccttagaaattaaaatcatgaaaggagatcatctgctggtcccagaatcacttaaggaatattatacaaatttggrtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcncccatttttaatattttgccatatctgcttcccatttccctggctcttgcatgtcctctgtttctctctttccatggaagactctctggggtcaggcatgggtgatggaagggatgaaaancaggcccacctaaccctgcttgcagatctgactcctgtgagcttttgatgtgttttcattgttcnttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacanttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtgagtctttgctttttgttttataagttgatttttatttctacatttatcacatctttgcctttttgtcttcatttctcttttctggatggttacttttagtattttttatgtatttatatatttttatgtgtagaattaggcctcatactcagagttaatttgtcataaaagagtttttcttttccttgtttgtagaacatttgtctcaggtcatgttcacttayttgggtctgatcttaatttttcctcattaaagcaggaagccattccttggatttcttctgtttctgaaccaagaataaattaagagtaacaataagaggagtttgctttattccacttatagctaggaaccaggcacttatcttcatttgcttttctgggaagtatcagcttgctttgcacgtggttcatggacctgacatgtcatcctcccacaggtcctgggcccagcgtcattagcaagcatttattgagcatctgctcagtcagccctgtgacctcaggctactgatctttctcttcttttgtctgtttagggggggaaaaaaaacaacttttaaaaaaagaaccttttacatttttctaattctaaaataatatgtattcgttattaaactttgaaaatacagtaaagcataaaaaagaaaacacctgtaattccacaagccagagataaccactgaaatcgttttaatgtatttttttctattcacataaagattatacacgactcacccacttatgtatttaactactttatatataaatacatatatatatatttttttcttcttcttctttttcttcttcttttttttttttcacggagtctctctgtcacccaagagtacagtggcgcgatctcagctcactgcagccttggcctcccaggttcaagcaattctcccacctcagcctcccaattaggtgggactacaggcatgcaccaccacacccagctaagtttttgtatttttagtagagatggggtttcaccatgttggccaggctaatctcaaactcctgacctcatgtgattcacccacctcagcctcctttgggattacaggcctttattattatgttattattattattattattattatttattattataggtcattatcttccactactgttcaagtgcctacctctatttgcctttctgtcttctttttaatttgctcctatgggcttagaaactaaatagccaactaaatctggtaaaattatttatcacttaagataaatatgtttaaggaataacccgtgaggcgttccagttgaataagatgcaygtgtgtttcagtgcatgggtttttgtgacttctttaactctcagtgacctttttgcatctttcatggttctcagccctgttcgtaataggtaaggcagctccatagttgagttctggaaatctggggtgctatactttgatcatccagagaacagcataatccctttttttttttttttttttttttttttttgagacggagtctcgccctatcaccagactggactgcagtggtgatagggtatggtactcagctcactacaacctctgcctcccgggttcaatcaattctcctgcctcagccttctgagtagctgggactgcaggtgcatgccactatgcccagctaatttttgtatttttaatagagatagggtttcaccatgttggccaggatggcctcgatctgacctcgtgatccgcccgcctcggtctcccaaagtgctgggattacagatgtgagccactgtgcccggctgcataataccttttccttttggccccccaaaatttcctggcacgtaacatattgtgaatgagtgataacttaaatacgttcaataataacaatttatctttggtaatactgagtgtgcttatatacacagcacctactctttctagaaaacctcctcccttggtgctttttatacggacccccttttgtttatttacttctcccagtcctcaaacatgcatgtattcaaacacatacaccctctccttccccagtgtcctccgttttctccttttatcattaggtttcctttttggccatgtggaagtgaagagaattcctatgatgtcatcccttcacacgccacttgtggaactcctcagtggttcctctttgataggatgtaagtgctgcaggcagagagaggttgccattcctctctccaagtcccagagcagatggtacttgggcttggcaatctgtgctgcttcagctgcagaagtacttttgacctgtattttctgcagcccttttcactcttgaagacttggttcatctcctttccccatttcacagaatatttttatatgagaatataaaaaccatacccttacgatgttatctttcaacaggtttaaaaatgttatatttgaaatcagtccaacagaagaagttggagacttcgaagtgaaagccaaattcatgggagttcaaatggagacttttatgttacattatcaggtgggtatgcaccagcaggaaccaaaaactttctggatgagattcttgtccaagtaggagaaatagataaagaggagactcatctgaggaaagctgtctacattcagcagtgagctaggctccacactgcggggaaagaagctgagggtttcwgcatgtctggtttggtgtgtgcgctctggagagcttttgcagatgtcactcttcagaaaacatttagctgaagcttccacttagtgctgccactaaatcgagctgacaccttggacttgaacaaaatgcagaagtacacatgctgacactgcagaattctaagcccactcagtagcttgaaatctttttgtcattttgatttgatataggtacttaaaagttagatacattctgacaaggtgtgtgtaaagtttatgtttgtaaactgaattctatcttaaatccaaaaagaactcgggagtaattcatttttgtagcataaagatccctaagttttattttgaaatatctgatttttacacgttaaaaaataacagggcatcgagaggattcctaggtgacatccagactcctttagctttgtgtgtgtggcaccggttagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgctaaagccataaactccttaaggacaggtagcatttcttagtcatcttcgtttccttctcaatgaccagtagaccattaaaacatgttagctaaacaaatgtgaaatgattttgtgatgcacacagctaactaaagtacttccaccaaaaaaaaaaaagaataggaacctcttattccctcagtttcaccaaattatttttttaatttaaaattttttatttacgtggagttatcagaacatatttttatttttaaattttttaaccaaatcatgttaggccaaccagtctgcctgtggtaatttattaatttatgtacaaattcattaaatgtggggtaactgccaggtgtggggtattctgttaggcacaggtcccagcagccctcatggagctgctaggatttttccaacagataattgaacttgtggggtcctttctttttttggaggtgggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaatttttttttttttttgagacmgtttsgctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaagacttttgacccttgctttctcatcaccactcttmtaaagttcagaagtgagaccactcagatttcttaaacttgttcaggacaatggtgaaagtagcaggaaaagcgggagcattgcagtcagatctggatttatcgcctccatctctgtcctgttgtgcaagtcatttaacatctctgagtctcagtagctcatctttaaagttagaataatcgcacctcataaaaatttttgtgaggactttaaaagatactatgtaatgtgcttacacaatgccaagcacatggcagacacctaataaaacatcaagttctctcttttccccttgccttcgggatagaaagtgttctcatatggaatagaaattaagaatctatcagatagtattaaggtgacattactagccttatctcatttccccgtgcttagtatatttcatcataggtttaaatgcttcaccttttccagatttattaaaactagtgacccataacatggatgaaatgggaaaatgtcattgtgacttctgaaataaaaagcttagatgtgtgtggcwattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagatygacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgyatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcmcaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctktctcctctctctcctcctttgaccttctcctcgaccagccatcatgacatttaccatgaatttacttyctcccaagagtttggactgcccrtcagattgttnctgcacatagttgcctttgtatctctgtatgaaataaaaggtcatttgttcatgtttgtgtttttctcagtttcattgttaacagttcctgctaaacaccttgactagagtgagatgtatcagttaaaatcacaacagcagacaaccccttccttttaaaggagaaaacgtaagtccaccatcagatcattgaatgtctcaaagtgacttttaatgtgtgaacgtgtgactttagcctttttaatgaatatgcttaagttatcttcaccataaaaagaagggtgttgcgggaagcaaacattatatgtcacttaattctgattgacgaacggtggaaagtttaaaattgcaacagcatttaaccttttttgaccagcatactgttgttgagcacatagactgtgccccttagggggttcctatgtcacttgsaagtcaccagaaaagactaggggatgttgaatgtggaaaaagtaaatcacagcagtaaaaaaagaagaaaaggggccggcgtagtggctcacacctgtaatcccgacactttaggaggccgaggcgggccggatcacctgagatcaggagttttaagaccagcctggccaacatgacgaaacccctactaaaaatacaaaaattagctgggtgtggtggcacacgcctgtaatcccagctactcaggaggctgaggtaggagaatcacttgaagctggaggcggaggttgcagtgagccaagatcacaccactgctgtccagcctgggagacagagcgagactccatctcaaaaagaaaagaaaaggcttccttgtcagagggcagccttacttaaaaatacaaacgtacataagcatcctgttgtgttggtaaactgtggccagactatattggaaaattagtgacaggttgaaataaggggggaaacggaataattctaaaatagggaaaatgaaaaattggaggtgatggtttgtacgagtggttggagatgaccgcatgctcctctgaggaagagtgaggggaagagcatggctctcctggtgggactctggaaggtacccttctgagccccaggtttctcgttctgaaatggaaaggatgctgtctggtagctttgttattgaaacctgaaatattttaataatatgctctatattgtcctgcaaagaaatcaagggagttagaaaagtgcttatcaggactgggtgcagtggctcatgcctgtaatcccagcactttgggaggccaaggcgggtggatcacaaggtctggagatcgagaccatcctggccaacatggtgaaaccctgtctctactaaaaactacaaaaaaaattagctgggcgtggtggcgcatgcctgtagtcccagctactcaggagaatgaggcaggagaatcgcttgaacctgggagacagaggctgcagtgagccgagatcatgccactgcactccagcctgggggacagagcgagactctgtctcaaaaaaaaaaaaaaaaaaaaaaagaaaagtgcttatcggccgggcacggtggctcacacctgtaatcccagcactttgggaggccgaggcagggagatcacgaggtcaagagatcgagaccatcctgggtaacacggtgaaaccccatctctactaaaaatgcaaaaaatcagctgggcttggtaatgggtgcctgtagtcgcagctactcaggaggctgaggcagaagaatggcatgaacccgggaggtggagcttgcagtaagctgagatcgtgccactgcactccaacctgggcaacagagcgagactccatctcaaaaaaaaaagcttatcaaggtatagcaacattaaataagaaaaataagagggaaaatcagagtaggggctggacgtggtggctcacacctgtaatcccagcgctttgggaagccaaggtgggtggatcgcttgagatcagaagttggagacaagcctggccaacatgttgaaaccctgtttctaccaaagatacaaaaattagcccgcgtggtggtgcgcacctgtagtcccaactacttaagaggctgaggcagaaggattgcttgagcctaggaggttgaggcttgtggtaagccatgattgcaccactgcactccatcctgagtaacagcaacaccctgtctcacaaaaaacaaaaagaaaaaaaagtaggaaagtaagatggaacccagagcaatggcagagtgaatgccatggagtcccagctgctgctggtggtgccactgcgccaacggggagggagacggggttgtcacagccctgctgctcattcttttgcctgtgtatccctgaaaataatttgggaaaacgtatacatcccttcacacattttaagtttgacaaatacatttttaatgtttaaatcaagagtacctgctagcatgtgaattttaatataaaaatgaccataaaaatatcgaatggaacccaccttcattcatttttaaaggtacatgaacaaagctcttagttggaaatttcttttttatttcttttttattttattttatttatttttgtttgagacagaagtcttgctctgtcgcccaggctggagtgcagtggcgtgttctcagctcactgcaatctccacttcccaggttcaagcgattctcctgcctcagcctcctgagtagctgggactacaggcggctgccaccacayctggctaattttttgtgtttttagtagagacggaatttcaccatgttaggcaggtctcaaactcctgacctcaagtgatccgcccacctcggcctcccaaagtgctgggattacaggtgtgaaccactatgcctgcccctggaaattttaaatctttacaaatttaacgttttttttctctactctgcttccttcagaattttaccctagtgaaatattttaaaggacatcttatttttggtcatctgtaacaaaaataaaaatttgttttcgtgaccataagcctattaacccaatctagaaaaacattttgcatagttacagttattagtgcatatttgattgcagtaatttttttttttttttttttttgagttggagtcttgctctgtcgcccaggctggagtacaatcttggctcaccacaacctccgcctcccaggttcaagcaattgtcctgcctcagccacccgagtagctgggattacaggagccctccaccacgcctggctaatttttgtatttttagtagagatgaggtttcaccgtactggccaggctggtctcttggctaggctggtctcgaactcctgacctcgtgatccgcccacctcggcctcccaaagtgctgtgattacaggtgtgagccaccgcacccggcccagtaatgtaatattttatcttgacaattctaaaagatatttgaaatgcatttttttattttgtcattggtatctaatgaaatgcatttattgatgagataaatgaaagtcttttaaaatgaaagtttaaaaacatggtagacaaatattcttgctagaatgagatggggctcatgaccaattctatttctatttttcatttttataactgtaagctccgagaaacactggggtgtttcattacagcagtgtcacacatttctcaggactccttagtaactaatccaaaagactcaatgatttataataagttataacatgaataggttctccaactttgttgaaagcaaaagttaaaaaaagataattacctaatttggagaatttattatgcatgcaaacattattcactttctcaggacttgggaagtagacaaggggatttaccaagacttttaaagtaacccaattataactctttttttcttttttttttttttgagatggagtctcgctctgtcgccaggcgggagtgcagtggcgtgatctcggctcactgcaatgtctgcctcccgggttcaagccattctcctgcctcagcctccagagttgctgggattacagatgcccgccaccacgcccagctaatttttgtatttttagtagagatggtgtttcaccatgttggccaggatggtctctatctcctgacctcgtgatctgcccgcctcggcctcccaaagtgctgggattacaggcatgagccgcggcgccagcctatactcataactctttaacttaaagatagcttatttaatccaatatgttaatacgcttgggaaaacagaaatattttaatactcctttggtactataattttttaacttttattgcagggaactttcaacatataaacggggaataatgtaatgagcacccatgtgtccatcatgcagcccagcaattatcaacacacagttaagcttatttcacctgtacctctgcccaaaccctcttgggttactttgacaaaacccaggtatagtatcatttcaaccataaatactgcagtacatgtctctaacacagtttttttttttttaatcacagaagatatttggctgtttggaaatatttttaattggcctgacgaaagaggtgctactggcatctagtgggtagaggtgagggatgccacttgacatctttcagtgcaacaggacagcccactgcaaccaagaatgatccagcctcaaatattaataatgcctggggtgagacgctgctcttacagataaggacttaaaaaaaatccccatcccatcatcacacctaacaaattattttaaaatatcaaattattttaaaatatcacaccgtttaaatatcaccatttacatttttaatttaaatttttaaattttaaaatatcaccgtttaaatttccccattcatcttatcattgttcagtttgtatttttgaatcaggtgccagacaagatccacgcattacatttagttgataggtctcttaaatatcttttccttttcttttttttttgagacagaatctcactctgttgcccaggctggagggcagtggcttgatctcagctcactgcaacctcagcctcccaggttcaagtgattctcctgcctcagcctcccgagtacctgggattacaggtgactgccaccacacccggctaattttttattatttttagtacagacggggttttgccatattggccaagctggtctcaaattcctgacctcaaatgatccgcctgcctcggcctcccaaagtgctgggattttacaggtgtgagccaccacgcccggccatatataattttttgaatgctcaaattgtcccctctttgaccaataaatttccttcacagtgactgttgagtacttttgacgtgaccctagtaatctttgatagtttccttgatttctagcataagacgttccaggctcatcttattgcatttctcaaccccagacctggaatccaccatttttctgtggagccctggttactgttagcgggtaatggtatttcaaggatgcagtctgggtgggtgctaggggtgttcctcaccgttagattggtcattgtgtcctttttttttttttttttttctagagacagggtatcgttctgtcacccaggctggagttcagtggcgtgatcttggcccactgctacttccacctcttgggttcaagcagtttttctgcctcagactcctcagtagctgggatacaggcatgtgccgccatgtccagctaatttttgtattttttagtagatatggggtttcactaagttgtccaggctgatctcaaactcctgacctcaagtgatctccctgcctcagcctcccaaagtgttgggtttatgggagtgagccacggcacccagccttttttttttttttccttgcaatgtatttgatgctaatcctgtagaatcacattctgggtttctcatgtcatcctgtggatcagactcagtttcaatcttgtggcaagaatactttggttttcctattacatcatgtcagggcttatgtttttatgatgtaaaggctgatctttggattcagatgttgccagcttgacccattcattataatttcccatcggctttcaccacgtatcacatggattcagcagccactggtaatggctgcc

SEQ ID NO: 10638 - DNA, 12201 bp, Homo sapiens
gtaaattaaaagatctatacaaagaatgtttacaatatgtacattaggactggggagttcctgggaggagaatcaatcactgctggacatgaggaatatcagtctccagacagtcagctctgtaaactgattcagatgattaagaatttcagtccaagtcaacaagtatttattgattacataccatagtctctgcaaagtcttcatgaaataacctcttaggtttagctgtagaatactctggagctatggagaaggtagatctggacatggaggtaattttgcatgtttttcagtagaatagcattacaaagcaatctttccttatattattattattattattattattattattttgagatgaagtctcactctgtcacccaggctggagtgcagtggcacgatttcggctcactgcaagctctgtctcccaggtttacaccattctcctgtctcagcctcttgagtagctgggactacaggcgcccgccatcacgcctggctaattttgtttttgtatttttagtagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagtgagttatttaaaacaactagttcacacacataggagttgttgctgataaagaattggtggaaatgatattaaataacaattgtttttataagtttcctctgcttcattaattttatgattgtgagaggccacgtgactggatatcagcatacaggactttgtatcagaatatgagcttggcagtcataagagattacttacaattcttcacaattctgtattttcatttctaaaactccataaagtttttataagaataaattgtagcaccttattcatactggaattcaacagttcttagttcaagtctcccttgagaaagcttcactgtgtttttagtgcagattagtaaagataagatcttgactggtaggtgagtgggtggaatttatttcaaatatgggggctctccaatgcttgcacaccaaattcatttacatattgtcaaaagccagaggatatttatggtaagttgcaaaaatagctacaaattctttgtagcccattctgtcaagaaatgcaatctattaatccacctcttgatgtgagctagtactatgacttgctttgaataacagaatgtaatggaagtgatgttgtgagttttaagtttcagctcaagacacctactgtttctatcttgcacaggagagctttccagcacctgtgataagcctcagcccgcctgctggataatgagcccacatggattgagagaggcctcctatccctgccaaacctattgatgctacagagatgtgagggagcccacctgagaaaagctgaacctgcccagtacataaaaaccactcaggtgggttgagcacaatttcctgtcttacagaatcatgaggagacactaaacaattatttgaagtcattaagttttggagtactttattacataaaaaaatctgacagatacaagagtcttcaaaaaaattttgtttttcagcaatgtcttagtgcttctgtggctcacaggctcccacatgcctggagtgctacagggagaaggttaaatgaatgaggaaaaattgataggctttcccagcccaaagcatgatgttattatcattatcattattaatatttgtctttatataggagttaccacttgggaatagttgctatgtgtcagacactggattgtatttaactttataattgtacttatctatcatttcattttaccatattaactatcatctaataattttccttctgttttatagaaaataaccttaaggctcaggtgttttgagtagcttgcccaaggtgatgcagctgataaaatgaaaagcagcatggaatacatatttatcttattacaaaatctgtattctttttactttgctactctagactctcttattattgtgaagcagctttaactactgcaagacagaagtcttggccttcagagtaaaacttcaccagtgcataaagtcagactaaaacaatttgaaaatatacagtcttagagaatgttataactgtttattagaactaacataaattctacctaatttcttagagggctcttaatgatgtcaattataatggcacatcccattgttattttagtcgtggaatcaatggcatgtcaataagtgctttctgagaaaattgttggacaaagtactattttgaactccaaattttattcccactattaatttatgaagagggccttttctctttctactagacaaaggtaacaaattagctcttgttaaaatggtatgctgttcttctgagtctcatttacttactactttaccttacattaaaattatgacctgaagacagaagcaactggaacaacgttcactgtgttatggccggatgaagcaggaagaggaaagagacaaaactaggttaaagatagaaatggcatctattgggccagtagtggcctcacgcctgtaattccagcactttgggaggccaaggcaggcagatcacgaggtcaggagatcgagaccatcctggttaacacagtgaaaccccatctctactaaaaatacaaaaaattagccgggcgtggtggcaggtgcctgtagtcccagctacttgcagtgagccgagattacaccactgcactccagcctgggcgacagagcaagactctgtctcaaaaaaagaaaaaaagaaatggcgtctattatctcttcaatgactttgccttgcttggactttcccttcaccccacaggatgtgaggtctgaaacggcaccctcaacttcccatccaagatacaattctaatcctacatttaacaccctaacttcttaactggagttgagttatttaaactgtaattttaataggtgaaattctggactaccatcccaaaacattttgctcatttgccaaagtcctaaggaatttccatgagatacaaagcaggtgagtctggatacaggaaaaaagataaaaacatgttatttgctacacagccagaaggatattgagtggcaaagggagcacatctcaaaggggacctcaaaaaccctcttcatccacaatggcaggagctagaaagaataaagccacctatagggtcaaatatctctcctaatcatgttaaggcactggattctgaattcgcacagaaggagactctcacccatcactcctcacaaggactcatggcttgccccatagcatcacatctgtgctgcttaccagctgcgtgaccctgggaaaagtccttcaactctctgggctttaatgtcctcctcggaaaatgagaacgatattaaaatatgacaagtatatgtaaagagtccaggaatttttcattccaagtgcagtgtatgtacatttctcacaactgcctaatgaggtacctcaatgcctccagccaaagaccagcaggagcatacaagcaatgaacaagtcagctttattgtttattgcaatgatggataaaactcaccatgagaatcatgcagcccctcagtaagagattgttggaaccaaagaagtagaaccacgagaatacatatattaagagaatgatgcaaggaattaatttttgcatctgtgggggtgggctaggcaagtcagagatcctctgggaggtagttatcaggaagggcaggctggaactctcagcacaggctgacacactgtccagagtggaatttctgtttcctcagagaaacctcagctctgctcttaaggcttttcaacagcttagattaagctcacccagttttcctaggataaattcttaaagtcaactgattatgaacttcaatgacatctacaaaatatcttcacagcaacatctagattattagtgtttgactgaataactggggatcacagtctagctgacacataaaattgaccattaatcagttgtaaggtttgtgcttgttttaggtgattttggggaggatttaagaaagagggattttgcttttaattggattctgacagaaagtggagggttggggtggcaatgttatgattgggtagcttcataaatcctacctagagggacagaagactatcctgaggctacagacgtggttggtaaagaagcagtaatcactcccaagagagagatgtgcctggtcatttttgtggtttggacaatatttgtgttttgtctgggttcagacatgatgactgagcattcaggtgttctgtctcaatccactgtgctcacagagtacgtgtctgattctgatgttctatgaaatcctttatctccaacaggagaaccaaaaccacctgggagtgccaggctagctgctagcaaccccaagcctttgttaattacatccagacagctctcaggtgtcaggacatttttttttgttttactttttttttttacagtctctgccagtgggaggtaaaacatagtgctgagaatctcagaaggccatttatcaaggacagagtgtttctaaatagaagctccattaacttatggtttctatcacatacagaaaatagatgcatctgaaaaaatataataagtttccctctaaggactaactttagctcaatctctagtcccttgcaaatatttggaattttaatgtggtaggataacaagttttaaaagatctggtagtttaagaaaagaaaaccatttttctaagtcagtgcaattcttcttattctaccctcaacttttgacttcatattcttaatttttttaaaaaaagttcttagagtaattgagccagccaaattttaaatgtaatcaatgtccccaaatttcctttaaacatactcaagaagcaccaaaacacagaatataaggattactcaatgcaaagaaaaactgtataaagtctcatacagttactatagacagcaccatctgacattataacccctttttattgccctggccaaaaccacttggatcttttgagtgcttgagaagaacttacccagctggatttatacaagtagaaaaggcaaaggtattgcttggctaccaccagcagagatccctaggtaggtggggtcaacttaacatttggagaattccacgcgcactatggaagcaaaaagaaaaacagctaaccctcatacagaagccagagaaagggcaggggatggggactgccagggagggaaatcaactcagggaaaaattcctggaggttgtaacccagaaaatcctgaaggatgccatataattgatgacctcatctatccatgaggctgctcagaaatgcccacccctggccaggcgcggtggctcatgcctgtaatccaagcactttgggaggctgaggcaggcagatcacgaggtcaggagttcaagaccagcgtggccaacatagtgaaactctgtctctactaaaaatacagaaattagccgggcatggtggcaggcacctgcagtcccagctacttgggagggtgaggcaggagaatcgcttgaacccgggaggcaaaggttgcagtgagccgagaccatgccattgtacctcagcctgggtgacagagtgagactacgtctcgaaaaataaagaaaaagaaaagaaaaagaaaaaaaaagaaaaattcccatcccttttgcgaatggcagacatgcacacaccagagaagattccaatttagtgtcttccctctcttcatagaacaattcctcaagtccactctgagtagaggctgcatcacaacaaggggattgccctgtctccttccagggctcttaatagaaactcttcagctagtaactgagatgtcaccatgggggatttttctaattggccaaaacctgacctggcagggtttggtttgggtgtcttcagatttccttgtcttgaggccctcacaattgctctacagctcagaacagcaactgctgaggctgccttgggaagaggatgatcctaaacaaagctctgatgctgggggccctcgccctgaccaccgtgatgagcccttgtggaggtgaagacattgtgggtgagtgcatgagtgaggaatgttctctggagctgaaaaacagtaaattgaaggaaaagagagaaagcgatttgcagagaaattgtagagatttcctaagacccctttcagtattaagagaattaaaaattatagctgttcctccttcaggaaaccagagccccaacctactctttttgttatgtatgcttttgtgttcactaaggatgctattctgtttatattatattcagtgacaacagcctggaggtctctatgtcgttccgtcatgattgcctcaaaaattagtgaagtttccatcagtggataattttttattattaaaaatgtatgaagtgtcattctcaaatttccctgaacaacttttgaagcttttcgtatgtctcctgtagtagatcttggggtcgttccatcaattatatactctatagatattaaaaaagttgcccgtttctttctctcagacttactcacatttccacatgggaactggcacaggtggggagtgggtaaaggagtccagcaggctgaatgccttcaacaatcattttaccacatggtcctcacttactctcagctgcctcatatgtgtcacctcacaaataatcaaataaaatgggcatgtagctaagctttgtaaatagtgaaaacatggatgtcaattgtttttacatatttctattacaggtatagcttcacatttcttttctttagcaaaataagggatccttttagtttaaaattgagaagtagaaaaaattggtaaattaaatcattttattctcaaattatcaacccaaattacctgttcttcacctcatctaataaagtcctataaaaagaaaagtgggccagacatggtggctcatgcctgtaatcccagcactttgggaggccgaagcaggaggatcatttgagcctgggagtttgagaccagcctgggcaacacagcaagacctcatctctaccaaaaaataaaataaaaattagccaggtgtggtggtgcatgcctgtggtgccagctactcagaaggctgcagtgggaggagcacttgagtccaggaggtggaagctgcagtgagccatgatggcaccactacactccagccagggcaacagagagagactctgtctcaaaaagaaagaggaaagaaagagagaaaggaaggaaagaaggaaagaaggaaggaaggaaggagaaagggaagggaggaaggaaaaaagaaagaaagaaagaaaacggaaggaaggaagcacagattaattatttggtctctttgtctcctctgcctttgtcgtccatctcttcccacctctcttcatgcattcctttctccctcttccctttcaggatccatctctgactccctgctcctttatagagatggacagtgagtttgtaaaacaaaagttgaaaagtcagatagttaaaaggggaagtgaactggaaggtactctaaactttcacaaccttattaaccatggctgctcccattctgattttgttcagcagtggaagtttcacccgctcctccagagcgcttggcttctttgttccaaatttcctttcttcaacctcacaccagagtgccctggtcaggctcagctcatccattaggcacaatgtgggcagtgcaggggaccctccagactgtaaagccacatgagaatgttttaactccttttaaaattataaaaaaatgaaattgtagagcctaagaaaatgttttaacttttaattcagcctatattatattgtctttataccaattcagtcataaaatataattttccatatttttatggaggaaggcgtccacacaagcaagagtgcttggggctcacatgtcagaacgcawccctgatcatggctgatcctgrccttcgtgtggttctgctaactatgtgcctgtcagtcttccccaaaatctatgtggtcctcaaatataacaactgtcattcaatacacatgtttgagcacccagtgagctaagttttaaggattcaaagatgaaaagtcatgctgtctccyctgcaragggtgctcagactagtgatggaaacagtatgggatgaaagaaagcagaaggccattgctgagcaggcagtggactcagcagaggctgaaactatacaagtgacttggttccagctgggccagcaggataaccagaygaaaagaaggattgcatatattccatatatatttatgtttgaacaaagagtcaaggtttattgcaaggataaggaggttttgttggtggcctgttaagaccatccagggtggtcatactggatagggaagaaggtgagctggaagaggaacagacaaacttggatggccagatgttgagatggaggagatggaggtcataacgtggtcaaaaacatgttgatgagaggacttagctacaaagttgttaacttaagcagaaacctcaaggattgattttatgatttctccaggaagtcctaaaagttaatttcatttcagggagaaaaacaacagaccactgcaaagaccaggaacatgaaaggataatgtagtttggtttgcttggcagatacttgtgaaagatgttggactgtaaggctgtcaatatcctcctcgcagaacttactacagtacattgtatctgctcccttacctacctgactctcccactattcagtttgttccttaatggtagaccatgcctgatcggtgttttacacatcccctgctatgtctgatacttgtggatgctcagaaagtggggaaggaaggaaagatacgatggtaaaaggcttacacatgtcttgaccagaatgttcagtttggctcatttggctggagtcatactgcatggctgccattctgctctggcatcctcagagaagcacactgcccattagaggaaaaagggtgaatataaatgttgagtcagaacactgcagacatttagtaacctccttcagaggaaaaaaaaaggtggggggaatgacagaaatccaaaaactagtagagcttccactttttcatttcagaagaaatcagttactctcctctaaggaccattactattaacaaaacagagaccttagaaggaagcattatttatttatcatatattttgtaatgttattaccgttcttgttatactctttcttataccctaccattgttagcagaaattattttaaattaataagatcctgcatgcttttcctttttctaaaaaaagaaagatctctgtgtagaatgtcctgttctgagccagtcctgagaggaaaggaagtataatcaatttgttattaactgatgaaagaattaagtgaaagataaaccttaggaagcagagggaagttaatctatgactaagaaagttaagtactctgataactcattcattccttcttctgttcatttacattatttaatcacaagtccatgatgtgccaggcactcaggaaatagtgaaaattggacacgcgatattctgcccttgtgtagcacacaccgtagtgggaaagaaagtgcacttttaacyggacaactatcaacacgaagaggggaggaagcaggggctggaaatgtccacagactttgccaaagacaaagcccataatatctgaaagtcagtttcttccatcattttgtgtattaaggttctttattcccctgttctctgccttcctgcttgtcatcttcactcatcagctgaccatgttgcctcttacggtgtaaacttgtaccagtcttatggtccctctgggcagtacagccatgaatttgatggagaygaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatggtatgtgtccaccattctgcctttctttactgatttatccctttataccaagtttcattattttctttccaagaggtccccagatcttctcatggcaattgctgaaattttatcatttctcatctctaaaatcacatattccaatgtaatacaagggtctttccattatgcattcattaaatccttctaggagaggtctcatcaaccttctactttattaaacatgcccacagagagaagggcacaggagtaaagcagaggcaatgtgtcgttgctcccaaatgtgtcgttacaatgtgtcgttgcttacccaaagaggtaaataaggcctctttgaccagcaggagaggaaatgctggtaggaagactcttccaggatgtaatgcagaagaagctcagggcagagctattcacactttacaccagtgctgtttcctcaccatagaggttcctgaggtcacagtgttttccaagtctcccgtgacrctgggtcagcccaacaycctcatytgtcttgtggacaacatctttcctcctgtggtcaacatcacmtggctgagcaatgggcastcagtcacagaaggtgtttctgagaccagcttcctctccaagagtgatcattccttcttcaagatcagttacctcaccttcctcccttctgmtgakgagakttatgactgcaaggtggagcactggggcctggatgagcctcttctgaaacactggggtaaggatgagtttcaccattttttgatgctttcttgtctgtcaagttcagaacttcctgccttttactctatatcccaaaacttgttttccacacttcatgagtttcttttgtcttttttttgaaagaattaagcaacaaaagcacagatttattaaaaaagaaagtacactccacagggtgggagcaggcctgccacttcatgggtttctaataacagacttcactctcctccctgagccaggggccttgagtctttgcagagccaaccctccaccccatcccatccctcacacatgcacatgagcacactctgcattctgacctcaacaacttcacttccacagagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtaagtttgagatttgttagagctgaagctgcaggaaggaaagtgggaggaggctgtggacatgaatgtggttgaaagttgtaggggaattgggaagtggcatgatgatgacacaggagcccccttggacccatcgatctcatgtctgtcctgttgcaggtgcatcaccatctacagcagcggaagagtggacttgctacatgacctagcactattctctggcccgatttatcataccctttttctcctgcaaatgtttctcctcttaccttttctctgctttttttttcttaagcttctgtatcccctcagagctcacaaatgcctttgaattctttccctgacctcctgatttttttttcttttctcaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaa

SEQ ID NO: 10639 - DNA, 72779 bp, Homo sapiens
  misc_feature (1)...(72779): n = A,T,C or G, or insertion/deletion polymorphism (see Tables 1-2)
caccacgcaccttcaccactcactgtcgtcaccaccatcatcaccaccaccttcaccactcactgtcgtcaccaccatcatcaccaccaccttcaccactcactgtcgtcaccaccatcatcaccaccaccttcaccactcactgtcgtcaccaccatcatcaccatcaccttcaccactcactgtcgtcaccaccatcatcaccaccaccttcaccactcactgtcgtcaccaccatcatcaccaccaccttcaccactcactgtcgtcaccaccatcatcaccatcaccttcaccactcactgtcgtcaccaccatcatcaccaccaccttcaccactcactgtcgtcaccaccatcaccaccatcaccttcaccactcactgtcgtcaccaccatcaccaccaccaccttcaccactcactgtcgtcaccaccatcatcaccatcaccttcaccactcactgtcgtcaccaccatcatcaccatcaccttcaccactcactgtcgtcaccaccatcaccaccaccactaccaccaccaccgtggccaccatcatcaccaccattagcatcaccactgtcaccgtcagcttcaccaacacaccgtcaccgctcaccgccaccaggatcaccaccacccagacgcactgacctcatatcctggtggttttgttaattatacgtacttggttcttccggtgagcaccttgatgactttaaatggtatgcttgaatttagtgagcaccttgatgactttaaatggtatgcttgaatttttttttttcacttgacagctttagagattgtttcttgccttcccgcatggaagatgaggagaatgggcctcgcttctctctcttttgcctcctccctcatcttccatctcaatttggtcagttacattatttttattatgtcgtaaaggtttctgtaactatcacaaagcctccatgcgtgggccataggttggtagacatactataataatgaaaaaacatttaccactgagccatagaaagagaagtgaaatcctagttattaaaattctgttctgtaaaaaagatgttctaggattcaaggctaatggcttttctttttttgactttcttcattttttccaggccattcttgaccaccgggttactcagtaccccgcttgtcaccttttggcacagactcttttgtttagtgggagtatctccttgagtgggtgctaaacatatttgacttttaaatttacgtatatgtgaacatatatgtttaaacatatacatttatatattaatatatacatttatatatataatttttttgagacagtgtctctctctgttgcccaggctagagtgcagtggcatgatctcggctcactgcaacctccacctcttgggttcaagtgattctgcctcagcctcccaagtagctgggattacaggcacacaccaccacacccagctactttttgtatttttagtagagatgggtttttttttttttttttttttttttttttttgagacggaatctcactcagtagcccaggctggagtgcagtggtgcaatctcagctcactgcaagctctgcctcccgggttcacgccattctcctgcctcagcctcctgagtagctgggactacaggcgcctgccaccacgcccagcttatttttgtatttttattagagacggggtttcaccatgttagccaggatggtctcaatctcctgacctcatgatctgcccacctcggcctcccaaagtgctgggattacaggcgtgagccaccgcgcccggctgagacgggttttttttttttttttttttgagacggagtctcgctctgtcactcaggctggagtgcagtggcacgatgtcggctcactgcaagctccgcctcctgcgttcacgccattctcctgcctcagcctcctgagtagctgtgactacaggcgcccgccaccgcgcccggctaaattttgtatttttaatagagacggggtttcaccatggtctcgatctcccgacctcgtgatccgcccacctcggcctcccaaagtgctgggattacaggcgtgagccaccatgcccagcgagacggggttttgccatgttggtcaggctggtctcgaactcctgacctcaaatgatccacccaccttggcctcccaaagtgccaggattacaggcgtgagccactgcacccggccgacttttaaatttatattgccctttacaattagaggtattttgcaactgtaatttgatgttggtatgaacttccatgttctcgtgtgtcctaatatgcccttatttgtcctcattcttcattactagtttggctggatatagtgttcaggttcaaaatatgtttttcctcagatatttgaagacattgctgtttttcttcattcttaaaagaatatttttcttggaaagttaaaaaatatccccccatggtttcttagcatctggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgggcggatcacgaggtcaggagatcgagaccatcctggctaacacagtgaaaccccttctctactaaaaatacaaaaaagatagccgggcgcggtggcaggtgcctgtagtcccagctattcgggaggctgaggcaggagaatggcgtgaacccgggaggcggagcttgcagtgagccgagatcgtgccactgcactccagcctgggcgacacagccagactccctctcaaagaaaaaaaaaaaaaaaaacttgcagggttttctttcactctgaaggttgaggtttcctggcacgtgggtgccaggggcgttgtctttcctcattgtccttcttggcatttcacggatcttgtgtatctgaagatgttccttcagctcagggaagcgtcttccctgtgtgtgctggagctccggccggtggagctcctgctatgccggctcagacctcaggccccctcacctgctccctcggagttcctttctcttccgttagcttctcactctgcatcagttcctgaactccatctagaacgctagctgggtcttcagtttgaaccacttcctcatttggctcaccccctctagatttagctcagcgtccctttctgaatgcaggagcactctggttttcagactagttccttttcatagcagctagttttgtttaatagacatggtgttcttttgcaactctctgaagaaactatttaaaatttctttaaaagtgtttcccagggctgtcaggttggtcacctgaggccttctctcccacctgggtctttcagcactgagaggtctgtggcatctcctcgtgttggagtcaagtcctgtaggcagcatagggccctggctcagcttttctctgcagaggcctcgcttgagtgggtggggtttgcccgcccgcagacctccacgggagggggaggggtcaggcctccccagcggccctctgaagtcacttgcttcacggaggtgttactgtctgctgctggacagagcatgatgggggctgcaagggctccctcaaaccctggactcctccaacagagggctcctggttgccaggctcagctctgccctgcgtcggccccagggcgtagggagggtgtttaatcctggcccgggccttccccgcaggtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacggtgaggcctgagccgggcaggggcgggggctctgcgcaccccgaccaccctgaccttgccccgtctcgccctgcagccacggtctacgggaagggcgtgtatttcgccaggcgcgcctccctgtcggtgcaggaccgctactcgccccccaacgccgatggccataaggcggtgttcgtggcacgggtgctgactggcgactacgggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggggcgcggcggccccctcctcggtgtccgctgcctcctccttagcccttggcctgagggcggaggcacagagcccacattgtgcccccgcgccagcccaccccctccgagacagagccccattcacctcccgcacgccagtgctcttggggacgggggctggggagtgtgcgcgcgtgggtatgcgtgcgtcctggttgcgtccgcggtgccggtgtacgcgcycccactgtgggccgctggagctgcggcccgggctccctcccggcctcgctgcagcagagctcccgcggcccacgccgctgcggctgcagctatttataggccttcgctgcggagatcgaggtgggactgcgggctgaggtggggtggcgtgatggggagtcctagaggtcgagagagcttggaggtggactgccggtgtccaggggaagggcttgggtgtccttccctgatgacccggtgagtggagggggcggtggtcagctttccttgatggcctcgcctgcctgcgattagagggttagaggcgggtccagtttgggatggaggcagtggaggccggcatctgagtgaaggtagtcaccccttccccttccatttgacagagtggaaggtggtctgtcgtgtgccggttgagcccctgggtgacagagtaggtgggtggggtgtgggtgactaagagaggagagtggcagtcagtgtgtgggagtgggggtggccagggtggtcagtgtcctggtgatggactggagggtaaggccagtggctggggggtcactgtgtaggtatctgaggagtgcgcgggagggggcaaggcagtcatggatggagagagggtaagtcagtgcctggggccagagcatgggggtcaatatgtgggtacagcagagtgcaggaggggtgtgggtgccagtgtccaggcgagaggctgggtggggagagttcagtgtctaggttaagaaggtggtgggtgggtcggcgtgcakagtccactcctgaacaggcagagatgtgacccctcctgctccccttccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcaggtaactgcgcagggccttgcctgtgcacctccttggcacgcgaggttgactgagttcccgctgcgtgctaggcgctggagcggggactgggtgggggaggcctagggggatctgcgggtcacggagggcctcgcgcgtcccaggtgagtgcaggcggcacagcgccacctgccggccgcgcccaggcggttcatgaggcctggggttgggcttcttgccgcggcgtccatccttgattttaacacggtccagtgcccagatgcaacaaggataattttttgggttccccaccaggccctcggtcttggctgccacaatggcggccaggtgggaatgtacaggagcagtgtatagggagggggtacctggttgtctggagccccagcctcttcctgagccaggatctggccttgctttccagtagctccccatccagggagaacgatgggaagcatccagcgagatgcttggggaagggggagggcaggagggaagtgggtgacctakagctgtgctaggagagggaggagcagtagctctctaggctttggcttgagagtcctgacctgttccagccggagggcagggaggcccctgcgggaggccaggagagggctgcaaggccaggtgctgagccctggggggatgttgcagacgacgggaagcggggctggtaggmgcaggaaagagggaaggagagggtcactgctgtgcacccagctccagccccagggtctggttccatctgcatgaccttcagggcttttcacagcacacacggactttaaagaaagaagtcactttcttcccacttgaaagggaatcacttgtgtcgttcccacgcctgggctttcttcagcatcacctttacagttgtggaggagtgtggggggtcccgaggccccggctgaccgtggttgccttcggtactcactgcaaaggctttgcccccagccagcaccttccgcgccggggctctgcgtcctctgacggtttccttaggaccgattcctggaagcgggacttgcagttacaggacatatggcattaagcttggagaaaacacggccaggggcatcccagacagggtggccgacattggtgaaggcggggagagcgggggctttgccaatctgatgggtggaaagagttgttttaattatcaccaagcattttttccttctgtgaatgggctattccagtcctcgtatgtgtacttaatttttcttgtgtgtagtgttttaagggttctttataccgactcagtcgtctccaatgttgcaatgggaaagttctcagctgcacgcaggaagcaaggtggggggcgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgggtgctggaggctccgctgcaccccgcgccccgcgcccgccggcatggccggcccgctgcccgacgagcaggacttcatccaggcctacgaggaggtgcgcgagaagtacaaaggtacggccccccgtcccgctgcctgtcgggccgctcctgacagcccagccgccgagcaccttgtcgtccacggtggcggtcccgatcgccggcccgagcgcggccactccgccggcctcgtccgcctggatcgcccccaacggctgccagtgcctagggaaggggaggactcgctccgctgagcccccgaggccatgcccttaatagggcatcgcgcggctcgggtgggtggggtgggccgcgggcgggtgggggcgctcagggcttgtcggggtcggctgtctgagccaggatccggtgtctgtggccagcagacacatgggtcaaggctgagccatcccctgccccacctctggggcgcgtctgcatggaacaggggcagcyccgccgcctggcaatgggtcacatagttgccgcctctcctcacctccctaaactggcgagggcctgggctgccacccttccttggcagggcaccccccccacaccccttctctgttcactaggggacagctgtgggctaggggtcagggtggcccctccttcctctctaggggagcatcagagtggcctgcccacctgcttgatgcctcggcagacccccttgccctagtccacgcccacggggagcccctggaccctcccaggtcctggtcccaccggccattcttgcagcccagctgcctggctcagcctgggtcgcccggctccaggcggttgtggacacagcattggctgccggcctgcagaggcttaggagcaagggactgagctgctggggagggtcgcggtgggggcccccaggcagagccgatcagagcagactccagctccacgtggctggttttgctggctctgcccccaagggcagctcagggagagaggtcctgctggggccccgtggtgccrctctccaccacaaccttgcccagctgggtaggtttcatggtgccccgaactcatctccttcaggcgtcctccagcgacggctctggggcagggtggatgtactgctgtggctctctttgacagtgctgtgcccagccgctttgcctgtgtgactagttcattcgggccaggggagacactcctgcacccttggggaggcctggagcgggcagcctgttgctcatgctctacatggccggccctgccttagagggagcacccggaggggtgctggggtatagggcagggaagcagccgcccacctgggctccagccctcctggcaagccccaggacagagctgtttctgagctgaccactctgttcaaagtgcgggaactgtgcaggatcgtttcctcctggagttcttcatctggtcaggttgctgggctgcctggggtgccccagcctgttctgggcattgtgctgaggctttcctggccccagggctgtctttcctctacctcctggggtgggaactacttctgattcatccaggggtgagccagacagatccctggaggttgctgggaccctctgtcagggtcctccctcccaagcgcagctcctctggaggccaggattggtgttgggcacactcgcagtcttggcccattgtctgccttctgggcttggtggtggaggctggtgagggggcaggggggccggggggcttgcctgaagtggagttgtcacgtgatggtgcagctgcccgcatgtgtgtggcactggcctgagagtggctaaacagcaaggcaggtgctgaggctccgtgagcacaccaggtaccccaagtctccttagctcctggcttgagacaaggggacgggaggggctgggctggtacctgtgtctgggagccacggaccaaggctgaggagggcctgcaggaggtcagaggtggcccctgtgccctacacctttccaggcctgacctctgtgagccccttggacctgctagagggctggagccccggcccttcctgtccctggggtggagggactgtgggagggcatggcaccccttgccagccagccagtgacggcaaggcagccccaaatccctccatggtaagcagctgcgggcccctgtcctgggcccagctcagcatttggtggttctgaggagggcagggaggccaggcctgtgccccctgcccagctgatccctgcactgaggaggtgctctggcttaggcctcctggcctcctcccctctgtggcattgcctcggttccacctcactgtgccctctcacagacaactccctgtctgaccctcactccggtgaccttcaccccccaccccacaacgtctcagaccctcccctggacacgtcattccctggctctcccctggaaatccccggtcttccctgtacagtcaggcggccactgctccgcttggaacatcgccaacttcctgtctgcctgagcccctcagcccccccattctccctgtcccccatccagggcagattcctctggggctgaggctactgcagcctgtggcgggagagctctgggcaccctgtgggagaggcctccgtgctgagggctgtgggctggtgacttagacagtcggcccagctgccaagaggtgtccagtcgcccagcgccccaagcctggcctgtgacagctcatagaggctgggccgttctgccgcaccatgggagcctggagagagacctggggtgggtgtggcagggcggggacagttctaggagagagttgtggcaatgcaggtgagtggaggtgaggcggccagtccataactgaaaagagagcggtgttgccaggggctgggtgagaaaatatcctggaattgacagctacacaactccgaatctactgaaaccactgaattggacgcttygaatgggtgaatggtgtggcatgtgaattacctctcaataaagctattaaaaaatactaataatcagcatgaggtcaacctaattggtactgacatgaaaagccagtggctccagaggaaatctcagtctgagctccctgtaaaggggcggccaaatccgtgtgctctctcccgccctctctcatgcacagcgatcgccccagccgggagcctgaacccagaggtgtgactctccccgtttttctttgtatacttccaccctgcttgattttttttttttttggagcgttttacttttgacagtaaacaccgaccaaaattcctctccagtgagccccaaataacctccagcctgccctctgccagctgagcaccaaccactgcagatgacgccctacgccatcacccactcacccgtgcaaacaccctgcagtgctggctgagggcctggggccagtgccagggacacagataaccaagctcagagtccaggacaggggagagtaggggacacatgaggagggggccaggcacagtggcactgggcaggcccagggctggcaaggggtcctgaagagagtgcaggccacaggctgggcacacgccctgtggagacccaacacacccagcccctctccaggcccrcttttcccccagaccaatgcaggcctcccacccctggcccctgccccacaccaacgccacccactcaccaacggtactcaccccggcctcattctcacccctgctgccctctccaggaccacctcacagcacccctaagccccactcccatccctaacatgacaacctaaagtctctatccccagctgcccaggcccccggctggccccactccccactccccggcctgcactcatgccctgacccccaggacaggcccctgcccacaacgctggactgctgctgggccgctctttctttcttcactgaccgcctcacctccactcacctgcattgccacaactctctcctagaactgtccccgccctgccacacccaccccaggtctctctccaggctcccatggtgtggcaggacggcccagcctctatgagctgtcacaggccaggcttggggggctgggcgactggacacctcttggcagctgggccgactgtctaagtcaccagcccacagccctcagcacggaggcctctcccatagggtgcccagagctctccygccacaggctgcagtagcctcagccccagaggaatctgccctggatgggggacagggagaatgggggggctgaggggctcaggcagacaggaatggttatggattggcctgtactggccctgggtctggcctcttcgacttgccgggacgctgtcagggctgctcacatcgccgcgccatcagcacctcaccctccccccgctggagtcggttccgtggtgtggaagtgcccacttttgcttatgcgtttatcagttgacggatagtgggttgtttccaccttttggctgttatgagtgaggctgctatggacgtttgcatacacgtttttgtgtggtcgtatgttttttatttctgctgggtagatacctaggagtggaattgctcagctgtgtggtaattctatatttaaccattttgaagaactgccagattgcttcctaaagcgggcgtgccattctgcatgcccagtaacagccgggtgcgaggtttccaatttcctcacatcctcaccaacacttgttattatctgactctttgattgcagacatccaatcctagtgggtgtcgagtggaatctcattgtggtttgatttgcatttcctgatggctaatgacgttgaacactttggtgtgattgttggccattttttatatcttttgagaaatgtgtatttcaatcctttgtccattttagaatttaccttttggtatttttgagttgtaagtgttctttatatattctagatgccagtcctttatcagaaatatgatttgcaaacattttctgtttctgtggtctgcctttttatttgcttgctggtgtcttttttttttttttttttgagatggagttttgctctgtcacccaggctggagcaggttcaagtgactcttgtacctcaggctcccgagtagctgggactacaggcgtctgccaccacacctggctaatttttgtatttttagtagagatggggcttcgccatattggccaggctggtctcaaactcctggcctcagcctccacagtgctgggattacagcgtgagccacctcacctggccggtggtgtcctttgaagcacgtacattttaattttaattattatgactccagtttatctatctttttccttggttgcttgtgcttttggtgccatatttaagaagccattgtctaatccaagtcatgaagctttacaccaatgttttcttttcttcctttttttttttttgagacgaagtctcgctctgtctcgctctgtcacccaggctggagtgcagtggcatgatctcagctcattgcaacctctgcctcctgggttcaagcaattctcctgcctctgtccgccgagtagctgggattacatgtgtgcgccaccacacctggctaatttttgtatttttagtagagatagggtttccccatgttggccaggctggtcttgaactcctgacctcaagtaagccacctgcctcagcctcagtgctggggttacaggtgtgagccaccgcgcctggcctgaattctttgattattaattaagctgagcacatctcctagagttgttgactatttgcaccttttcttttgtgaactgcctattcacaagcattgttggccaggctggtcttaaactcctgtgctcacatggaaatggaatcaagggatcctcctgccttggcctcccaaagtactgggattacaggtgtgagctgctgccatgcctggctactacacctttttacatcagggacttgagcatctgtggattctggtatccatggggagtccagaacccatctcccgctgataccgagggacacttgtattcggcgtaaacttcgaagttgcctgtgggcagcaccagctcacggaacagaacttttcagctcctggaaagttcctgctgagtccccactgggcacaccatggatgggtctcacaccacgcatctatttttgtttaattctgtctgtttctttttttttttttttttttttttttgagatggagtctcgctctgttgcccaggctggaatgcagtggcgcgatctcggctcactgcaacctccgcctcccgggttcaagccattctcctgcctcaggctcccgagtagctgggactacaggcgcccgccaccatgcccagctaattttttgtatttttagtagagacggggtttcaccgtgttagccaggacrgtctcgatctcctgacctcgtgatctgcccacctcggcctcccaaagtgctgggattacaggcgtgagccaccgcgcctggcctaattctgtctgkggtttctttagccatatcaatttttaacactcaccagtcttttatgatttctggattttatgctatgcttaaaatggccttcttttaraaaaacatctgctgagagttgcttccagcactgctgcatttttttaaacatctctgtcgttaatctttgtggaatttgcttggggctgaggtcgagatgttcaaggaggctcgatgtcatgcttggtgtcacgctcatagggtctggccgtgggcttgtgggttacagggatgattgtaaacatctccccttccaccaatccggcttcctgacgcaggggctgtgtattgcttcacttctgtgcccccgagccgagccctgccctgtcctgtggcagaatccagcttcctgamgcggggactatgtgttgcttcacttttgtacccccccagccgagccccgccctgtcctgtggcaggtgtggcttgaaacaagcgttgggtgggagggataggtggacttggagctggctggacccctgcaagatcctggcctggtgcctcccaaggagcggctgaggagtcccccgtggtggctgtggaggtagagagcagcctggggtggagaggatgtgcctgcggcagagagggcggaagagccagcgcttagccttgggtgcataaaatcagagatgcctgtgagataggtatgcgtgtgcagacactgaggtgcaggaaatgctgggctgaggtggggaggccaggctgggaggccatcactagggcaggcctcgggccagagctctgagcctggggtcctccagagcttaggtgcctatgagaagaggcagccgggaagcagagcagtgggcagctgtgcagccatgggggcctgttgggtctgcgaaggaggaaggggcgtgaggaagcagggccacgttgggagcagggtgaggcctggatggtgctgggaccaggtgatgaggggtgttgggacctcagcgggactgcttggggtgtcgtcggattggaggtgccagggggcatgtgggaagtgctcaggaggccctgctggtgccaggctatggtgggtccagcagggtggcagggagggagaaccctctccaggacagagcggtgacatggaggctaggccgcagcrggtcacagcctcagctggatgctggcccgagttccctggggaaggagttccctgggccttggcctgagggacctgcatggtcacagggggcatgggcatcacctggcccagggtgagtactgagtggtcgctcacatttacccagccacacatcatcagtggccagtccagactgctgctcaccactgagggccctggagattttcccagggttgggctgttgggagggtgtgggcagtggtgccctgtggcctcagtttccccagtgaggcccaagaggagctggcagcagaggggccaggggccaggtacctcaagaagggactggaggaggctgggaagggcgatgctagtgggaccaggtgcccagatctcccaccgctggggtcatgggtgatgcccacagacccacagtgggtagggagatgcggggctgggagagcaggggccgtgggtcatgaggtcagggacccaaaatggggcatgggccgggtcatctgtaggcccagtggaaggggagttgggaacacgcgttcagacggtggaaggagggtgccagctgggaagacaggatcctgtaggacttgggacatcagcctgtggggcctgctctccaggatttgggtcctggttagctgcagaagagtcctcccagctggtggtcagctcttggcaggactgttgctgcttcttcctggaggcagaggagacccaggaccaggaatgggatggggatcactttgtgtccctgtgtggctccaggagtagcggcagacccagggccagtgctgcaggaaaggaaggccccaggacggcatcagggtggctggtgtgagtctgggtgctcttgggcaggctggtgtgtcaggtgggctggggccaagtgggacggtgagggtggggaaggccatccacaggggcacaccagggtgggcgggggggtgggggttggttgggggagtggggctggtcaagggctggaagtgtgggtctgcaggagcagaaggaggtagctgcagtaaaggtctcctggttgtggcttttatgatttttattcctgctcctgtttttcaaatgaatgtgtcttttgaccttttgaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgagatcaggagaccagcctggccaacatggtgaagccttgtctctactaaaaatacaaaaatcagccagtcatggtagtacacaccaataatcccagctactcaggtgtatgaggcacgagacttgcttgaacccgagaggcagaggtttcagtgggccgagactgcaccaatgcactccagcctgggtgacagagcaagactccatctcaaaaaaaaaaaaaaaaaaaaattagccaggtgtggtggcacatggctgtagtcccagctgctcaggaggtggaggtaggaggattgcttaaccctggaggctgaacccaggtgacagaatgagaccccatcttgaaaaaaacaagaacaacatttaatcagctcagaagtcccaaatctgatcatcgaagttgtgtctaaatcaggtgttggtgaggctctgggtaggatccagatgggggcaaaatttttctccatctttttacttgtaaaactagaaagcaagttttatgcctccaaactgcaatgttgggctaggcatagactagacatcaccattcccaaagggagaaatataaaggaataaaggggttgccagtcccaagcaagtctgaaatccagcagggcaaattccgtggggtttcaaggcccgtgaatgctcttctgtggctcagtgccccaccctctgcacctgcacctctgccagcctctgcctctaggcctaaggccctgaccttggagtcattcttcctttttctcaaagggtagcacatgtttgcagctgcctgggtctgtcatcctgtttcttgcctgtagactctcagaagcccaataccttccttcatttcatcctgtctctgttcccatcaatccaagcaggcagtgtttctgctggtaaaacattctcataaaccttctgggtctcccctgtatgtcacagggagccaggccattagagagaagggttcactcggatcctccctggataatcttgtctctattcctggcttctgttgagatgagtgaatggacccatgagtcacatacctcatctctgcagagatggctttctctgcagaacacactttcctaacagtgaacctcccaacatgagcatcttttgcaatctaaataggctgcagatatcccaaatcacccatgctgtttcctttttgcttaatagttccttcctcaatttatctctttcttcctgtactttaccataagcagcaagaagcagccaagccacaccttccacactttgcttggaaatcttttcagctaaatatccaagttcattgcttacaagttctgttgagcacccgacagtgaacacagttcggcgaagtttcgcttcaatgtgagaagcacctttcctccactttcctcgttgccttctaaggcttcaccacaagcacctttaatacccatatttctaccaaccgtctggtcagacaggctaggctttttctactgtgtgcctcaagatgtcccagcttctgtttattacccaattgcaaagccacatccacattttcagatattcgtcacagaggcaccctgctcctgctcgctgtctgtattgatttcctttgattcccacagggaagagccacaggcagggcgccctaaaacaatagaaatttatcttttgattgttccggaggccagaagttaaaaatccggtgtcggcaggtccacgctttctccgaaggcacccgggaagagcctaggaatagccgcctgcctcttccaactccactgccccttggcttgtggctgcatcatgccaatccctgcctctgtgtctctcctcgtctaaggacacttgcttttggatctagggcccatccaggtaatccaagatgatctcatctcaagatcctttatttaattatatctgcagagaccctgtttacaaataaggccacatttatgagctccagggacatggacatagatttttttgtggccaccattggacctacccagccatcctgcagtagttggttaatgtagaacttacacatttttgttccatagtcattgttttaaaaagcgtgcacagtgggctgggcacgtgattacaggtggcacatgcctgtaatcccagcactttgggagcctgaggtgggaggatctcttgagcccagaatgtcaacactgcagtgaacctgggctacaagagcaagaccctgtctcaaaaagaataaaaaaataaaaaagcatgcacagtgttctttagtgtgtgttaatttatctgtaatttcatgatttaatgttatgaagtattttagacataagtaacttcttttacttagtgatacagcttgggcatctctctgtgacattaatttacaatacagcattcccctgtatggaaaccatatcatatttaaccaatcaatcctttctcctargacacggagtttaattttggatttttgtattagaaatgactgcagtgaacagtgttgtagctgggtcattgtgcatctctatgactgttgttaaaaagggaatttctggccaggtgcggtggctcacgcctgtaatcccaacactttggggggccgagttgggcagatcacgaggtcaggagtacgagaccagcctaaccaacatggtgaaacgctgtctctactaaaaatacaaaaattagcagggtgtggtggtgcacgcctgtaatccccgctacgcaggaggctgaggcaggagaatcacttgaacctgggaggcggaggttgcagtgagctgagatcgcgccattgcactccagcctgggcgacagggcaagactctgtctcaaaaaaaaaaaaaggaatttctgggtcaagtggttttcaaaatttaagctttaatttacatcaagatactgttttttacctatcgtattggcaaaaatcaaaaatctggatttctaggttctgttgctgaagctgtgggaaccaggccagagaaagcgtctgtcagagccacaaacgcgcagtgtgtgtccgagcagacgatggtcactggcctgagtgcgctcagaggctgggcccacacgtgccgctctgcatggccagacgtgggtcacggtccccgtgcagagcgggaggcctccagctgtggggtgggtgggaaagcaggggcagaatggtgcccggaagatttcaccgtttgtgttaaaaggaagaaaaccaagaatcacatggtatttgcttgattttctgtaaagaaattctggagaaacaaacaggaagccactaacagtgattttcacactgtgtgtgtgggtggggggagacagggagaagggaggggagcaagacttctctgtctactctcagtgtttgagtcacgtgaatattttctattccaacacgattttgatttttaaagtttagtgaagggaagaatgtaaactgttataagttctttttttttttcttgagacagagtcttgctttatcacccaggctggagtgcagagatgcagtctcagctcactgcaacctccgcctcccgggttagagggattctcctgcctcagcctcctgagtagctgggattacaggcacccgccaccacacccggctaatttttgtatttttagtagagacggggtttcaccttgttggccaggctggtctcgaacttctgacctcaggtgatccgcccgccttgacctcccaaagtgctgaattacaggcatgagccactgggcttggcctaagwttttattttattttattgkttattttattattattattattattatttgagacggagtttcgctcttgttgcccaggctggagtacaatggcatgatctcggctcactgcaacctccgccctccgagttcaagcgattcttctgcttcagcctcacaagtagctgggattacaggcatgcaccaccatgcccagctaattttgtatttttagtagagacagggtttctccatgttggtcaggctggtctcgaactcccaacttcaggtgatctgcctgcctcggcctcccaaagtgctgggattacaggcgtgagccaccgcgtgcctggccagttcttttttattttttttgagacggagtctcactctgtcgcccaagctggagtgtagtggcatgatctcagctcaatgcaacctccacttctcctgcctcagcctcctgagtagctgggactacaggcgcccgccaccacacccggctaatattttgtatttttagtagagayggggtttcactgtgttagccaggmtggtctcaatctcctgacctcgtgatctgcccgccttggcctcccacagtgctgggattacaggcgtgagccaccacaccaggtttcagacacaatttttaaacaatttctaagttgctggctaggtactgcagtcgtcgtccctccagcagtgcccaagtgggccgactcctcccacctgcccagcacccrgtgttggagcttcagacaagtcacatggcctcgctgtctgaygggaacttgtgtaaggagtctcctggcagagccagcgggagggtgagcagaactgcggccgcgtcaggttagcgcggcatctgccacctgggcctctgcatcccggaccccgagcctggtcctggagccatcctggagccggggcgttccctgcatcagctctgaccgatcgtcagttatcttattccagcacgttttgtgctgatgaagnnnnnnnnnnnnnnnnnnnnnnnnnnnnnnnnnnnnnnnnnnnnnngtcttttactgcgtttgaagccagcctctcaatgaactttctctgagctccagtaaatggtgagttgagttgtttcaggtgccaagaggagcagtgctgacttgggtaaatgctgtcccatgtcctggcgctggaccgagagctgcgcctgcaccgtccgcattcaccctcacacgccctcccctcagcagcctcgcctcacactgggagggtgccccgctgtgctacaagggtcatttatttgcatgttaacgatgtaagctcattccttgttataaatactggtttttatcaaatgagctgtcgagattttctagatcaatataccggttttctcctttaatctgctagtgaagtcaacgatattaacagagttctgggaaagtgcattatccctgaactccaggaattcatttcttctcttgctccatgtttcctgtggtgacaccttcgtgtctggtgctgggtgaggcagccgccccaggggcccacaggtgtctcggtgttggagggctgagagggagggaagggggagccaccatggatcaggtgagaagcctctccacagaggcctggcgaggtccaccctgctgcagcagagcaggtgcctgcgtgaggagggcctccagagggcagcggcagggctgtggtgggacctgcttgtgctcggagagcactggctgctgttgtccagtgcttggaggtgaggggcaacgagggaggctaccactgtctttgaggtgaaagggtggtggccaggccagggtgtggtggagacagtgggcacaggacaggtttgagagatatttgggaacgatgggccccctaatggatggtcatgtgggtgggacccaggaccttccccgcaaattggtctctagcagacacctggtattgagatactcttgtactgggctgcaggggagagaggagaaggatgtggctcggagagatgacctctgtgcctcctgggccctcactgggactcccagcagccctggtgggcatccagtcccgcagtggtggccctccaccccagaaatcctgcaggctggctggcccgactgagctcgcactgagccccaccctgcgcaggggtggcctccagagcatggaaggctctcctcccacctgtcccgcagcatccgcagaggccgggctgtygttgggccaaggctgcgaggcagaagcctggggcaggtgaggtggctcctgtggacctgccgcaggctcaggcggggagcagagcaggggtctgtgcctccggagggctgagtgtgtgctggatgtatctggcaggatttcactrggcctggtctccctggggctattgtcgggggccccaggtggaggtatctgccagcagggtgtctgcctgtcgcaggtcgcctctgcatggggtcactgggtcacagcccactggcctgctccaccaccaccagagagccccagcagggcaggctgccagggggttaggggctgggtgggtgggtgggcgtgaagatggggcagggagcaaagctgagggcaggcagggtggtggtgggcagggcctcaggggagggcccatcccattcgcaggtgtggtgtgggggacagggttggagccccttctttggcctgggcctgtggccagggcagccagggcctggggactggtgaagaggaggttgctctgtgcccagacagaggggttgggaaggagggagggcttatctgtggtgcctgggctcaaccttggttctggggtccccagtggtgtggggaatttgcagagagcttcatgaggatttggctttgcccagggtgtgagacctggccaggagacctgatggcaccccagctgggcatgggggccatgctgggttcgaccagcaaagcagaagctagaggtaggggttttccggaggcactggtgctggtgagcccgactgcagcctgggggtccctgcagttcactggcctggacacacagacccgcgtgcttcttcggcaagactcctttgtgatccatgaattggggccagagcgatgagatctcctgggcagtggccggggctttgcttcccacgctccagagctgcgtcaccagggcgcccagcttcctctaccccagctccctttcctccccgctgcctaaatctcttgctcgtgggcccttcgctgccagcctgggacctgcctgtcctgttgaaatccccggctgtagccccgtctccaggcgcccccctcccggctgcagccacctccaccttcttgggggttgcctggacttgtttcctctacggcaaggccttggtgcctgtggcctctcttcctgtgctggctgcctgcggcccgtccccacatagctgtcccttcctttgggaagcctgtgccgggaaggaaccacagagctgactgacgtgcagctggctgagcccttcccagggtcatcgtggccgcccccacttccaaggctgcaccatgtggccaccgttccaggcaggctgggctgggcagtctcaggctccttcatgggaacttgctgctgctgcagcttgtcgataagcctctggctgcgggagaccacaggtgaccatggtggccactcacaggcgggcagcttgacttcaggggggaagttaaaggcggagtcggtgcatgaaaagctgtgtgttccttctctgaacagctgtgtgccctcaccttctcattagcttgaaaccatgatcctatctttttgtttgttttcgagtcagtcttgctctctcccagacaggaatgcagtggcgcaatcacggctcactgcagccttgggtgggctggttcaagccgtccttctgcctcagcatcccaaagagctgggaccacaggcccaggccaccgtgtcaggatagttttttagttttttgcagagacggtgtcttgctttgttgcccagactggtcctgaattcccaggatcaagtgatcctcctgtctcagcctcggaaagtgctcagccaccacgcctggccaatcttataacattccattttatgcgttttaatcctttaaaaaaatctccctggccgggcgtggtggcttatgcctgtaatcctagcactttgggagcccaagacgggtggatcacctgaggtcaggagttcgagatcagcctgaccaacatggtgaaaccccatctcaactgaaaatacaaaaattagcccggtgcggtggcacacatccgtagtcccagctgcagaggctgagataggagaattgcttgaacccaggaggcagaggttgcagtgagccaagatcacaccattgcactccagcctgggtgacagagcgagattctgcctcagttaaaaaaaaaaaaaaaaaaagtctccctaggctgaggaaaatttttatgcattaaattaaaaaaattgatctggaccaggcagtgtggctcacacttgtaattccagcactgggaggtgggaggattgcttgagcccaggagtttgagaccagcctgggcaacacagagacagactgtctgtataaaaaattaaaagatgaactgggagtggtggtgcacgcctgtagtcccaactactcagaaagctgaggtgggggcatcgcttgagcccaggaggtcgaggctgctgtgagccgtgattgagccactgcaactcctagcctgggtgacagagtgagaccttgtctcaaaaaaacaaaacaaaaaaaaaacagcattttttaaaaatgtatgaactttttagatctctttataaatatctgtcactttcacttgaggtttactaaggaagtatgattcannnnnnnnnnnnnnnnnnnnnnnnnnnnnnnnnnnnnnnnnnnnnnnnnnnnnnnnnnnnnnnnnnnnnnnnnnnnnnnnnnnntgcaggccaaatttaggtttatccagatacagctcagtaaaacctagctgggaattcagcagtggcgcgatctcggctcactgcaacctcagcctcctggattccagtgattctcgtgcctcagcctcctgagtagctggggctacaggcgtgtgacaccatgcctggctgatttttttgtgtatttttagtggagatggggttttgccatgttggccaggctggtctcaaactcctgacctcaagtggtccacctgcctcggcctcccaaagtgctgggattccaggtatgagtccccgtgcccggcctgaaattctgttttaattcctcacttcaccattttccttaagtttggcaactggtgtttcttgagactccccacaccccaactggctgagtcccagggagggcagggacgggcagggggacgagagactccagaactgctgggtctacggtggaggtggggctggcttctggccctttgcctgttagctcgtacccgtgggagctgccggcctcgctcctggatcatggtcacgtcctccatgccagccccagcctggcgcacagtgggtctgtttacaggaggggaaggacttgcgggtgaaggcagaggaaaggccttgctggagactgaggcaggctagtcacttctatcttgtggaggctgtcctgccccacactaccagcacggactggggtggagcacagtcccggggccagtgttgaaggggtgccctggtgtgggcagggcccagcattcctccgtgccccctgcagcgcagtgagtgaggcagagctgacctcaccctgccagtgctacctgctcccccaggcgtgcgcagtgacacacagctactcctgcgggctgaggaggctgaccccattagccataggggtggttggatcagagcagctgcgaagggtccctggtggtcgtggggggtgggtgagggatggagctgcagtgtcatctggcggcagtggagatgctggcgagtgggcagactggggggcgcagccaggaggacctgtggggctgcctgtggggcatcctgaggctgggtgggagaggcagagaccagggtgcaggtcggacctgtcatctttggagccagtgtacaaggtgcctgacccagggctgcgcagaggcgagacgcccggggaaggggcacactgctggggccggggaggtgggaggtggccgaccagggtctgggggcttgatctcagcagcctgccagcccaggccctggagttgggccggctgaggaagttactgggagatctggatgggtgggtatctcctgcagggcgcgggtaacggcttcaaggccctcgcacgtgtgtcccacaggctgttctaagcatggctcgttgcagtggactcggggggctgtggggtgggccgggggctgcggagctggggagtgggccgtccgagcgctcctggatccggcctggtgacctggcagtctggctggggttagcggggtcgcgtgccccakaaccacaggctgggggggaggggtgcgcggtgcggccgggagcatgcgcccggggcggccctgtccggcgcattgatcagctgaagccccgcccctggccggcaagccctgccccggacctccgggctcctcccccggctgcggcgctggcctgggcagtgcggtgcggggctggactctgcctggtggtggcacagccgccctcagccccggcgcagacatggacccctcgcgagccatccagaacgagatcagctccctcaaaggtgcggtcctggggccgggcccgagccggggggcgcggaccacacagtgacctctggctgggtgcagtccacgcagggtggcgggcagggtctgccatccctggggtgacactgtgggtcgctgagccagagccgcaggagaccccagactcgtccccctccgggctccacctggttcggggtcctactgggctggcttcagcggctccgcagccctgcaggagcgtcgggggcggggtggctgctgcagcggcggcggcggcggcggcggcggcggggcggggacagggacacagtgggagctcagccttcacagcagggtcagccccttccacccggcccgagtttgccgcccacaacctggcgtccaaggggcagggcagggctgggggaccactgtgcagaggcgccgggccggctggccctgagcaagtccacactgcggctctttgtcttggggtggggtgggggggctgggggctgcccaggagccctgactggttgctctggaaacccaaaggggtctggagtggggggagaaggggccgcccagtcgcacaccctggccctcccagtgctgaatcagctcccgcttcggttcccacagggtgggggcagggggcggtagcttccgcccgggggtcttgggggacgcctggaccctggcgcaggggtgtgtgtgcttcggggggggtgtgtgctgcaggaggtgtgtgctgcgaggcgggggggggtggcgcatgccgcaggggggcgtgttgccgagctggcagggtgggccaggaacattctgctccgggctcctccctgcggcttcccttcccgcctgcaggcccctggctggtgggagggaggggactcccgccgagccccgccccatctctgctggaggaagctaccgccctttcctgcccggagccggcttgggggaggcggggctggttgggtggcggcccagcgggggtcagtcctggcacccctgcaggcctgtgtaggagagaacctaggtccacgtgcttttaagaggccttgggatcattttgggacagtgtgggtatcgtgggttagtttggtggggcccttggagatctgggggggattaggttagggaatcaggccaggaagatgcggtcggcctgccgggagtgcaggaggtcagtgtgggggggtgcgctgagggactggccaagagggtagggccttctttgggcacagggctgggcaggcttggacccagctggtgttgttcccaaagccacaaccctggtgggtggagggtccgcaggtgctggtggtccgaggggcgtggccactgtggtccctacatcttcctggagcctcacctcctgaggctggccttttcctgcctggggctggcttcagagggagggagagccatgccgcagcgagctggccctgccagagggctgtgggaaccgtggctatgccttcggagtttccccgccaccacacctctgtgtacgcaggcgtgcgcgtgcgcgtgcgtgtgtgcgcgcgtgtgtgtgtgtgtgtgtgtgtgtgtttggagcctgcaccgtggcgccatggcgacggccccataaacccgcccccacaagctgcttgttggccgcctgccggctgctggccagcgcctcccacctcgggatcccccctctctcccactcccccccaccgccctatttataatcagttcccgggtttgccgggcttggtgggaaggggtgtgtcggcttggggcgagcagcgatacgggtgggggtccatggagcacagcgtgggacagtgggagtgttgggtgcggttctcatgcctggaccctcagtgggggcggcagcagcggggcggggaggggggggtggatgatgggtgtggctgggccaggcctgcagggcctcacagggcagtttcctcttcccttcccttgggccctggccgtcttctggcctggcattcttccaccctgcagccatccatctggcctgcagacgggcacttgggctgcccagggtgggcatctgtgggcggtagggactcggtgactttctctgtggcagcggctgggaatctctggcctccaacagctgggttggaggtgggggtgaattgaggcccctctgagccccctagccggtgctctgctcagagggctgtgggcttggagaggccactcctaatctggcctggaatgggaagtgttaacttgagtggccactgcctctaagcctggtgtgtggaggtgggggctctgtccgtttgcccgcctgatggacagcagcagcggtgcctgcagccctcctcatgtgctgtggcagctgcccccagccgctcccctcggacttcctcccgcaagaccccagcttcttccccaggccctagtcctctccgctcaagcctcgcatccctcatccctccaggcctggcagcccagcaccccccttcagatccttgtgaagccgggacaccagagcccacatccctgccgagtacccctcctgccctcagcccccctgcctgccctgccaccctcttctttagactcttggtctatatccgcccccacttgccccagcacagtcttagggaccttgaaggatgtgtttagaaactgatgtcatttctgacgttggagccgtggggcctggtggggggaaaggggcagctgtgggggtggccgctgcctcttgaggtgccccccactctacaagggccccgtcggctgtgggtgggaggggccgcccatgctgctgagtcagagggggccggcccggcgtcctggaggaaggcgggcagccggcagtgccggcagggattgcacggagccaggcgccacgagccacacagccgggagcccgcgccctcacgctcagcaccccagcctgcctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgygtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggccyggagcctgccccagccacaggtcagctgcaccctgaccccaagtcatgatgggtggcaagtaggggtctggttgtcgggtcttgggcctgggcctgggctggagtggttggagtggtcagccggcttgcggagcgtcgctcacaccagcaggtggccccccctagccgagggtcagggggtgcgcttgctgatgggcccatgtggcccctcctcctcggctggggaccttcgggtgtgtaggccaaggaggagcctgtggcccaggcacaccccggggcgccccctcccctctctccaacactgcccttgccttcgccccctccgcctcctctcctgtcccagtgacctgtcttccccgaggctcctcggcactgaggtgggggtgtgcgaggaggtgctggcgccggttgggtgtggccctcctccagcacatggcctggccgcctcccttgccgcgggggttgatgggtgaggcttggtgccgcacagagtgcccggtgtgaccggtaactgagtgcttggccagcttggacttggtggtggctggggacggccctgggcgggatggggagaagcgcagggtccaggcaggaggctcctccggcagggcagaggccaggctgtggtgtggtgtctgctggcccagcctggggcctagataggcctttcccggtacgaaccaggtcgcacaggacaggacgggtcctgtcatcccagaggcttccagagaccctttgctctgccccttctctgtggcctccctctgtccacaagcacctgtaccagcaggacccaggtgggcagatgtgtcccctgcagcccgaggctcacacacacactgtggagcactctgccctccgtgctggctccggatggcccggtcccccagcacctggccccacctccctctttggggctggcacctgggagcagcttgctctctcaggctgaagaagggggcctggggtggggctctcagggtgggcaggatttgccagggtgtgggggagggggcccaggggaggcccaagtttagggcgcagctgcccgtgtgggatgctgggcggagccctggtgctggctggcctggggtgagttggacttgttaggggcttgccttgggcccatctgggaggatcagtgaggctgtggggtggaggctggcctcccctcctggctctctctgcggctttggacaggtttagtggcctctccagctcctctctaaatggacgacatgtctcccgacaggaggcatgagacaaagactgcttggccaggcatgtagtccaggccccggcccatgtggccttcctgctgtcctctcccacccggcacccctgcccacccactccccggtcatttggcagcccagcttccccatgctcaactcctagctgtggtgactgggagtccctcccctcctttttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggctgggcctgcagggcgggcagctggcggcagggccaagagtggggtgtgctgggtgtggctgcagcaggcagagcggagggcacccctccccgatggaggtgactcagtccccccaaagccacagccgccagcagcagctcagagtttccaacaggaagcgagccacagctccgggatgagtcagggccagcaggctcaaacccctctctgccctggacctcacgggctgagcttgggatgggaagctaggggaaggaggcggctcggatgtggggtgtggcagagggccagggctgggcctcaggcagtgacaggggtccggatggccctgcatacagcccggggcagttctgatgatacctgagaccaggcacttcttggagtttttaagtgaccaagcagtgagctgccctgcccttccccactgcacagccgctccgtgggttggcagaagggcaaggtcagagctcgtgggccaactgtgctggtccaggatggccctgttggatgggctgcccctctccacccagccctggctagggagcaccagctgtacccctgcmgtgaggcccctgccctccctgtgccctggtggtctgcttgtccctgggtggggcccatgggggcctgccagcaacacatctgtgtgggaagccatccgtccacctgcttgtttagccatgcacaggccagggccagacccagatggagcccctgccccagggggctccagatatgtggggtgaactgggtgaggagagcgtgatgggaaggtggcttcagaagcaatcagggagggctctgaggaggtgcctaccctgccaggagcagcccagagagagggacagagggaggccggaaggccagagggagaggacccatgggaaggccctgggcctgtggcagagtttcagttgcttggtgtggtgggaagctgtaggaatgtgtttttatatgtgagtttcatttacgtttcatttttattttacttattgttttgagatggagtcccgctctgttgcccaggctggagtgcaatagcacagtcttggctcactgcaacctccgcctcccgggttgaagcgattctcctgtctcagcctcctgagtagctgggattacaggcatgagccaccatgcctggctaatttttgttttttttttttagtagagacggggtttcgccatgttggccaggctggtcttgaagtcctgacctcaggtgatccgcctgcctcagcctcccaaagtgctgggattatagctaccgcccagccctaatttacattgcaaatggcgatgctttgcctggctcaaaattctgaaggaaccgaggattgtgtggaggagacgccagctgagcgctgtccatgcaccagcaacgggcaggggccaggtagccgccaccacggtgagcgctgtacacgcacagcacctagagctgcttcccacagcaaagggcaggggttgggtagccaccatgacttcscctctacacggaggacacgcctgtgccttgacctccccccttgaccctctgtggccctgcgtcaaggaggaagcctggaggtggcctggctgccttgcccttcttcccagccacagggtgctctaggtggagggactatggcccggccagctttccacagggatcactggcttggccgagtcacccgtttgcgggatttctgtagatcgccggcaggcttctaaggggtagttacgatgggatttgatttgcacttcactsgtcagcaagcacctgggtggagaggtatggagaggggaggcaggtgtcaccattgcccctggacagatgcctggggctgtgctggttggggaggactcaggtggaggaagagaccacctttggggctgaggaatgtgagtctcaaggagtggggtgtggtgggcagtttggggctctgctcccgcctggctcctgaaataccgctgggcacatggatgcctggaatgtgggtgggagggtgggagggcagggctgggctggtggggcctgcagcgggaaggggaggctacagggtggggtctgctgggcggggggtctgctgggcggggcaggaacagtagggaagacccgtgggctggggccggagggctctctgggattgcaggcaggccagtcccctgcacccccaggcaggtctgctgggctggtctgacccgtcagtcggctgggcttcatctctgcttactgactaaggggtggctgcgaggaggagccgctgctaccagggcatgagtgggccctccctctgcytcccaccccttccctccttcctgcctcgccttcctccctgccggctctcggagcagcctggcctgtgtggcagccatggacaggtacagcatggaggagctgattcagctgggccaaggtagggcaggcagagctgggggctgtgggaggcagaggagrgggccggggccgcctctggcagacctgtctcttcccgttgtccaccgttctgtgccgtcagacctgggatgcagggataggcacagccccctctcggagctgccccaggggtgtgtgtgatgtgtgtcccggaagcacaggcctgtccggacctccgtggagtggtagaagaactgcccgctgccagcctggggcactcctcccgccaggagctggttctcacccaggccattgagtcaggctcctctgaggcttccccagcacgtggcagggagtgggctgaaacgtccggcctgtcggcccctgcccactgctggccagatgctgtcctgggctcagctgggagttgggccctttctggcatgcctgggtatccctgaccctcagggctgcctgggcccgcccgacccctggccgcccagagtgggccactgcaggcatttccctcggccgcacgtttttgaggtgtggggctggagagcaggaggctggggtgggcccggccctcttgttgtccgcgggcttcccagcatggacctgggtggcctgcccagtggcccggggccaggctggttcactgtgccttgctgtgggctgaggtaactacactggaggccacctgggctcagatggcagcgtgcgggacagcaggcggcgcctcaggctcctggtctgtatgaggccttcatggtataggacttcatggggtttgctgagggttccatgtggtgccaggagcgacgctgtggaatggggtataccgtcaacgtgcattctcctgggcctgaggggtgcgcccagcagacaggggtcccaggaagaggagcaggactgtgcgtgtcccacgtcctgtttccccggctgcattgggatctgatctgcataggatatgctgtgggcctgcctgtggcccggctctctgacccaggccttccacagagcagggcttcgggactcctgggtggagccaggccagtctcctgccgtggcccaggagaggcgtctccatcccagatccctgggaccccaggagaggctgtgctgtggggcaggcgcaggcctgagccctggtttcgggctgcctgggtctctggcctgcgcgtgactttggggtggctgtcccggccaccggtggggccaggtgctgtgttgagtgacctgcgcagggccctctgggagaatgggcggcctcttctcttggcccctgtggcctttccaagagcaccccctggcttggcagggcaggtgggtggggactgcaccgcctcctgcagggacgtgagcccgcacctcccgcgccctgctctattatattagaaccccctgtgggagctgggggaccgaggtgtcgggtggcaccgtccagccagacctgactgcagcggggcctgggtgccctggcgccgtgcgtcatgttccaagtctgggtggtgacggtccttgcgcgccctcctcggatatttatatcccctgggcccctgcccactgctcccctcccccacaagctgctgctgacagcagcacggccgtgccctcctcccacccgacgctgccgccagtggcttgtgcctcctccgaggggcctgtgacctcccacacccctggcccgctccgtctgccccgtgggctcctgccaccgtccccgatgaagatcgtgcccggtaggtgggcagcccttgaaagccttgtgaaatcctggccccttgctggggacaggggccagagggctggggctgaggctggaggccaggggcgctgtccctcgccctgcacacagcctgcctcatgtgccctcacccagaccccctcagccctggtctgcagtctcacttttggggtgttggggctggtgaggagggcgaagttgaaggagtgcagtgggttcagctgcaggcttgaggtgggggctctggcatccctccatgcctgccagctgtccccagagggcagccttggaggcagagtgggctgctcgggcccctcttctggtggggacagcagggggaggctgggagggagggagggtgtgtgccgaggccgcgggcagtgctggggggctgcggcttggccaggcgtgcggctggcccctcctcccggcgggtgtggccgcggggacgcagggrttaaggccaactaaccttgagcgtcagtagccctgcgcagggacagctgagccggccgggtggggagcgagggtggggaggcgccgagggccggacccgcggagggaggaggagaggaggcgggcgggagctgttgtggggctgccgccgcgtatggggcggtcctgcgggcagggcaggctccggtcccggcgctccccctcgctcgccctgcacgcagggagggggctgtctagcctggagcagccggttcccagcgcaggaagggcagccctggcggctccgcgtggcggctatggagccctcgggcagcctgtttccctccctggtggttgtgggtcacgttgtcaccctggccgctgtgtggcactggcgcaggggacgtcggtgggcgcaggacgagcaaggtaagccccgctggtggctgccagggactcgaggcggggcagaggggccgcctgcctcccgccccttcattccctgcgccctccccttcctgtttccaagctgaatgtcagtgaaagcagtgttgcccctccaccccaccctgcagtgtagaccctgaccctgctgcagtcccagggcggggcgggctctgcagtggccctcagcctgcagcctgtgcgggacaggtgggtggaagcggaggccggcagggcaggagcgtcccccacacgaagggaggcctgtggcagccgccgtggcagggacaagtgggcaggtgcctgtccggccagcactgaggtggaggtggctccctgcacacacagcagggggtggagccacacgcaggtgaggcaggtgccctcatgccctcgggccgcacagggggcgggggcagccaggctgtgccctgccctccctgctcaaagtcaccagctcctgggctgtggtcccaggtggcaaccgtgcccagcacaggatggggcggggccctggggattgggcagcctcaattatgggcttctggccagagggactgcctatcggggacctggctggccagacctctcctgcagtgagggcgctgcctggctcagctcctctgctggatccccggacttgagatgagtcaagatggggcttctaggcgtggcgctggggacgcccggagctgccggggactcagctgccaggatgggacttgggctgagggcttcttccccatccatgtttttggctggggaccagacactgtccctgcctccccacctcagcccacaattgcccccttcggccacggtcctggctcacaggatgcctctactccctggtggtgccagacgcggctcagctcctcggttctgcctccagcgttgtctgcccaccacctggccccatgccctgccttcctccctgggccctgcagtccccaccgcacatcctgctgggaggccccctcccatgccgcttcagtcccagggcagcctcccagcccggcccgtgggttggggcgcggcttcctggctgcgctgggcggggctgcgcgccaggggcaggttctttgggtctgggcctcgctcccgcagtgggcggattgtgggggggaggtggaagaggtggagagcgaagccggcagcctcgcagcgtgggctggaagcagaggcgccgccgcggtccagctccccgcactgtccgtgggccgaaccagggctccggccgtggccggcatgtcgggggcggggggcgcctttgcctcgccgagggaggtcttgctggagcggccgtgctggctggacgggggctgcgagccggcccgcaggggctacctctaccagcagctgtgctgcgtaggtgggtgcagtggcgtggccggtggcacagaaggggccaccatcgctctcacctagtggggctgggtctctgctgggaaccgccgcctgggctgggatgggggtggcgccttggcccggtgcagccttgcccccgagctccggaaacacctggggaggaaggcggggtgatgttcccctacccccatttgtttgtctctagagaaggggctggagggggcggggctggagggggcggggctggcccacccccgggctgttccacgtcagcctgggctttggcctgggtttccaggacacgggggagggaggaggtgctgaaggcggggctccaggccttctgtggacttgctgcagtcctgggccagtgggattcccttcccagtcttggggtttccatcctaggaccgtctccactagctgcgggacctcagccatagggtccacacctgtaaaacgggggcgatactcctcagagggccacggcagtgcctgtcgtgagggaccctgggctggcggccgagggtcagcagccctggacagcacaggtgtcaggcaggtgtgcagaggcacctgagctgggggtgttctgggtgcgtcccatgtgggagagccagctgagctgcagctgtagagggtgggtgtagcctggctgggtgggacgggtgtgtctgttggttttagggtcagaataggatggatggggcggggcaggctgggctgggagggaggggaggtgatgaggagggaagagctcagagcaaagaggcacccagaggcaggaagtagggaaggggagcttgagccaggcttgggaggtggaggcccctgaccgagcccccagcccacctggtcccagccctgccccgccccagcccttctcctcacccggtcccagccttgcccgagtccgtgtctggagtccccaccgtgccccttcccttccctgagcccctgccccattcctgaccctggcccggcccagggcggcatctttggaggcctgttagtggcagggagaaggctggaacaggggcctggctggggtgggctccacgtgggtcctggaccttggccccggctcccagtttccagctgtcgtggactccctgtgcccacctccctggctgttccgggatctcacactgtgcctcagcagagtggcagccccgttcctgcaggcaggagccacctggtcacggccgggcccccagagcccatacccagcaggcgcggggcttggcctcagggtagctgctggcccagggcttctgaagaggcgacagtgtttccagaggctttggacccagggaggggcggcagaggtgtggggtccggggtgcccttgggcacaagactggaggtgctgaccagtgcggggtcagattttgatttgggggcttctggtgactcctgaggttctggaggctgctgggccggacaggcagagcaagagggtcaccctgaatctcatgccaggctcagagaccatgcatggagaccaaggggtgtcttcgttgggcggcgtgtacgatgtggcagagccctaggggctggctgtgccccttggcgtggagtgggggcttccccacctctgaggggtttgggcaccccccattgtgagggttctggtgccccctcacggcctcaggggcagtaggaatgaggtggggtgagctcttcccagaactgaggccgagtgcagctcccagctggaccgaatctgcctgatgtgcggctggaacattcttgtggttggggcagcgcattctttcctatggtggtcgggtgggctgggcaggcccagaagctggccagaggcagctccgccccggaccccagggagccggaggccccagccagcgcaggccctttgccctttgccctttacagcatgagactgcttcccttgagccccacccagctgcaaacagcaccccccacccctggggtcgcccaggtcctgcctcaggtgtggcttcccctctgtgagtcacaggcttgggccccctccccatccctgactcactggcgaggcccctcctggggcttcccgatgctccattcccccatgaggcccggcctccgtgagtcagccctcagctacgcgcctccgacgtgaggtgtctgcctgggscagggtgggctccgcaggtgggcactgctccaggatgtgccaggtgggcagcttgggaggggccaggcctggggtgggaccccactggccccagggccagggcaggcaccatggggcagggtgtgctccccgcttcatgcaggtctgtgaagaggtgtgattggggggctgcaagagctgacaggcagcaggtcccctcccctcgccaggtatcagcggcttcttgagtccgccctggcagggtgggtgggcagaggctgaagcagggcctggcccaggcctggagggagctccaaagagaggcgtggcctcagagcccctcccgtcgggggagcccttcagtctgttggggggtccttctgggtggctgtggggacggcctgtgttcctctgcggtcctggcaccatttggtgtgcagtgaagtgccagctcccygtgtccccaggtccccctagggggctgcagtggtcgggrtgggtgaggaaaccccggtttcctgtttctggcgggccgagggcgtgtctgtgggsgagggggctgcttgctccttcccgccgggacactcccctccctggcggcggcctgggcagggtggggcctcgggggcgggccggcctcgccggggagtacagcaggcagggagtggcygcaccgactggggctctgagctgagcctgtgccgagtgagcgtctcgtggggccgccagccttcagctgcctgtgtgccacacggggctgcccagagcaccgtgcctgaggccgagggtccgggcgacgaaggtgtgggggcagcatgtctcagcaccagctccgcgtgccgcagcccgagggcctgggccgaaagagaaccagctcggaggacaacctgtacctggctgtgctcagggcctctgagggcaagaaaggtagcagggctcccctcgggcacccccgccaggcagggcgggcccctgcgggaggaaggcccacttcctgtggcaggaaagccttggcaccgctggggggctggtcttggagatgggggtcgggggccagccatccccacccaacacggagtgggccgacaggcgcccgcgargctgacgggggcctccgagcgtcagatgtmgggcctggaagggcgaggaactctgcgctctggggaaggttcgctgccctgtcagcagcacacgcggcttcccttccaacaccccagcgggcccgggccctggctctgccacacccctgcttgggtctcagtctgtagaggccgggggggactgcaggacgggacttgtgtgccctgggctcagggtgcgcccaggaccctcccatttcctcgggggaagagtccggggtggggtggctgcacctggtggcgcctgggcccctggcacctgggtctctgctgtgtggctgggctgcgggtgagggcgcctgggtctcagtgtgtgatctgagggaggctttggggctccccaggcaggacctggccagccaggctgctgtgtctgcacggtggtcacctgagggcccccggggcttctcccaggccccaggtaagctggtcttgtctcccccagatgagcgggatcgtgtgcagaagaaaaccttcaccaagtgggtcaacaagcacctcatcaaggttggtggcgcatgctggtgcstgtcacaggggctgaggctgtgggaggcgctgagggagggtggcccctgccgcccaaggctgtccccatgctgcctgtgtgctcacctttcatctctgaaacctgttattttctgtcctctttcttccctacgcctgctcctgcctctctcttcctcctcttccttctggtctttcctggtctctccttgcagcactggcgggcagaggtaggtgcctccgtggggcagggtgtgttccgtgggctcccgggagactcagcccccgcctccttccctctgggaccagcacccactctgtagatcagccacycagggcctattggtggctctgggggactggccacctcagccgctgctgtccccacaggcccagaggcacatcagtgacctgtatgaagacctccgcgatggccacaacctcatctccctgctggaggtcctctcgggggacagcctggtacgtgtgcccctgccccctccgggccccgcctgccccacctggagacctctgcctgccttccctccttggggcctctccggccgcccactctacttggaatccagctcaacccctcctgccttctccctgggggcaggctggcctcgtccctggcagcacctcccgcccaggctgctgggcatcacagccgagggcctggcctgggagtggccgcaaccctcggacctcggctgctctgggccttgccgccctccgcgtcgggacacagtaacctcatgctccgctttgctttggtttctctgctgcttggactctgaaccttgacctctgccctttaccctttgccctgctctggccgggcagccgagggagcgggacgtaagcaggagctcacgcctggtgagtggctgtgcctgccggctgcagcggcacgggagctccccaagaccgtggagcccggctttctgggggctggtggcccgtcggccaacccctgcctggctcttgggcgggtaggtggttgggtgtcaagctgcccgtccaccgtgctgcccagagctggcctgggacccaccggtggctgctgtggctgccaccgccaggcaggaggaccccccctttagtgccactgccctccacacgaggcttcctggctattgtctcctcccaccccttccttccttccctcagcctgggtcgctggacttcccgagccctgatgggcctggcctggcccctgggccggtggcctccctttccctgcgggggagggtgaacctgggatgaggggctgctgccccctggggaagacccttggctcggttgctgcggcgctttggggcatgctgagggtggggcccgggagctgcagctgcactgtgggtgctgastgtgcctccccacagccccgggagaaggggaggatgcgtttccacaagctgcagaatgtccagattgccctggactacctccggcaccgccaggtaaggctgcccggcaggccctgggccccacccagacccctcaccaagccagccccgccctgtgggccgtgaccgagagcccctcgctcacaggtgaagctggtgaacatcaggaatgatgacatcgcygacggcaaccccaagctgacccttggcctcatctggacaatcattctgcacttccaggtagaacggctgcccccaggacccccaccccctgcaggagtttccagggtagcctgggctccttggctggcgggttgatccgctttctggctagggcgtggcctgggaggtgactggcgccgtaggtatggtggcacctgggtgccttcctgccagccgcaaccctggactggatctgtggcctgagggtacaggcctctctctgaggccacctatccgtgccctctggccctggctgggcagggcccagagcctccctgtggaggaatgcaggccccggtgcctgccctggggaggcttctgcgcagcacaggctgactcacccgctgcttgtcctggctgcacaggaaaccacaaatctgagagctgagcaggcagagcctggtgctggcacrgcagctgagtcacacaggctggcaggacgacaggcagctaggggtgggtgggcagaacctggcctgagcatgccactgagtgtaaagccaggctgccagaggccccacctgccagcctgcaaccatcgatggagctcgacccccagccttttccaggcctgggggttctgggccaggtttagtggtacacttgtgggttcctcttatgcccactgcccttccactctgctccatcccagctccgggaggtgcagggtgcagcctagccctccccagctaggggagtgggcacctgctgtgtggtggcagtgagggttgggggttctgagctgcgtggtggcagctgccaccggctggagtggctggacttgtggccccgaggcatggccagtcccagcagcttcccaacagggaagggccctggagcccggtgctgccctggctggtttggtggccccatgcactccccctgggtgctgagctacccctgcccctgtgcatgtggctgtgggcacagagcaggcctggtggctgtggctgagctgtggcctcctctctgctgtgagcagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagtacatggccccgggggcagggggctgtgggctgggggcacccccacagcgcctccactaggcaacttcagacacgttggggcagggaggagggcaggaggaacagggatgagtgccagctggccgcctcggggtggtggagttcagggcccagccccaccctggtgtccttcagaagcaccaccacttgatctcaagactggagggcccgcgggctgctggtcctcacagccaggtgcatgtgccctctgtggacgcctccggaggggcctggtggggagggtggctgcagggaaccccagctgcctggcaccctcagctctgcgcagtcctctgtgctgtgcccctgggcttctgggtgtgggggtggcagggtgctctcagctctgcccatgtgacagtgtayttttcagggtgagtgtkgggggggtccatggttgctgggatgtgtgaggagccggcctgtgcacccgcctgtgtggtgtggccgctggtcttgtcccacccacctgaccagccacctgcttgtcccaggcccctgctcatcgacatgaacaaggtgtaccggcagaccaacctggagaacctggaccaggccttctctgtggcggagcgggacctgggagtgacgcggctcctggaccctgagggtacgtctgygtggccttcctccctgtcccttcccctgctgcctgccccagagccaccgctgagctgcccttccctgcagacgtggatgtccctcagcccgacgagaagtccatcatcacctacgtctcgtcgctgtatgacgccatgccccgcgtgccggacgtgcaggatggggtgagggccaacgtgagtggggggcccggagggcagggggcttgggcctggacgccccgacgacccctgacagccgcccgtgcctgcccgcaggagctgcagctgcgctggcaggagtaccgggagctggtgctgctgctgcttcagtggatgcgacaccacacggccgcctttgaggaacgcaggttcccctccagcttcgaggagattgaggtgggcctgccgtggggggcggggtcctgggcctgccctgagagccsggcgtggttgccgacagcctcgtccctggcagatcctgtggtctcagttcctgaagtttaaggagatggagctaccagccaaggaggccgacaagaacaggtccaagggcatctaccaatccctggaggtgagtgggaccgctggaggggtgggtggtgtcctggaacgccccaggcctgaaaggttcttccggagccgacctggccctgcctttgggaccaggrctgtcccaggtctggtgggctggggtctgaaggcccagcgccccaccccctgccccctgcctatagggcctgagtgtggcccctgtctacagggagcggtgcaagcaggccagctcaaggtgccccctggctaccacccgctggaygtggagaaggagtggggcaagctgcacgtggccatcctggagcgggagaagcagctccgcagcgagtttgagaggtgggtggggccctgtggtggcaggggaaccacccgagggtgwgtcactgcctgggaaggaaacccccctccccgccccgcccccggcgggggaacccaagctcccactcgccttaggacagtgggccacagccagggagaccggagcgggaggcgagctgcagtctgtggccagggctgtgccggacccggccaacgcggccccttccctgtgctgctgctgcaggctggagtgtcttcagcgcatcgtgaccaagctgcagatggaggcggggctgtgtgaggagcagctgaaccaggccgacgccctgctgcagtcggtgagggggtgtggggcaggcagtgggcgggagggaggccggaggagcctgccccgccctgcagccctaaagccaggagggggctgtccccctgggctcctggggcaggggcaggggcaggggcggggcatgtggtggggaatccaggcctgagctcctccctcctcgtgtgcagcyaactctcactgcctgctttgggcagagttggtttctggccayggggcagaacccacgctgggctgccttgcccccgccaggccccctccccgacagcggcttactgttaggggaggggttgggggagggcccaacccactgctgattgcccaggaggacagggcccacgtggcattacaggaggagttacccagggtgggtgatggaggatgaggcccaggaccccacagacatggtcatgggggtctcggttcttggactgggctaagtactctggacttggtcccaatcccccagaaggccagtaggaagatgtgtgaggtgggcagggagggaaggggaaggacagggatggaggcagtggcccactgaggctgaggaagcggctgagggtggccgtcttggccggggcccctgtgaggtcagagggggatcagctgtgctccgagtcatgacaacgaccttgcaggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcaggtgggccccgccctgccctccctgaagcccaggtacacacggccccaggcccgccaacacctacctgagtcctctgctgccccagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgaggtgggtggcgctgagcgatgggcagtgcgggggtgggccgggcccagccactgcagacctcaccgtctcatctgttgcagggccagctctcccccgccacccggggtgcctaccgtgactgcctgggtcggctggacctgcagtacgccaagctgctggtgagtgggggcrgggccagccgggggaggtgggtagcccgcggcctgctgacacgcaccctcctgcccacagaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggtgagcggtggcccagctgccctgaaccccacagccccctccccagctgtgccctggccgtcccctatggtcagagaccagtgggggccctgggtcgagtttgctgggagcgtggcagagccgggtgtggccggccgtccctgagaccctttgctctggtgccaggcgctgatgcgggagctggagctgaaggagaagaagatcaaggagctccaaaatgctggggaccggctgctgcgggaggaccacccggcccggcccacggtggaggtggggctccctgggtaggggcggggctgcggggggggccgtgccgggtccccaggcggggcggggcggggcctgaccgggacctgctgtcccgcagtccttccaggcggccctgcagacgcagtggagctggatgctacagctgtgctgctgtatcgaggcacacctgaaggagaacgctgcctactttcaggtgagaaccggagccccctccgcactgtggctcagcggcagccttgcaggagcccctggaccccctcggcagctccaatcaggagccctcctgtctgcagacgttgccagctgctgcctgcagcctgaccggggccttggacaggggtgctccccaggcctcctgggggctttgccactccttcctcagtgcccccgtcttgggcctgccctgggacaactgtgggctggggctctggtcccaggtagcctggcgtgaccccctcccgctgccccagttcttctcagatgtgcgggaggccgaggggcagttgcagaagctgcaggaggcactgcgtaggaaatacagttgtgatcgctccgccaccgtcacccggctggaggacctgctgcaggatgcccaggtgagggagggggtgtgcaggggcgtgtcaggaggggctggcctggagtctgggctgcacgggtactctggagactagggggcaactggaggggccagcaggagttgggaggcaccatgggaggtgtagaggtcagccgargsgggaatgaggcaggatgttctgggctgcatgggtactctggagactagggggcaactggaggggccagcaggagttgggaggcaccatgggaggtgtagaggtcagccaaggggggaatgaggcaggatgtggggagccgagaggcagccggtccaagccgggccgcccccatctccatagccacagagtgagtggaagcctgaagtcagcagctgccgccagcccttgtgctgtagaaggggcaccgccagcccttgtgctatagaaggagcactgccagcccttgtactatagaaggggcaccagctgtttggcctgagatctggagcgggcagagtggaactgggctttgtgctctgggagcaggggtgggatcacccaggagggcgggtgcacagtggggagtgacagggaagagggactggagactgaaatggcctctgaggtcggcagggctgggccggggggagagccggcagctcccaggtgtgtgccgtcctgcggcctggcccccgcagaggggtgggatgggaggaggcagtaccttctgcagcccgcaggggaggggcaaggggcgagggcattgtagggaccagagcgtagctgggaggacrtggtgggtgagctggggtgagaggagggtgccctgtctgggttgggaaggagcgagggtgcatgggtctgcttggggccaacccccggggcctgtcccagctatacctcctgcttccaagtgctgccaccccgggagcatcaggagggccccacaggcctggtcccggggtctgggggtgcctggggcaggcctgtgggtctccatggccctcgtctggatgctgcccctcccccacaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgagtgcaggccgggggtccactggggggcgtggccaggcagggcagggtgtggccatgtcctcaccgactctgcccgtcccaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggtgggtggcgggggctcagcaggtgggggctggaaggcgggtggggcgctggtgacgctgactgtagccctgacmtgccaggctggaggcccagcaccaggccctggtcacgctgtggcaccagttgcacgtggacatgaagagccttctggcctggcagagccttcgccgcgacgtgcagctcatccgctcctggtccctggccacggtacgcctgcccccgagccgggggctctctgggtgggaggaggggagaggcgttgtgcaggkcacggccgcctcgcccggcactcagccccacgtgcttcccccagttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtagggcacggcagggctggggcggttgggctggtgygaggtgggcggtggagtgacccacatgtgttccccaggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcaggcaggggccgtccccccccatccagtcccatccctctccccatccctcctcccaccctccctcctttggccttcaaggggcgctgtgtgctgcgctcggtgatgagtgcgttcccactccctgtctttgcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagtgagtgcacctggccacaggcgaggggctggggtcggctggggggtgctggggtgagggctgtgaccttgcaggagggtgcaggagggaacgagttgggggctgttcagagatctggccaggaggcgggaggcccagctggggtggtggccgcagaggtggtgagaagagttcagggctggatacgcttcgacagtggcggccgggggacttcctggtgatgagattcgggtgtggggaagagacagtggagctgggcagcggctgctgagtgaggtggggaagctgtggatccactttcagtggcacagtaaggaatcctgcaccctgcctctcgtctgtcctgttcctggcctggacttaagggcctctggcatttatttccaatgtgttatgtcatagtctcttcctgtgttgcaaaccacaggtccacccgctgtctactcctcacagaaccagcacagtgatagggccgccgcctcttcctgtgttgcaaaccacaggtccacccgctgtctactcctcacagaaccagcacagtgatagggccgccacctcttcctgtgttgcaaaccacaggtccacccgctgtctactcctcacagaaccagcacagtgatagggccgccgcctcttcctgtgttgcaaaccacaggtccacccgctgtctactcctcacagaaccagcacagtgatagggccgccgctggctaccacagggtgccatttccaccccggtgtccccttcgcccagtcttgggctgcaagggctgagaactacgcttccaggccctgtgggcaccaggatgccgctgtcatccagccagtgggctcgtcctgtctcggggccttggggtctgccgttcctggctggcgcaccccctctccaggctgggtcctgagtgtccttgtgttacagaggctcccaacctccttctccccaaggctgttcttctcctgaagcaagcctctgaccacagggtcagcygacccccagggttgggtctgggcttggcaggcagcaccctgggtcgctgtggcttgggttccattcccttgggctattgctcgagccccatgtcatggccctgagccccrctttcccgccaggctcaagaccatcagcctggtgatccgcggcacgcagggggccgaggaggtgctcagggcccacgaggagcagctcaaggaggcccaggccgtgccggccaccctcccggagctcgargccaccaaggcctctctgaaggtatcgtttcgaggcttgggcttcatggcggggtgggggtacagcgggcccagctgaagccgcacatgtccctcctgtccccaacagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggtgggcttgggtcggtggggacggggcggctgggcgtgccctgcggccacggctctgaccacaccatcrcccaggccctgctggaggagatcgagcgccacggcgagaaggtcgaggagtgccagaggtttgcgaaacagtacatcaacgccatcaaggtgaggcccagccgcctgcaccaggccccaagtccgggaccgttgccrggatgatggcgggctttccctgagcctgggccatgccagggaaagcccatgtgagggtttaggggctgggcaggggccatcggagggcagagctggtggctgaccgcagtgcattgccacaggactatgaactccagctggtgacgtacaaggcgcagcttgagccggtggcctccccggccaagaagcccaaggtccagtcgggatcagagagtgtcatccaggaggtagggtggggccgaacctaactgggtgaggggctggcaggcctctggctggagctgcagctctcgcagggctaaccctggctctactccacagtacgtggacctgcgtacgcactacagcgagctgaccacactgacgagccagtacatcaagttcatcagcgagactctgcggcgcatggaggaggaggaggtacagcccgttgggcggaggctgggcagagggttccatctcaccacctgttgtgtcccacacacagccacaggagctgcctgaggccacctctcgtggccctccccactctccccactggcgctgccascaccccctgcccccagctcagcctgccccaggmtgccccacctgtggcctgcccccctggcctggtgtggctacactgctcccccacagtggctggtgccgcctctcctccctcgtgagcgtcccccctgcagcctagcggccgtcctgtgggctcttccttggcgttctgcgttggcctttccgctcaaccctttgctgccagaagtcgggggtgctgagttgtggggctagggagggtcttccaaggcacccatctgttggcttctccctaccttctgcgtggccctgaatcctcttccgagttggctcgggtctgcactgctgtctccacgctggccgcctcgcctcaccccgccccacccaggcttcccaccctggtcggggagaggggtccagtggtgggagccaggcccactggtgtccagcagagctcaggcagggctgtgtgctgggtgtggctcgcaggttccgagctcctgctttgctctctctctccccgtccgtctgtctccgtcgcctgtctgcgggaagcagggaggacgcctgggcctccttccccaggctggtgagcacagtggggccggctgcgatcgctgcccgagcgccctgggcgggtgcacgctgtctcctccgccgggctggggcctctgtcttccccgacccctgctccgcgctgtctgagtgaactgtgccggtgcgtgccccgtcagcgcctgcccgtgttcacactctctctgcttctcttcttctctctgctgtggccrcagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgacaggcrcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcrgagcggcgcctgcggcaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcrcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcragggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcggaggaggagcggcggcgccgtgaggctgaggagcgcgtgcagaagagcctggcggccgaggaggaggccgcacggcagcggaaggcggcgctggaggaagtcgagyggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctcwgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggctgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcargmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttcccgtgcctccggccttgtgtcttggggtcaggtgtgtgtcagggacagggtggacattgcagccccaggctccaggctctgagctcagccactatggccagtcagggacgtacgtctgtgtgcagcagagaccaggtgctcgcaggagggcagctgagagaccctgggcagagggattcagtgtggggcagggtggtggccacactgaggccgggccccctgggacctgctgctggtcaggtgctgaccagtctcccagccccacccttcgcactataaggggctcacgtttccttatctgaggcggggtgtggtatgctcccatatcagtcactggctgtggccccttggcctccggggagggtgccacatggccccgggtcagttggttgctgctggccgggcagccctccagagaaggggccacaggcagtgggcctagtatgagggcctccaccacagtctgccatgtctcggccccatgcccatcacactccggggattccatctggatgggcttctccaggcttccgactggtggcagtttctgggaagacttaggggaggagggaagcggggccaccccagcctgcagtagccactggtccaggctcagccgatactcttttttttttttttttttttttcaggcagagtcttgctttgtcacccaggctggagtgcagtgtcatgatctcggctcactgcagtctccacctcccatgttcaaatgattctactgcctcagcctcccgagtagctgggactacaggtgtgcacccagctaattttcatatttttagtagagatggggtttcaccgtgttggccaggccggtctcgaactcctggcctcaagtgatcctccctgccttggcctcccaaagttctgggattacaggcgtgagccactgtgcctggccttcgcctctcctgctggtgggacccaggcgttcaccctggggtccaagtcctagtcttctcgctcttgctgggctttaccctccctgccccggcccggtagagggtgctctgcctgctggtccgctggaacaggagtggccccggccgggtgacccacagccatcgagcggggcagtgccttactctgtcccaggtggctgggttttaggacctctgagccctcacagcttaagagttgcagggaaaggaagcacaggttgtcagtgggtcactgggagctggtgagtgggcggccactcctgcctctaccccttggtccccagacccatgcggtcctctgtggggccactgatttaggccgaagaccacatcctggaggacgggaccaccacagtcccagagggttggtgtcaggacggtggcaccaactctttccgagaagctcgccgacgctctaggctctgcggcgcccgtgttcccgctccctctgcacccccttgccggaagcagtcagaggccctgggggccgttacacaggagcccgtctcccagggcagacacggaggcatcgtgggctggaaaggtgggtccgtgcctggaataccagctgttgtctttccaaggggaaggggcctccagggctgagtttacctccaagtgaccggttggtctctggctggttttgcgtccagggcccctggtggtctttatggccagaggacgggatgtgctgctgccgacaggagctgggcttgtcatggggcgcctggcttcgtctggtcctccatcgctccaggcgggagccgtgtgggagcaccggacgctgcgtcactggccgcgtcattggcttgtgggtggctgggtgcccgctcggcagccggtgcccctggtgaacacccacaagtccccacgctggtgtccacccggcagttccattccccagtccgtcttccagcgttgcccttctcaggccctgaccggccagccgagcccttccccagccctgtccacgtgtgtccttaccatgagctgctctcctctcctcatgagaggccagggatcgccccgacccctgactccagggccagcccaagtggagtggtccgactaccatgaacccaaccgccatgaagcaggccgggcttggcccccacccagtcacagggaccctctgaagctgtggcctgactggcgggcaagctggaagctgcgccacctgcccgtgcagccctctggctctcatggctggtgcccggcagtgcaccgccccttaccctggatcctcactgtgccgctgaccttagcctgggtgggtcttgtggcactggctcctggtgggagctgtggccacaccatccccaggaacttctctgaacagtccgcagttctctgttgcagtcgggacctccttgcttcaaaacttagggctggtgctgcagctcttttgggccttgccggagaccccttgacgcatccttccccacctgcggcaggtgctcctggtacaagagctctgttagctcacagggcctgagtggcaggactttgttccacagcctcaccagctgtgctacccttccttttcctgggccccactcaaaacgagaagcctctgtgccaactgataaaaagatctgtgtgtggtatcgtgccgggtctggtatcgtgctggggctggcatcatcctgccgtgtctggtatcgtgccgggcctggtatcgtgctgggtctggtatcgtgccgtgcctggcatcgtgctgggtctggcatcatcctgccgtgtctggtatcgtgccgtgtctggcatcatcgtgctgtgtccagaacccagaggcctgccatctgccagcttctttcctggtgttaggaaatgcaaggctcaaaactcgttcttgaccttggacaggacgtcctaacatgcccagatctctggactcctaaaaccttcatgacgtgaccagtccctgaatcttggctcagcctctctcctgccctggagtgcctgtgtcctagcaggacgctcagaacgcctgccacttcccgcttgccaggcctggtgggtgcgatgctgtcagtgagcggacttgcgtgtttgcgctttggtcagttgtctgtgtgtctgcatgtctgtgcgctgctgtccacctcgtgtgaatgggaactgcccctgacctcctcccggtgcagtggagagccctctgcccagccaggagccacaggacaccgtctgaggctgtgagtctgctccaggaaagaccacagacagcacagcagctggagttggcactgtggggagacgctgtggctcagccgccgtccaccacagtctacccagctcttgtagggacctgaccagcaaattaagtgggaagatggtggccatcacccatgcaccctttaggcatctgcggtgttgctgacgccgccgttttgaccaggaggttgtattgttttatttccttggctggagctgggggtagtttctaaggtttccatttggtctttcctactacagtgatttttactccatgggccaaaaagcccatgtgaggatttgctgttgagcatgccagttccaattgcacgttcctgggctgggaaatgatgggctgaggcctgggccaggactccaggtccttcctgaccccatattccctacccagatgggagcctctgagggtgctttgcgccccaggtgtcagcgtccactcagaccctgatctgggcgtcttcctctccccagggcacagttgtccagataagcatctttgggtccctggagggactggggggtcactgctgtccacacttggaggcgtgaggcctttcacaaggggacctggccgctctttccatttgtgggctctggctctgagaactggctgacataaggaaacaaagcaagtggttgtgttttccatcagagcagtgggcctggactcactcactcgttttaaaatttgtgggtgccgcgtgctgagccagtgtcctccgagtgtgccccgggaccacctgggagcttggaaggggcagagccttggccgcggcacagaccaactgagtcagaaatcctgggcctggggctcagccagctgtgctttaaggagccctccaggggctgccatgtgcctgagtgtgagaaccagtgtagtgagcagctccttgcaggctgcccatctgcgtctcctgtcagactgyggcgctccatgagccagcttcatgggcccccatggtcagggtcttctggccgctgcccccaccttccctcccgctgccagcacgtctcaacaggtgggagctccagcggctgcactgccattggtgccaggctgacagcatcgccaggcagtcggtggtgttctgaccaactgtggcatctgtgcgccaggaccacgtctgcgcccccccatcccaggcaggctccccagggcggtgcctcagttacacatggtttctggagaattctcagaaaaggggtgcaacaagtggggagggcaaggagctggcaaagggggctggagccgtagccctgccccacggacatctgagaggcaagggcacagctcagaggctctgactcctgcccacacgtgggtctgagctgcctgtggggtggcacgtggtcctcaggcatctctgaatgagcagctcttgtcagccaagggcagtgttctggaggaggacacaggtgagcgtctgcagcagctggggaggggaacaaggacacccaaggggatcttggaggatcggccacggcagctgccttcacggtggcagctcctcagtagcagcgcagacggaccgagagacccttgaaaactcctcccacgtaaatccgggtaaaacttaaatagcttctcgggtgcattctgacgttaccaaaaagacaaggaaaccaccaggggtgaaagagaaaggagggtcctcagtgcagcggctgagctgacgcttcccgaggaatttgctgatcctggaaggctgaagcctcgggttttaaaggtcctcaggaacaggaggccgggatgcgggccgtacagccagaggcctctgtggcatccggatcctcaaagggctgcacccagcgagaaagcgggttctccgacgatccagccacagaagggaaacactggatcctgcctgggctctgacaggaaagcgtttccactgagctttacaatttcaggccatccccctgtagggtctggagaaccccatgtggaggaattacatcaccatggccccaggttggttgttgcctggtacctggtatgagccaatataatcttatctggaggtcttgcccccaaccaaggcttcccaggcttcagataaaagacctcgggctttccaacatgacgcagtcaaaagttacaagacgcatggaaacgagcatcatgaacaagggcagaactggaagctgagggacgcaggatactggaattattcaataaagaatacacagtgagtatgtttgaaatgtttataacacaacaaatccataatgtgagaagtaaaattctagctaaaaagagcaagaagattttaaagaaatttgatagaatttctagaaatgaaacatatactaataatatttaaagctcaatggactaaacagcagacgaatcatagttgaagaattggtgaattaaaggatagatctaaagaaattactcagaatttatcccagagatgggaaacaggaaagagaggttaggaggcagaacagaagacatctagcatcagtccagctggggttctataagaagatcctggaataaggtgaggacgttttgaagaaatagtggctgataattgttttccaaatagatgaaaaacatgaaccatttatccaacaggcacagtaaaacccaggtatggcaaataaaacatctacatcaaaacacattgtagtaaaattgcggaaaaccgaaaaccaaaaaagaaaaaaaaattaaagcagctagagagaaaagacagattccctacgaaaggataatggacacaacccattagcaaaagcggaagcctcttaatgtgtgttccgtgaactaggagcgagcgcttcacccttgaacttc

SEQ ID NO: 10640 - DNA, 14478 bp, Homo sapiens
gggtttccccttatcaaaccatcagatctcgtgagatttactcactaccagaagaacagtatggagaaaactgtccccaggattcaattatttctcactgggtccctcccacaacacatgggagttatgggagtacagttcaagatgagatttgggtggagacatggagccatatcaggatataattgcatttaaaaagtagtcactgtttatctgaaatacaaatgtaactaggagtcccatatttttatttgctaaatacgccaaatctaattgaacagaataacttttcatttgcctgaatatattaatgaatggttgtgttggggggacatctattttcttccatgtgcatgcaactcctactcctgttcctccttctgctccttaactcactccatcctggaagaagtgacgtgccttatgtgatcagtaaatttgggaagaataattgagtcatgataaacttattattattattactataattttttgagaaagagtctcactttgttgcccaggctggagtgcagtggcacaatctcggctcactgcaaactctgcatcctgggttcaagcgattctggtgcctcagcctcccgagtagctgggactataggcacgtgccaccacgcccagctaatttttgtattcttagtagatactgggtttcaccatgctygccaggatggtctcgatctcctgacctcatgatccacccactcggcctcccaaagtgcagggattacaggcatgagccaccgcacctggccccatgctaaacttaactccatgctcttccccctggatgcaactctactggcagaagggtttatgaacaagcatacgccttcccctgtgtggagatttaagtggggagggagtgagggagtctaaagttccagagcaaattttcagagacacaaacaattggggcatgggtttagatgtaaaagaactaaaaacaaaagaacaaatgtatgagagctatatatttacaaggagaggcttttggtgggaagagatcctgtcattctcagccttgggatttgtttagtaagagagacgggcattttccagattgtagaggcctattctgagccaccttttatacttaactactgagcctgggcaagatgcttgcagtcttagggcatatggttttgtgacacgacttgtggtggctttgttcataggtcagtggttgtttctatagaggcaggactgtacccatgaatgtcaataagcaaaaggcacaagaaacttgtgagggccttcaagattgctgcgaagcccttgtaagcagggacagacaaggcaagggcttacgtatgggcagtaagtgcttggaaggacacaagtgctgcctggcaacagaactttgggggctgcaagatggttcaacagaggcccacagtaggcacagtcacattttctaggtagtcatagctgaagcagatagtcttttgttttgttttttttggggggagggaggggcaaaaatagaaatctctaaagcatttttaggcactggtgactggaataatatttttggctccaagattccttgtatgctacaaaacaccaatgagaatctagttttaaattgctagaatgaagcctagaaaagcttcccatgtctcagtcaccccaaatctcaccctgctttcaggtccaagcagcaaactggatggattactcttgaattcatgtggcattctcttggctcaagggtggaaaacatttaaacaattactgacatgattacatagttattgtaggtggcttaattttttaattctttcatatacagatggggctgtgctccccagactggtcctgaactcctagactcaaacaatccacccacctctgcctcccaaagtgctggggctccaggtgtgaggaaacacacctggtcagttatattttctaactgaactaaatgtaagtacaaggtgaaaatattccctaggagacagtcttcttaggccagtacaattccatatcaagcagaggttggtctgctcacttgagagagtagatgctgtgtcacataagaggtccctcactgaattcagagctgaggtgtcaggagcacttcactcaaagaggaagtgaaaatcaagatgctttgaatagattcaatggaaaagaaagacacaaaatgttattttaacataggttccttcaatgtctagtttattgagaggttttaacatgaagagatgttgaattttattgaaggccttttctgcatttgagataatcatgtggcttttgtctttagttctgtttatgggatgaatcacatttattgatttgcatatgttgaaccttgcatcctagggcataagaaacccacagccaatatcatactgaatgagcaaaagctggaagcattccccttgaaaaccggcccaagacaaggataccctctcttaccactcctattcaacataggattggaagttctggccagggcaattaggcaagagaaagaaataaaggtattcaaacaggaagagagtaagtcacactatgtttgttagcagataacgtggtcctatatctagataaccccatcatctcagctcaaaagcttcttaagctgataagcaacttcagcaaagtctcacggtacataatcaaagtgcaaaaatcatgagaatttctatacaccaacagtagacaagcagagagccaaatcataaatgaattcctactcacaattgccacaaaaagaataaaatacctaggaatacagctaacaagggaagtgaaggacctcttcaaggagagctacaaaccactactcaaggatagcagagatgacacaaagaaatggaaaaacattccatcctcatggataggaagaactgatatcatgaaaaaacaatttatagattcaatgctatgcccattaaattaccattgacattcttcacagaattagaaaaaaaaatttttttaatgtgtgtggaacaaaaaagagtccaaatagacaggacaatcctaaacaaaaagaacagacctggagatatcacactacctgacttcaaattatactacaagacaacagtgacaaaaaagcaaggtattggtataagaacagatacatagaccaatggaacagagtacagagcccagaaataagaccacacacctaaaaccatctgatctttgacaaacctgaccaaaacaagcaatggggaaaggattcgctatttaataaatgatgctgggagaactggctagccatatgcagaaaattgaaactggacccctcctttcaccatatacaaaaattaattcaagatggattaagaacttaaatgtaaaacccaaatctataaaaaccctagaagaaaatctaagcaatacccttcaggacataggcgcaggcaaagatttcatgacaaagacaccaaaagcaattgcagcaaaagcaaaaattgacaagtgagatctaatgaaactaatgagcttctgctcagcaaaagaagctatcatcagaatgaccagacaacctacagaatgggagaaaatatttgcaatttaaccatctgacaaaggtctaacatccaacatctacaaggtacttaaacaaatttacaagggaaaaaaataaaaaacaacctcattaaaaagtgggtaaaggacatggacagacacttgtcaaaagaagatatatatgtgaccaacaaacacatgaaaaaaagctcaacactactgatcattagagcaatgcaaatcaaagctacaatgagataccatctcacaccagtcagaatggctactatcaaaaagtcaaaaaacaacagatactggcaaggttgtggagaaaaaggaaagcttataccctgctggtgagagtatatattagttcaatcattgtggaagacagtgttgtgattcctccaagacctagaggcagaaataccatttgatccagcaatcccattactgggtatatacccaagggaacataaatcatttgattataaagatacttgcatgcatatgttcattgcagcactattcacaatagcaaagacatagaatcaatctaaatgcccatcaatgatagactggataaagaaaatgtggtacatatacaccatggaatactatgcagccataaaaaggaacaagattatgtcctttccagggacatagatagagttggaagccattattctcaacaaactaatgcaagaacagcaaaccaaacactgcatgttcttgcttataggtgagagctgaatgatgagaacacatggacacatagagggaaacagaacacactggggcctgttggagggtggggggtgggaagagagagagcatcaggaaaaataactaatgaatactaggcttaatacctgggtgatatcatctgtacaacgaattcccatgatgcatgtttacctatgtaacaaacttgcacatcctacacatgtacccctggaattcaaataaaagttggggaaaaaagaaaagaaaccactcaattacaaagtagggcatcctcagaaagcaggagaaggaatgctgctacctcatgtgcgatgcttgcttatacaggacattaaagctaagaatagtgtactttattataaaggcttgtgatcagcctgtgacaggctataagtatttttttgttgctatgtaatttttgatttcagtaagaatttacaggtgtactactatctttgaagtgaaacttattcttaaactaaaaatgctttctgttcttaaaaaaaaggcacaaaattaatggttcccacccatccttaaaatagtaaatgcttttagtgtcaacgttaaccttgtgagtgctgtgagtttcctcacaactaagtttaagtttaaaggctctgagtccactggcatcaactggcaccaactgactggcattctgcgaagctaaacaatgaatttctttatctacttttctttcttcatatgtgaatgaatctccatcagggtctgtagagacattaaataagggttctaagagtgtaagcctgcttagtattattgctctagaattgggggttggctttctagaattcagtggctacggggcctgtgctgtgataatcttttatcccctattaatcctttgaacttgttaaaactgtggctcatgagagtcttggcactgaaccaacacaatctccaaggttctgaaagaaatgattccattcagctgtgagacagtacagacagcaattgcttaaacaaacttagcttcatccagacattgagaacttacacttagttgagattaagcagaatataataaattgggggtcagaggttactttaagttcttaaagacaatttgatttaaggctttagtttatttggattttactgtgtctggaatttttcctacaaaacgatttaatctttgaacttcaatttcttcctagggatattaacaaggggaaaaaaaggcttgtagtaaaaatttgtggcatctcgacattgttataattttgctattggaggatctcattgtttaatcttattgcagaacctctgaactgcttatcagacttaatttggcatgaaaaatatagagcaaaattttagccttggattccaatagatatttgtgttatatagctaacatatgtttctgaattttcttgaaaaattctacaccactgcccaccagtggtcccatgaggatacccacaagggcagggtttgtcctggggagaagctttgtgaacatgggtgacaactttcggaaattctgatagctactgttggcaatataaagagaaatgagataggatccctaaaaaaagaaagtatacaagattttatgaagagtgatagatatgataaagttgtatacacaaatttccatgtgaaaaccaaatatgaaataagtaccttattaaacaaggtagtaacatgatataaatgtcaaagaaaaggttccacatgagtggagagacgaaagaaagtcatagacattgcacgaaacccaagtcgtcagagtcggagtcatactccaagtcgtcgacgaaggtctagttctgtgggtagaagaaggagctttagcctttccccaagccgccggagccacacccccagcckccagagaagatcaaagtctgtggtaagaagacgaagcttcagtatctcaccaatcagattaaggcgatcaagaacacccttgagaagaaggtttagcagatctcccatccgtcgtaaaagatccaagtcttctgaacaaggcagaccatccaaacgtctaacagatttggataaggctcaattacttgaaatagctaaarctaatgcagctgccatgtgtgctaaggctggtgtccctttcccgccaaacctaaagcctgcacctccacctactatagaagagaaagttgctaaaaagtcaagaggacctactatagaagaactaactgagaaatgtaaacagatcacacagagtaaagaagatgatgatgtagtagtgaataaacctcatgttttggatgaagaggaagaagaacctcctttttatcgtcatctctttaaactcagtgaacccaaacccatttttttcaatctgaatattgctgcagcaaaaccagcttcaccaaaaagccaggtaaccttaacaaaagaattccctgtatcatctggatctcaacattggaaaaaagaagcagatagtgtttatggagaatgagttcctgtagagaaaaatggtgaagaaaacaaagatgatgataatgttttcagcagcgatttgccctcagagcctgtggacatctctacagcaatgagtgaacgggcactcgctcagaaaagactcagtgagaatgcatttgaccttgaagacatgagcatgttaaatagagctcaggaaaggattgatgcytgggctcagctgaactctattcctggccagttcacagkaagtacaggagtacaggttttgacacaagaacagttggccaatactggtgcccracctggattaaaaaggatcagttcttaagagcagccccggtaactggagraacgggagccgttttgatgaggaaaatgggctggagagaaggagaaggattaggaaaaaacaaagaaggcaataaggaacccatcctagttgattttaagacagaccgaaaaggtcttgttgcagtaggagaaagagcaaaaaagaggtctgggaacttctctgctgcaatgaaagatctgccaggcaaacatcctgtgtctgctttgatggaaatctgaaataagagaaggtggcaaccacctgaatttctattggtccatgatagtggccctgatcatygcaaacgttttctctttagggtattgagaaatggaagcccttaccagcccagttgtatgtttttcttgaatagggattgataaatggaagtgcttaccagcccaactttgccagccttaataagaagcatgctaaagacacagcagctactgtggttcttcaagcaatgggccttgtaccaaaggacctcatggctaatgccacctgcttcaggagtgcctcacatagatagattgaggttttataataatcatttcagataattttactctgcctcacaatgtgtttcctctttaatgttgtaaatatttggcaatttaagacattgtgtaaaaagcaatctgtagaaacatctccaggctttgatttttgtaccatggaaattgtatttaaccatacagggttttggtatgtttatattgtttatcttagtgatgtatttgtttaagtggctaacatccaaacgattgtttgaaggcattagagtaatcttcagtgtggaatgttaaataacgcttttatactgtattttgtactatgatgtaactccccttccttatggctagcctactgtaacacttgcctgtaatcagtgaagggctgtgcaccttgtactatttcacagtgggttctgctggacagatactggcccagtgttattgaggtgatcaagcaagagctgttccacagggctaaagcaaccatctcccctcaaaattttgtagaggttctaaaaagaaagggtatgaggtgtgatgatcagcactaagtcctgcattcctgttaaagccacttgggtcataagaagggagtaaaaaatgaagtctgagtagaattctactattgctgaggccaagtacatttagtatggcatcgagttgtgatatagttttactttgatgtgcattttgaatttcagctacacctagatagacataaaatgataattaaaatgctgtaaccaacttatctaataaaattggcaaccagccactattctgttgactatgagaaagttaaagtttatgttaatttttagggtctgataggatatttcatgtgtattacagtggtattcatatgctatgtttctaaactttattttcaaaagcttaaggcccaaatactaacttctctggaataataaaataaaaaaaaaaaaaagaaagtcatagacattgcatggccagatagggtagagatctaacctcacttgtacttcattttagaatgagacatcccggctttatgatcctaacaacatttgaaagcttaacactcaatagaataaaatgcaaatagaataaaattctctctcccctacttcacctccctcttattttcctctccctttatattgccctttttgattcagacagctggccataatgttctattaatgagctaaaatacagtatgaaggacacacacagatgggacaaaaaagcaggatgtacatgtagagcccaagtgcaaaggcactgcagctttgtgttttactcactgcaaagctctggaaaagacttgaaagtagctaagttctgccttagggtcaaatgtcccttgggagtccaaatggtagagaaaatacatctgacttcaagcccacataaagtgggcacagaatggttaaaaagcaaaaccttgaacatctacataagtgaaattagatttagttttattacacacaatgtggaggcacttgacacctctgtgcagtggtaggattattttgagatcagatgtttttcagagcatttgattttcccttcattaaatagatttctttctttagagcctagaccaaaatagccaacattcactgaacattatcattcatgtgtttaatggtacctccagattaacatatccaaaattgaagcaatctttttttttttttttttttttttccgacacggaggcttgctgtcacccaggctggagtgcagtagcgtgatcttgtctcactgcaacctctgcctcctgggttcaagcaattctccggcctcagcctcccaagtagctgggattacaggcatgcaccaccaggcccggctaatttttgtattcttagtagagatggggtttcactatgttggccaggatggtctcgatctcctgaccttgtgatccacccaccttggcctcccaaaatgctgggtttacaggcgtgagccaacacgcctggcctctttttttttttttttaactacatgtactccctcaggtgtcaccatcaccattcactcagatgcttaagtcagaaacctgaaaatcatgtttgattcttttctattatcattcccagctgtaccattgctgtttgctaaaattactcttgactcctttagtttctctttttattgtcatggccctattccaatctctcactaccagtctattcttttttaagtcttttttccatatgtaatatatatgtacagcatagtatatataacaaaagcgtttagcttaataaattattgtaaagcaatcacccatataatcaccaccagatcataaaataggatattacaaagattccagaagtccttgcctgcctcttcctcatcacaactccctgcttcctgggtgttagcttttatggtaatcacttcactttgctctacccattcctaatcaatattgattagtttttcctgtttctgagctatatattcatttaatcaaattatttatattcttttgtatcttgcttgtttcattcaacatgatgtttgtgagatttattcatgcatttattctagtttatttttattgctgtgttctaactttttattaaattcattctattgtatgaatgcatcacttttatttgtccattgtactgtttatggccatttgagtagtatcaagtttttgcattattacaatgatattatggatattgtgaacattttggtatatataagcacacacttatacagaaattgaatgttgggtcacagggtagtatatatgcatgtcagctttagtagatgatgccaaaaagttttccaaagtggttgaaccaatttacattcagcctagttctcattgctccacttaaatttagccattgctatcggtgtgtagtagtagctcatgattttattttgtatttctcttattattaatgaggttgaccatatttttacagattttttgtctttggattttcttttattgtaaagtgctcaagtcttgtggtgatttttctgttatttgtcttttctttataaatctgtagttctttatgacttgtagttttggattatgtaatgtaaatattttctctcaccctgaggccctgctttgcactttcttccttgtgtctttggataaacagaagttcttaatttcaatgtagtcaaacttaccaatcttttcatttatctttgctgttttgtttaagaaattttctctactctaacttataaagatacagtactaagttgtgttttaaaaaccttttctcttttctcatttagttttatagttcactagaaattattttgtgttgcttgcatatgtaataatgaagagattaaaatttattttactctatcttgatatctaattatcctaggatcaatcatagaaagttcttctcttctctgtactacatttatttttttaatttttaatttttatttgttgtgggtatatagtaagtgtatatttttatgagatacctgagatactttgatatagacatgcaatgtgtaataaccacatcatggtaaatagggtatccatcactttgagcatttatcctttctgttacaaacaacccaataatactattttagttatttaaaaatatacatttaaattatttttgactatagtcaccttgttgtgctatcaaatactaggacttatttattcttctgtttttttgtacccattaaccatccctagttccccctcatacctctactatccttcccagcctctgctaaccatctttctactctatcttcatgagttcaattgttttgatttttagcttccacaaataagtgaaaatatgtgtttgtctttctgtgcctggcttatttcacttaacataatgatttccagttccatccatgttgttgcaaatgacaggatctcattcacttttatggctgaatactactccattacgtatgggtatcacattttcttcatccattcctctgtgatgaacacttaggttgctttcagatcttggctattgtagacagtgctgcaacagacataggaatgtagatagctctttaataaactgatttccttttaggggtggtatatacccggcagtgggattgctggatcatatggtagctctatgtttagttttctgatgaacctccaaactgttctccatagtgcttgtactaatctacgttctaccaacagtgtgtgagggttcccttttctccacatcttcactagcatttgttattgcctgtctgttggacataagctattttaactggggtgagatgataactcattgtagttttgatttgtgtgtctctgatgatcatatgcctgtttgccatttgtatgtcttcttttgagaaatatctgttcagatctcttgcctatttttgattagattattagattattttctacagagctgtctgatcttatatattctggttgttaataccttgtcagaatgggagtttgcaaatattttctcccattccgtgggtagtctcttcactttgtgaattatttcctttcctgtgctgaagctttttaatttgatgtgatccaatttgtccattttggcattagttgcctataaagctcactcattctttcctctgtttgatctattctgttattaaaagatgctgatgcattcttccatatgttgattgcatttttcaacaccagaatttctgcttgattttcttttattatttcaatcccmaggttaactgtacctgatagaattctgaattcttcctctttgttatcttgaatttctttgcgttttttcaaaattgctattttgcattatctgtctgaaaggtaacatatctctgcttctccagtattggtcccaggtgccttattcagttcatttggtgaaatcatgttttgagagatggtcttgatattcatagatgttccttagtgtctaggcattgaagagttaagtatttactatggttctttgcagtctggccttgtttgtgcctgtccttcttgggaaggttttccaggtattcaaaggaacttgagacccaaccccagtagtgctgtggttcctgcagactcatagacgtactgacttagtggtcttggataagttccggaagacttccctggattaccaggcagagactcttgttctcgtcccttatgttctcctaaataaacggagtctctctttgtgctgtgccgcctggatctgggggtgtcgtgatgcaagcacccctggggccaccaccactgactgtgctgggtcagatctgaagccagcccagcattgggcctcactcagggcccactgtaaccactacctggctactgctaatgttcgcttaaggccctagggctctacggttagcaagttgggaagccagccaggtttgtgcctttcttgccccggtcatgcccacagatgctgtctgagagccagggactggagtcaaaaatcttagaaatgtacctggtattttattctgttgaagctaagctgttccttggtccacaagacaaagtcctttccgctcttccctgccctttccataggcagaggatcctttctcagtggccaccaccaccactggcccatgggtaattctgtcagtccactgccaatattcacttaaggccccagggatcttcacttagccaggcctgggtggtgaaagctgccaggcctgggactcacccttcatggcagtgggcttctctctggcccagggcaggttcagaaatgctgtttaagagcccaggcctggacttagggtccccaggagcccacttggtgatctacccaactgtggccgagctggtacctagggtacaagacaaagtcccctttacttttctctttgcttttctcaagcagaaggagtctttcaccatggcctccacaactgggagtgtactgggtctcacttgaagccaggatgtctcagagtctcaccaaaagcccagtactacctgggtattgctgctggttattgagggcccaacggctctttattcagcaggtgatgaatcttgcctggactgggtccttctcttcaaggcagcagattcccttctgggccatgatgtgtctagaaatgtcatctgagacctaggtcttggaatgggggacttacaactctgcccaatgccctaccctactgtggctgagctgcaagacaaagtcctctttactcttcgctatcctctcaagcagaagaaaggagtcaatttctttgctacaagcagctctgcctggggttttgaaaggggtggcacaagcactcccttagcccactgggctggtgtctctctgggtcacatgctaccctagttcactggctctaaacccagcccagcactaggacttgcctaggaattgcagtccttgtgtcctagactgcgtttcaggcttatctagaaccccagaacactttagcccacagtgacaaggtttgctgagaaactcaggttctgaccactgggatgcactattctgttccctccatgggtgggcactggctgaacccagcatggcttttctctcagtgttatgacagggccacactgagtttaatgccaagttccctagtcactgtgctttccctctcccaactgcacgaattctctctatgtatcatccagctgctgccaaggaatcggggaggggtggtgtcggcaattcaaaactgtctttcctactctcttcagtgcctgtttcagtaatataaagctaaattaggtactgtgattgctcacctgattttttgttcatgtgtagttgttgaaatttgcaggagggatgattggtgaagatttctatttgctcatcttcctctgcctccttctgtactatgtttattataactgaagtttatgcatatatatggatcagtttctgaattatctatgattacattgtttcatttatcattgtggct

SEQ ID NO: 10641 - DNA, 17252 bp, Homo sapiens
aggaggtcgaggctgcagtgagccacgatcatgcgccactgcactccagcctgagtgacagagcaagactctgtcttcaaaaaattcattaattaatttttttgtttttgtttttgttttttttttagatggagttttgctcttgttgcccaggctggagtgcaatggcgcagtctcggctcactgcaacctccacctcccaggtacaaacaattctcctgcctcagcctcctgagtagctggcattacaggtgcctgccactatgcccagctaatttttttgtattttagtagagatgggtttcaccatgttggccaggttggtctcaaactcctgacctcaggtgatctgcccaccacagcctcctaaagtgctgggattacaggcgtgagccactgcatcccgcccatgacaaagttttattaacattttcagggtggcaagggagtcatggaaagctaagcacattgtaattctgaaaaaaaaaaaatggggttctgtcagaaaggaagaaagggaggataaatgttggataagacggctgggcgtggtggctcacacctgtaatctcagcactttgggaggccaaggtgggtggatcatgaggttaagagttcaagaccagcctggccaagctggtgaaaccccgtctctactaaaaatacaaaaattaggccatgcatggtggctcatgcctgtaatcccagcactttgggagggcaaggtgggcagatcacaaggtcaagagttcgagaccagcctggccaacatggtgaaaccccatctctactaaaaatgcaaaaattagctgggtgtggtggcgggtgcctgtaatcgcagctacttgggaggatgaggcagagaattgcttgaatccaggaggcggagtttgtggtgagccgagatcgcgccactgccctccagcctgggcgacagagtgagactccgtctcaaaaaattaaaaaataaatactggctaagacgagtagcaatgtctgtcacacctcctgagagactactgaactctagttatatgctagtgttacctggggagacttgggcctgaattttttttttttctttgagatggagtcttcctctatcacccaggctggagtgcagtggcacaatctcagctcactgcaacctccgcctcccgagttcaagcaattctcctgccacagcctctgcagtagctgggattacaggcacccatcaccacgcccaactaatttttgtatttttagtagagatggggtttcaccatgttggccaggctggtcttgaactcctgaccttaggtgatccacccacctcggcctcccaaagttctgggattacaggcgtgagctaccacgcctggccaaattatgatcttatatgtgaaaatgattatgtaaaaatgattgattatggtgttgtgatgggagatgctgtgctgtcggcacagtagtagggcataggctgggcgcggtggctcacgcctgtaatcccagcactttgggaggccgaggtgggcggatcacgaggtcaggagatcgagaccatcttggctaacacggtgaaaccctgtctctactaaaaatacaaaaaattagccaggcgcctgtagtcccagctactcgggaggctgaggcagaagaatggcgtgaacccgggagacggagcttgcagtgagccgagatagcgccatggcagtccggcctgggtgaaagagcaagactctgtctcaaaaaaaaaaaaaaaatacaaaaattagctgggtgtaatggcacgcgcctgtagtcccagctattcaggaggctgaggccgaattgcttgaacctgggtggtggaagttgcagtgagccaagaccgcgccattgcactccaacctgggcggcagagcaaggctccatctcaaaaaaaaaaaaaaaaaaaaaaaaaaggccgggcgcagcggctcacatttgtaatcccagcactttgggaggctgaggcaggtggatcacaaggtcaggagtttgagaccggcctggctaacatagtgaaaccctgtctctactaaaaatacaaaaattagccgggcatggtggtgcgcacctgtagtcccagctacttgggaggctgaggcaggagaaacggttgaacccaggaggtggaggttgtggtgagccgagattgtgccactccactccagcctgggcaacagagcaagactccgtctcaaaaaaaaaataagtaaaataaaataaaataaaatgtatttgaaactgggtgtggtggctcatgcttataatcccagctattcaagaggctcaggtgggaggatcccttgaggacaggagttgtagaccatcctggataacatagcaagactttgttactttctttctttttttttttttgagacagagtctcgttctgttgcccaggctggagtgcagtggcacgatctcggctcactgaaagctctgcctcccggattcatgccattctcctgcctcagcctcctgagtagctgggactataggcacccgccaccatgcccagctaatttttcgtattttttttttagtagagacggggtttcaccgtgttggccaggatggtcttgatctcctgacctcgtgatctgcccgcctcagcctcccaaagtgctgggattacaggcgtgagccaccgtgcccgaccaagacttgtttcctaacaaacagggccagttgcaatggctcatgcctataatcctagcactttgggaggccaaggagggcagatggcttgaggccaggagttcgagattggcctggacaacatggtgaaaccccatctctacaaaaaaacacaaaaattagccaggcatggtggtgctggcctgttgtcccagctacttgggaagctgaggtaggagtatcactttagctcaggaggtcaaggttgcagtgagccgagactgcaccactgcactccagcctgagcaacatggtgatacccgtctcaaaaaataataataacaaataatgaataaatgcaatttattttaaagtgaaacttgcatttccttttttagcctctgtacaaggaaaaatcattgctcctcctatttcctcaatctctttccactttaccacctgataaaattttactttataaagcatgagagcaaagctacctcctccataacactttcctctagctctctcagcccaaagtgaatttcccaacctcttaactccaaaatgaagttgttaatgccttgtgtagagcatacattccatctcacattatggttagttgctgtacaagattagacattccttaaatagagaaactatttcttattcactataaccacaaaatgctctatccttgccactcatactataaacccctatggttctaggtcctgcccaaaacataaatgggtggtatggacgccgtatcaccttactaaactgtgacattttggggattaggaacttttggccaagagggagactcacgcctataattccaacactttatttatttatttatttttgagatggcgtttcgctcttgttgtccaggctggagtgcaatggcgcactctcagctcaccgcaacctccgcctcccaggttcaagcgattctcccgcctcagccttccaagtagctgggattacaggcacgtgccaccacggcccggctaattttgtatttttagtagagatggagtttctccatgttggttgggctggtctcaaactcctgacctcagatgattcgcccgccttggcctcccaaagtgctgggattgcaggtgtgagccactgcgccaggcctcattattattattattatttttgagaccgagtcttgctctgttgcccaggctggagtgcagtggcactatcttggctcaccgcaacctccgtctcttgggttcaagcagttctcctgtctcagcctccagagtagctggtattacagatgcgcaccaccacacccatctaatttttgtgtttttagtagagacagggtttcgccatgtttcccaggctggtctcaaactcctgggctcaagcgatccacccacctcagcctcccaaagtgctgggattattggcatgaggcacagagcccggtctgtaatcccaacactttgggaggccaaggtaggaggatcacctgagtccaggagttcaagaccggcctgggcaaaatagtgataccccatctctacaagaaataaaaaaattagccaagtataggggcatgcacctgtgttcctcgctactcgcgaggctgtggtgggaggatcacttcagcccaggaggttgaggcagcaatgagcactgatggtgccactgcactccagcctgggtgacagggcaagacctcatctcaaaaaaataaataaaaagtgagcttgctcacctttcctatgtctctcagcaccttgcttttgaattttagctattatttttacagatcttttaacaaaaaggctgctttaattaacgttaactaacatacatggcatataagaagatccttgttctcaagggctttacaaacctctagagtcaaatgtgccttattatcagtacaaaaataaatggtgtcagctgggtgcagtgactcacacctgtaatcccagcactttaagaggctgaggcaggtggatcacctgaggccaggagtttgagaccagcctggccaacatggtgaaaccacattgtcaggcctctgagcccaagccaagccatcgcatcccctgtgacttgcacgtatacatccagatggcctgaagtaactgaagatccacaaaagaagtaaaaatagccttaactgatgacattccaccattgtgatttgtttctgccccacccgaactgatcaatgtactttgtaatctcccccacccttaagaaggttctttgtaattctccccacccttgagaatgtactttgtgagatccacccctgcccacaaaacattgctctcaacttcaccacctatcccaaaacctgtaagaactaatgataatccatcaccctttgctgactctcttttcggactcagcccgcctgcacccaggtgaaataaacagccatgttgctcacacaaagcctgtttggtggtgtcttcacacagacgcgcatgaaacacatctctactaaaaatacaataatcagctgggcgaggtggctcacagctgtaatctcagcactttgggaggccgagacaggcaggtcacttgaggccatgagttcgagaccagcctggccaacatcgtgaaaaccccatctctaccaaaaatacaaaaactagccagatgtggtggcgcacgcctgtaatcccagctactcgggaggctgaggtaccgaatcgtctgaacgtgggaagtggagcttgtagtgagccgagatcgccccactgcactccagcctgggcaacagagctagactgtctcaaaacaaacaaaaaatggtgtcaagactctcagacgagattctaatggattaaggcctatatgtaaatagcaccaaagactatggaacagagatgggagaagcaagcagggaggcaggaatagtttagctgtggcagttttagcttagtccacttacataaatggttctttagggtagcacgtggagcatcctcatttccaaacattggactgagagtagagagctgtgcaaaataaccacaagtccccaactatgccctcttaattatccctatcatctaagactgttgttcccatccatcactgaacttccccgtcytcttccttcaacccctgtgttagtcaatggttgaaattttgatttggtaaaaaacctctggcgaaaaccagcaaaaagggctcacaaatcaggtctcagggaagcacagaggtagccacgagaaggcccgaggtgctcatgcaaagagctcgagcccaggagctctgggaggaccccaggcgctcggagccgccgttacgtaaacggcactcagagcctccgaagaccggaaggccccgctcaggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccakactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagakgagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggycttccaaggtaagggggttcattaatcgccaaggcctcactcccttttttccatctctccccggactcacccgccaagggtgggttggaaaccgaaacgagtcagtgttgaaacgtgtctcatcctattcctgaagccagaatattctggccatgagtcattgtttccgcccatcttgattcttttggaaatggcagctcttgttcaaagaccggaaagggtgggatgtcaatttcaagtggggtcaacctgagttctgtaaatcccagtagcgattttcccgccgcgggtgggcaggcgaatcttgcgccggtttagacaaaggaggccgtgaggacctgcatgcttttctttctcaggcatgcttcggaaactggacatcaaaaacgaagacgatgtgaartcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggtaagtttgccttaaggatgaaaggggccttggagtggaagtagaatgaaggattttttttagagaggtggggatatctaaaggtttttatgacgcacggctgtttgcaggctctaactaaaggaccattgtttatttgatgttgatttaagtagtggatccttagagatagtggtatggcggtcttgaattgtatcaaaaatcttggttttctctaggcaattttttgttccaattcagttgaatactcttcagtggattcaaaccatgaaaaaataagtcaccaggggaggatagctgaaataattcctaaggcggtgcctgttttaatggagaagatatggggtggagcctgcgttttaaacaaacccagatctgatgcaggatgtacttaactacgttgagaaaaactgatctgcgcaattgaggcgttactgaaatattaggtggtggagatttgagaataagggttttcgtcttttacctcatgggaactctggaagtccttttgttaggataaatcctaataagaccaagatagtactgtaaaatgaagtttaattatcatgggtccccgcttaagaaactgaagaacttattttctttttttgccccggggtgaataataattggtttactattgctttagggggaaaccttagatattttaatttaccttctctctggatagtagtgttgttaagagagcagaaacccatacttgaaaatgtgcttttcttttttgttttctaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttytagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttamtaaaagattttcagctgaatggaactcattagctgtgtgcatataaaaagatcacatcaggtggatggagagacatttgatccyttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctyacttaaatttacagaaagaggtgagctgtgttaaacctcagagtttaaaagctactgataaactgaagaaagtgtctatattggaactagggtcatttgaaagcttcagtytcggaacatgacctttagtctgtggactccatttaaaaataggtatgaataagatgactaagaatgtaatggggaagaaytgccctgcctgcccatctcagagccataaggtcatctttgctagagctatttttacctatgtatttatcgttcttgatcataagccgcttatttatatcatgtatctctaaggacctaaaagcactttatgtagtttttaattaatcttragatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtctyacgcttmtctcagggaaaaacatgcagtsctctagtgtttcatgtacattctgtggggggtgaacaycttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacagggtgtgatatgggtcttttctcatcgacgcctctttttccttccctctcttaggcaaaccttttagagaagtcagctgagcaaatatgtacaggtgaattcaaagcaaaagcctcacaaagttgatttgccttagagcaaaggacagttcctttcttcaattctaattagaggtgttgggtttttaattaaatatattactgctgtacttagaggagttcttaaacctccaagtaaaatcaaaaacctctttaaaatcaaaatttctgtcttgatttatttatttattattttttttttgagatggagttttgctcttgttgtccaggctggagtgcaatggcacgatctccgctcaccgcaacctccgcctcccaggttcaaatgattctcctgcctcagcctcctgagtagctgggaatacaggcatgcgccaccacacccagataattttgtatttttagtagagatggggtttctccgtgttggtcaggctggtcttgaactcccgacctcaggtgatctgcccacctctgcctcccagagtgccaggattacaggcgtgagccatcgcacccagcctctgtcttgatttttttgaatcaccaggtgttggtatgttttgttttgttttgttttgaggcacagtctcactcttttgcccaggctagagtgcagtggggcaatctcggctcactgcaacctcagcctcccgagtagctgggattacaggtgcccgccaccatgcccggctaatttttctatttttggtagagacggggttttgccgtgttggtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcaaaaacccctatcctgcttttattttcagctaccttgaaagtgagctgaatcaccatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctcagcaccttaaaagcttggatttaatagtaactgggtaaccttaatcagtagtcagaattatcaacactttgctttatttgacacaaccagactttctcagttcctgttctgtatctagagcaacgtcttcatactgttttttcacaaaatttttatttaaaacagttgtgacagccgaaggattttttttttttttttacaaaattaaaatgaaataacttgtacaactggtgcgtaccatggctccagccagatgcccaaagcactggctattaattcctggagttcagatggtcagttgagtctatcctagttttttgcttcacttgttcaatcatggaactttctagaacgctgccactcttcaaaggcttctcaatttcaaatttgaaaacttaattctctccctcttagtttcaaagttgttacagtgttatctatgtgaagtatgtggaaagttgggggctggggattttcctccaggcagattaagaaacagctctccgggtcgggcgctgtggctcaggcctgtaatcccagcactttgggaggctgaggcaggagaatcgctcgaacccgggaggcggaggttgcagtgagctgagatcatgccattgcactccggggcctgggcgacagagccagacgctgtctcaaaaaaaaaaaaaaaaaggcacggtgactcacacctgtaatcccagcactttgggaggccaaggtggagggatcatgaggtcaggagtttgaggccagtctggccaatacagtgaaaccccatctctactaaaaataaaaaaaattaactgggcatggtggcgggcgcctgtaatcccagctacttgggaggctgaggcaggagaaccacgtgaacctgggaggaaccccggaggtggaggttgcagtgagccgagatcgtgccactgcacttaagcccaggtgacagtgtgagactctgtctcaaacaaaataaatacctctctagtgaggtggctcacgcctgtaatcccagcactttgggaggccaaggcgggctgatcacttgaggacagaagtttgagaccagcctggccaacacggttaaacgccactactggtggcgggcactagtagtcccagctattcaggaggctgaggcaggagaattgcttgaacccaggaggtggaggttgcagtgagccaagatcatgccactgcactccagtctgggtgacagagcgagacttcctctcaaaaaaaaaaaaaaaaaggccaggggcggtggcttatgcctgtaatcccagcactttgggagcccaaggcgggcagatcacccgaagtcaggaatttgagaccagcttggccaacatggtgaaaccccgtctctactaaaaatacaaaaattagctgggcatggggtcacgcgcctgtagtcccagattgcagtgagccaaaatcacaccactgcactccagcctggcgacagagcgagactccatctcaaaaaaaaacacctccgaaaatttggtgtcctttactaataattcttgggaagtagaaaaaggatatacgtagcaagcttttgttcccacactatacttggtttctaatttgcagttcccttcttgacctgcatagaataatagttattttccattgggaaatgagaaatcttcaacattgaggtaagttaggatttttttttttttaagaggtggggtctcactctattgcccaggctgcagtgcagtgggactatcacggttcactgcaaccttgaactcctgtgctcaagcaatactcccacctcaacctccaaagtagctggtactacaggtacctcaccatgccttgtgttttgttttgttttgttcatagagatggggtcttgctatattgcccaggcttgtctatttagcaggagctttaggcagccagatgttgagagtgtcttcatttttccattacatgacagtagactgcttattatgtatcatgaactgttagataatggaattataaagagatcattcttccccttaagaaactcaaaaaaagaggccgggtgcggtggctcacgcctgtaatcccagcactttgggaggccaaggcgggcggatcacaatgtcaggagttcaaggcccgcctggccaatatggtgaagctccgtctctagtaaaaatataaaaattagccaggtgtggtggtggactcctgtagtcccagctacttgggaggctgaggcagaagaattgcttaaacccgggaggccgaggttgcagtgagctgagattgggcccctgcactccagcctgggagacagagcaagactctgtctcaaaaaaaagaaaaaaaaaaaaagaaactcaaaaaaagattggggaatagttcaaaagaaacatgacaactaactacacatgtcaaaaagctataaaggacatggggacatttgcggaaatttatggattgtatgttactactgtatcgatgttaaatttcttgagtattataccttgtttttaggagatgcatgctaaagaatttatgcataacgaatcccataatgagaatgcaaatgtggctagatgttaaagtttgtgatctagctgggtgcagtggctcatgcctgtaatcccagcactttgggaggctaaggcaggcagattgcttaaacccaggagtttgagaccagcccaggcaatatggtgaaactccatctctataaaacataaaaaaaattagcttggcatagtagcacgtgcctgtggtcccagccactggggaggctgaggtgggagaaacgcttgagcttacgaagtcgaggttgcagtgagctgaaattgtgccactgcactccagcccaggcaacagagtgagaccctatcttaacaaaaaaagaaacacacacacacacaaagtttacaatctagtaagagtcatagacatggacagaaataattagaaggcactgtacaaagcattgtagggttgggaaaaagcagggtgacaacttctagacgtagagggtggtaaagaaggcttcataagaaatgtgaggttggaccttaaaacatgagtaacgaggctgggcacggtggctcatacctgtaatcccagcacttggagaggctgaggtgggtagacacccgaggtcaccagtgtggccaacatggtaaaaccccatctctactaaaaacacaaaaatttgatgagcgtgatggtgcacacctgtaatcctagcttcttggggggctgaggccggagaatcacttgagcccgggaggtggaggctgcagtgatccgagatcatgccactgcactccagcctgggcaacagaacgagactcaaaaaaaaagatgagtaagaaacacgtaccaaagcatggaattgggaaagaccctctgggtgtatggagatgggagaagcagggatggactgtgtaggtaattttcttattccatcttccttccctgccttctttctccgctcgccgctcttggtcagtgaatactgtatgacttcagtttttcccatctcaggccttatataaaaatattagagccaggcgtggcggctcatgcctgtaatcccagcactttgggaggccgaggcaagcagatcacctgaggtcaggagttcgaggatagcctggccaacatggcgaaaccccatctctactaaaaatacaaaaaaattagctgggcgtggtggcttattcctgtagtcccagctactcgggaggctgaggcaccagaatcacttgaacccgggaggcagaggctgcagtgagtcatgatcacaccactgcactccagcctgggtgacagagcgagactccatctcaaaaaaaaaaaaaaaaaaaattggccaggcacagttgtacgtacctatagtcccagatattctggaggctaaggcagaagaatcacttgagccccggagttcagggctatagtgtgctacgttgatctggtgttcacgctaagttctgcatcaatatggtgacttcctgggagtgggggaccatcaggttgcccaagtaggggtgaacctgcctaggttggaaatagagctggttaaaactcctgtgctcctcagtagtagaattgcacctgtgaatagccactgctctccagcatgggcaacataacaagaccctgcctcttaagataaaatttggaaaacactgataggaaaaaaaggctctttggtctaaataagtctggactgggtataaatgacacacaactggatggactgtgtttaggaagtagaaaagactcaattgcttcctgtatcatgttaaagtggtgaccctaaacacacaatctcaggatcatagccatctttggatctagactgaaggagttggcattggcaggcctggtttgaataaagttgctcttttaagagcatcacctaaggtaggtcactggagcctcactggtccttcaccctctaggttttacatagtcagggaaaggaaccaaggttttgcctaagagcactatgctgtctgcagaacagaattttaataagagcttccaaaagttatttaactggaaccctaagatactgaatggtggctt

SEQ ID NO: 10642 - DNA, 112486 bp, Homo sapiens
  misc_feature (1)...(112486): n = A,T,C or G, or insertion/deletion polymorphism (see Tables 1-2)
atcacgctactataaagacacatgcacatgtatgtttattgtggcactattcacaatagcaaagaattggaaccaacccaaatgtccatcaatgatagactagattaagaaaatgtggcacatatacaccatggaatactatgcagccataaaaaggatgagttcatgtcctttgtagtgacatggatgaagcaggaaaccatcattctgagcaaactatcgcgaagacagaaaatcaaacagcgcatgttctcactcataggtgaattgaacaatgagaacacttggacacagggtggggaacatcacacactggggcctgtcgtcaggtggcgggatgggggaaggatagcattaggagaaatacctaatgtaaatgactagttaaagagggcagcaaaccaacagggcacatgcatacatatgtgacaaacctgcacgttatgcacatgtaccatagaacttaaagtataattttaaaaaaatgtaagagaaaagaataccaaagttaattgcaaggatccttaataagaactacttacattggaagcaaaccacagagaattgtaaggagtcatgtgacagagaggaccaggatgccatgaaaatggacttggctaaaaataggtcatttaacccttggctgactggcatctctctagattttcagttatacaatgttcaatctgctgtgcaaggtaattccatcttgcaaaggatttgatgttacattctaccacacatacaactgaattaaacttttacggaattggaaatgcaaataattgatcaaaataaatcaaacaagaaaagaataggaaggaataaccagtgatggaatatcaaatatgaatggaaaacagaataggactgctaaaaagaaaaaaagcttcagaagcacataatagccgtgttatttagaatcatagtggtgtgcaaatgacttctatcacatctcattcaataccagagcaaaagatgttaagtttattatgtaatgcccaccaaatagctagcttttgaaaaaaacttgtttctcaatttgagctaaccatttcaggctactgcatcaaaccaaagttattggcatcatgctaagctagatgtgttgactgaagtatgagattcacacttttgtaaatgaaaagcaatttgattaggcaatgttttcctaagtgaaagcaagttattagagaagtaaagaaacaaaagaatggctactccatatagcggagtttttgtttttttttttaagtgtaggcaaatgtttagtgaagatgatatttcaataagaaaattggtgcttgggacgtgcttccactaaatttgagatatcttagacaaaacaaagtcttattttcaagacattatttttatcagactgaagtcttggaactatttgatctagttactctatgttctcaactgtgttaactaattgaaaacaacattgttattaaaggtattcacaagaaaaattcagagttactgttgcatatcctttctctgtttcaaactgttttctcctaagcacccaaggctctgtgatgtctgaaacagttaatcattaattttaaaagataagcttatcgtggaattagaaaaaaaaactattttaaaattcatatggatccaataagagctcatatagcaaagagaatactaagcaaaaagaacaaagctggaggcagcacactaccccacttaaaagtatactgtgaggctacagtaaacaaaacagcatgatactggtacaaaaacaggcacatagaccaatggaacagaatagagaattcacaaaaaaagtccgcacatctacaaccatttgatcttcaacaaacctgacaaaaacaagcaacggggaaaggattccctatttaataaatggtgatgggagaactggctagccatatgcagaaaattgaaactagaccccttccttacaccttacacaaaaattaactcaagatagattaaagacttaaatgtaaaacacaaaattataaaaaccctgaaagaaaatctaggcaataccattcaggacacaggcatgggcaaagattttatgatgaaatcgccaaaagcatctgccacaaaagcaaaaattggcatatgggatctaattaaacaaaagagcatctgcacagaaaaagaaactatcagagtgaacagacaccctacagaatgggagaaaatttttgcaatctatctatcttacaaaggtctaatattcagaatctataaagaacttaagcaaatttacatgaaaaaaacttcattaaaaagtgaacaaaggacatgaagagacatttcacaaaataagacgtacatgtggccaaaaaaacatgaaaaaaagctcaacatcactgattacagaaatgcaaatcaaaaccacaaatgagataccatctaatgccagtcagaatggcaattatttaaaactacataaacaccagatgctggcgaggttgtggagaaataggaaggcttttacactgttgctggaaatgtaaattggttgaaccattgtggaagacagtttggtgattcctcaaagatttagaaccagaaataccatttgacccagcaatcccattacagggtatacatccaaaggaaaataaatcactctattataaagatacatgcatgtgtatgcttattgcagcactatccacaatagcaaagacatggaatcagcccaaatgcccatcaatgatgtactgcattaagaaaatatggtacatatacaccatggaatattatgcagccacaaaaaggaatgagattcagtcttttgcagggatatggatgaagctggaagccatcctcagcaaactaacacaggaacagaaagccaaacaccacatgttctcacttataattgggagatgagcaatgagaacacatggacacaaggagaggaacatcacacactggtgcctgctgggggagggcagtggtgggaggagtattaggaaaaaatagctaatgcatgccagggttaatacataggtgatggtttgataggtgcagcaaaccaccatggcacacatttacctatgtaacaaacctgcgcatcctgcacacataacctggaacttaaaattaaattaaattaaaagacaagctaaaagggttaacgaaaaataattagataaaaaaattttgattttcaaaatcctgaaacaagagttttaaatttgcttttaatatatattcaaatcctttaatactgttcccttccagagatgctgcttaatttcctctcttgagtgtggcttggacttaatgatgcatttctgatatggtctggctctgagttcccaccaaattctcatcttgaattgtcatgcaaattgtaatccctatgtatcgggggagggacctcctgggaggtgattggatcacgggtatggtacccccatgctgctcttatgatgctgagggaattctcatgagatctgatggttttatgaggtatttttccccacttcgatctgcaattctctctcctgccaccatgtgaagaaggacgtgtttgcctccacttctgccatgattgtaagtttcatggggcagccttctcagcaatgcagaactatgagtcaattaaacctctttcctttataaattacccagtctcaggtatttctttatagcaatgtgagaacggactaatacaacttctaactggtaatgctgacataagagtttgtgactctgggtgtagaacataaaactcactgcagcctcccccttctctctcaatgtctctggaatcatgagctctgggggaagccacctgctgtgccataagcagccctgaaggaaggtccatgtggctgagaactggggccttctgggaacagaaaacaaggaactagggcttttccaacagccatgtgacccatccatgtttcatgtgaatcctcagtcccagtgaagcactcagatgatgcaggcctaggctgacaactggactgcaaccttgtgagaggccctgagcaagaagcactcagggaaacctctcctggattcctgaccattggaacctgcgggagatgatgaatatttgccattttgagctgctaagttttacataatttgttatgcaatagtaaataactaacacattttcacaaaagaggatgtagtattacacattaatttgcatttgctctaaatttatcattattattaatattattgttattgagacagggtctcgctctgtcgcccaggctggagtgcagtggcatgatcaccatgcactgcagtgtcgacttcctgggctcaagggaccctcttatctcagcgtcctgagtaactgggactacaggcatgaagcaccacgcctggctaattttctaaatttttttgtagagatgggggtttctccatgttgcccaggctgatcttcaacatctggagtcaacaaatctgccttcctctgccttccacggtgctagaatcacaggtgtgagccaccacacctggcctaaattaattataagacattacacatgtaacttagttttaaaaggtaaggagaatgtccatggctgaagaggatgcattttattaccattcacaatgatcactttacttgaacttcaatttccaactgtgtccaaattaaacacaaaaggaagatccaacccttgctgggctgattctttgatggcccccaacagccacctcccggtcattcactttcccccagttattcaagcaactctagtgtagatgctgctgtgaagggatttagcagatataactaagggcctcaattagttgactttaggctgggtttatcctgctttgactgtcctaatwaggtgagtccttgaaaggtctgtgttctttctgagcatagagatttgcagtgtgagagggattcagcatgaggggtttcctctaccgtgggctttgaaaatgaagaggctgtgtaggaaagaacactgttaggcaccaggaattgagcacagccctgcctattctctgtattgacagccagcaaggaacagaaacctcagtcttacaactgccagaaactgcattctgccacctctgtataagcctgaaggaggattcaaaatgaaaacacagcttttggaagcccagaacagggattctatccacatcttgcccagatttctgaccaaggaagtataagcagataaatgggtgttgttttgccagtcgtggtagtgcacgaatgaattgatgaattgatatgcacactaattacataaaataaaatatttcttaactttttcagtattttacattttataattttctgtgatgcaatttaatagactcatatttcattcattcagtcaagaaaaattaatttaatccctacaatgaaccaggtgtgccctcatatgcttacgtgcctgacattccagaagcttcacaagaccaaggtggagccagtggaatgttttaggtggagaaatgacacactctgactcacaggagcaggaccactgtgcagagaacagtcacgtagcaggtaatgggacagtgctagtgtcacaaataaggagtgacaaggtggtggggactaaggggagaggagggcctgagggatgagaggaatggagggaagggctggagatgcaggaggtgaggaaatggagcagagggaaagaattcgaaagcagcagaactcaggtttaaacacattgttttatatattttaatacatcaatctacagagccttgcagggtgatctttgcagttggcctttaataccttatgtgggtctgcctaaaaactaatttttttatgttaatcaggtttaaaaaatactaagtgttcatataaaatatacacaacacttagaagtggatacttcctaaaaacaggcagtgcatgagcactggtgaggggcattgtgactgcattgagtgcttgccactgtgagatgaataaagtccgtactggctcctggttacaacatatagtaacacagtggctaccttgtattaggagatgtcctggactcacacagaaactcagggctatggaatgaaggtaaatttaaaatactacaagcgggagtcacagatacattgtctgggaaagtgaaacttaggagctttgtgattcctgttgtaatgcttttagacacatttatatgtcaagggaccaaagtcacatttttggccrattagattcctgatcattaggagttaccaagattctgctacccactgtagttaataaacaaaaagcaaactggtctctattctatctcatgcactcaggcacaacttttccagatttaaaaaacaaacaaacaayaacaacaaaaaaccctgtctctacacctccattcccagggcaagctcactctctggcaacaagctccctggrgtgatttttcttctagaagagtccacggggacaggtaaggagtaggaggcagggagtccagttctgggacggggattccgtgatgcaaagtgaagagagaggaacggggcccatttcgagggtttctccctggtttctcagacagctcctgggccaagactcggaaacgttgagacagagcgcttggcacagaagtagcggggtcagggcgaagtcccagggcctcaggcatggctctcaggatctcaggccccaaaggcggtgtatggattggggaggcccagcgctggggattccccatctccgcagggtttctcttctccctctcccaacctgtgtcgggtccttcttcctggatactcaccaggctgccccagttctcactcccattgagtgtcgggttcctagagaagccaatcaatgtagccgcggtcccggttctaaagttcccacgcacccaccgggactccgattctccccagtcgccgaggatggtgtcatggcgccccgaaccctgcttctgctgctctcgggggccctggtcctgacccagacctgggcaggtgagtgcggggtcgggagggaaacggcstctgtggggagtagctagggkcctgcccggcgggggckcaggaacccggttgcggtgccgggaggagggtcgggagrgtctcagccccctccttgctcccaggcttccactccttgaggtatttccacaccaccatgtcccggcccggccgcgcggatccccgcttcctctccgtgggcgacgtggacgacacgcagtgcgtgcgsctcgacagcgacgccacgagtcccaggatggagcmggaggggccggaatattgggaagaggagacagggaccgccaaggccaaagcacagttttaccgagtgaacctgcggaccctgagcggcyactacaaccagagtgaggcctgtgagtgacaccggccgggggcgcagrtcactacccstcyacatcccccacgraccgcccgggtctccccgagtctctgggtccgagatccacgccgaggcagcggaacctggagaccctttacccgggagaggcccaggagccgttacccggtttcattttcagccaaaatccccgcaggttggtcctggcgrgggcggggctcggtgggcggggctggccgcgggggcggggccagggtctcacacccatctagaggatgtctgtctgcgacgtggggtcggacgggcgcctactccgcgggtatcaccagcttgcttacgatggcaaggattmcatcgtcctgaacgaggacctgtgctccttgacagccgcagacacggcggctcagatcacccagctcaagtgggaggcggcccggggggcggaggttcatcctcacagggataggcacctattagatgtggtgtggttttcctctctactcttagaccctcagccagtatcactattggcattcctgagccactggctcagaatttcagtacattatctgcccgcgggacacacctcagaggaaaggggatgaagcgtggtccatgaccatggcaccccctggtcttatcaccacctgcacctcccaggggctgccagccacacagagtcatggacaggtctctacagacacaacttagtgccagcttggatgaaaccctctgaggaatgggtgccatctttcaggatgtggtgcatgtattgaatcaaagatgtctctatagtgctgtgtttacagaaggaagaatacgtgggtccaaaaaccaagaagtagaagcaggtgtggctccatatctaaacccttatattcaccttcagggtgattttgcacttctcatctccaatatctgggctctgtaggggaggaggtcctggtttcccaaagggggcaccctggcaaggagacatttaaatgagagtccatggaaatacacattatggctgcccccagggatgtttgaatagtatgtgtccagatacaagcaggtgagaagaggaggaggcagggctgctatcacacaaggagggcaggagatgtgtgtgtggaaataagagatccacttggagaccttatggttccccttgtcctgttgtaagtgtgagcagaatcatccagcaacccagcctgagagggtttcatattcaagagcccagaaccctcaggaaggaaggattgagcgatactcataggtaatgtcccaaggctgtgctcctgtgctctgacatcctcagcaggattggtgcaaagccctgcttcccatgggctgttcccagccagtgactggtcacagcaggcgttaaggcaagccattcctgggagacacgggactcctctgatggccaactgtagctggaaggctcctccacggccttgctcaactctccttagattgcctgtgctctaggatgcgtcgaacaaactttctctccttctgtccagcacttggggtcacacttgcatcgtggtctgccgccttttccagggatttctggctcacttcccatattcccttacgggtgtgtcccctcataagatgtcgcagactttaagctcatcttggcatctgctccttgaaggacttggactaaaaattatttccatctgcatatcaataactcttattccaacctgtaaaatccttctctttatccaacttctgccacccccacagaatctattttacttgtgtgtgtagtatctctttgagttaacagatatttgttctattaagctactaaattttgaggtagtttgtgacacagcacttgataactattaaggctttcttaagtttccattattccatggatattatctacatatcttttaatcccttgcattttaataacattagctatacttgctgtttccaactctttcctcctatttttgaacattttaaattttgtctttctctgtccttccttccttctttcctcctttcctccctcagagctttctccctccctccatttttttcataaactccaagtgtttaggccaaaaggaagcattatttgaactttatgctaaaagtataatgccgtaatttataatataaaagtaaagaaaaggaagttgttaatggaatatgaaaaaatgcctagggtgattctatagccaagacagtaccttttaacatttaatttctgcctccaactgaatgttttcagaacacatgagcaacacaagctctttcccattcttggtacaagcacttgagaaatcaaattagccttatctagtatgattaatgtccatacatcatataatcccaccatctgcctcctgatcataccccctggggacattcttggctatgtgtccaggagacatgtacaccaatgtttatggcaaaaactggaaacaatcacatatacatcaatgggaattaacaaaattgtcgtataataataaaaagtaaaacttcagcagcaacagtgaatgaacagcaccctcccacatcagagataactctcctacacataacatgcatcagcatcacagaagaatgcacattgtgtgagttctctgtacggggaagtttaaaaaagcaggtcaaactgtgatttggatatatatatacttattgtaaaaatctttagagacaatgaaaaggaatagtaaatacaagactcaagatagaagttccttttggggaatagaattggacaacagccgagggtggcttcataggttttgttttttatgccaggaggggatgtccaggtagttaagttacttgatcataaatctttatttatttatttatttatttattttcgagatggagtctccctcttgttgcccaggctggagtgcagtggcgtgatctcagttcactgcaacctccgcctcccaggttcaagcaattctcctacctcagcctcctgagtagctggaattataggcatccaccacgacacccaggtaatttttgtatttttagtagagacrgggtttcaccatattgtccaggttggtctcaaactcctgacctcaggtgatccrccaacttcggccttccaaagtgctgggattacagacatgagccaccattccyggcccacaaatctttaaagtgtcatttttcaaaatgcaccttgtgtgccattcctgactgattatttggaaatgaaagagaaaagaaaataccaaagttcatctcaaggatccttagcaataactacacacgttaaaacaaagccacagccaattgtaaagagtcatgtgacagagaggaccaggatctcatgaaaaatagccttggctagaaagaggtcatttgaccctgggctaattggcaactctctacattgtctggcatacagtgttcaatctgatgtgcaaggcaattgtatcttgcaaagaatttgagaatttgatatgttgctcacattttaccacacatacaagtggattaaacttttacacagtaaaaaaaaaaagcattgttgagcaaaataaattaaatgaaaagacataaaggaataactagtgatgaaatagcaataagaatggaaaacatgaaagagatgcttgtacagcaatgatagcagcacaaaagaacagtgtttttcagaatcatactggagtccaaatcacttctaccacatctaattaaaaaacacagtgaaagatgttaaactttcataggatgcccactgaatagccagttattgaaaaatcttgttcctagattggagtaaacaatttctgcctaccctagccaaacaaattattgtcatgatgctaagctagtgtatagacagaggtgtgagattcacatttttctaactgcaaagcaccctgattaggcaaatatttttgtagatgcttgagtaagaaaattggcattttgggcattcttaaaccgaattagaaacttctgaagagaaacaaacgtagttatgattgtaaaggcattattgtatggcaccaaagtcttgggacactttaatttagctactgtattttctcaactctgttgcaacttatcaaagagaatattaatattaaaggcatttacaaaaaaaatctgagatattgttgtatcttctttctctgtctcaaatatttaatcaactttacagaagagaattttaaagtattaaaaaaagtcagatacaagaagtatttgatttacaaaaccctgaaacaataatgttaattttgcttttaacatgtttataaattctttgatactcctcctttccagaagtgcagcttcattccctccctgttcgtgtggcctggacttaatgactcacttctaactgatagagtaatgctgacataatagtttgtgattctgggtgtagaacataagactcactgaagtttctactttggttctttctttctctggaatcatgagccctgggggaagctggctgttgtgtcataaggaggcctgtggtccatgtgactaggaagtgagtcctcctgggaccagacaataagaagctaaagcctcttccaaaagccatgtgagagattcttgtgtcttgtgaatccctggccccatttgagccctcaggtgattcagccctggaagacaactagactgcaacgttgtgagaggccctgagccagaagcattcagagaaacttctcctggattcctgaccatggataactgtgggagatgataaatatttgttgatttgagctgctaagttgtaggtgacttgttatgcagcagtagataactaatacagcttcacaagagaggatgaatcactgaactttttcatttgctctaaattcattataagatattaaacatgtcatttgcttttaatatttaataaaaatttccatggctatataagatatattttattatcattaacaatgatctattttttgatcttcaacttgtatgttctatttaaacatgaaaggaagatccaggctatgctaggctgattctatgatgacaccccaataaccacccttggttactcaggttaccccagttactcagttgacactaaagcaggtgctgctgtgaagaggttttgcagatatatttaaagtccccagtcagttgactttaagatgaggattatcctgcttagacggtcctaatcaggtaagctctgaaaaggactgggttcttcctgagaatagagactcacagtgtgagagggattcagcgtgaggggcttcctccactttgggctttgaaaatggagggatcatggggaaagaacactggtggccaataggaattagaagccctccccactgtctactctgatagcccgaaggaaacagggaccttaatcctacaattgccagaaaccgaattctgccaacaaactctacacaagcttgggggagaaccccaatcttaagatgaggatacagctttgcgaaactctgaacaaagagtctatcacattaggcctggatttctgatgaaggaaatgtagacaaataaatgggtgctgttttcagccactaagtttgtggtaattggttatgtactgccaggaaataaataaacagattcaaaggataagtatatgacattttctccaccggaatgaattcatgaactgatatgcatagtagttgcataaaaccaaatatttcctaacttgctttgcattttccatttcatgatttttgtgtgatacaattttgaacacaattatatttcattcattcattcaacaaaaattaacttagtgcctactatgtggcagatatacttttatattctgtagatacaactttgatcaaaacaacccaaagcccctgtgcttgtgccttccattctagaggcttcttgagagtaagatggagccattagaggcttttaagtgaagaaatgaaacaatctgactcacattagcaggattgctgacctttgtggggagaacagtcatgggcagcaggcragggacagagctagggmcacaattcagtagtgacagagtagtagagactaaggggagaggagggcctgaaggatgacaggracagagagaagggctggagaagcaggaggtgaggtaaaggaacagagagaaagaattctaaagcaatggaattctcagacttaaatacagtgttttatagatttttaatgcatttatccgcaaagcctggcacagtgttacttgcaccttggtctttaatgcattctgtggggctgtctaaaasctaattgcctctctaagataaaaaggttaaaaaaggccgggcrcggtggctcacgcctgtaatcccagcactttgggaggccgaggcgcgtggatcacaaggtcaggagatcgagaccatcctagctaacatggtgaaaccccgtctctaataaaaaattacaaaaaaattagccgggcgtggtggcggtcgcctgtagtcccagctacttgggaggctgaggcaggagaacggcgtgaacccgggaggcggtgcttgcagtgagcgagattgcaccactgcactccagcctgggcgacagagcgagactccgtctcaaaaaaaaaaaaaaaggttaaaaaagaataccaaatgtctcaataaaatatacacatagcttagatgtgaataattcataataataggcaagtgcatgggccggccattatagctcatgcctgtaataccagcattttgggaggctgaggcgggaggattgcttgagcccaggagttcaagaccagccagagcaatttagggagacctcatctctacaaatattatttttagaaaaattagccaggagtggtggcacaagcctgtggtgccagctacttgggaggctgagggaggagcattgatcacatgagccaaggaggtcgaggcttcagtgagtcatgagcgtgccactgcactttagccagggtaacagagtgacgmcctgtctgtaaataaataaaaaataaaaaaattaataataaagggagtgcatgagcactggcgaagggcactttggctgcattaagcacttgcaattctgaggtaattaaattctgtacaggctcctggttgcaatatacggtaatacattgtgctttgtattgagatgtcctggactcgcacacacaaactcagagctatgaaataaagatactgtaaaaatacaacagaccagagtcacagatacacagtctgggaaagtaaaacttcactttgtgagtctaattgcaatgcgtttagacatatttatatataatggggccaaaaatcatctcttttacaaattagattcgtgaccattcaggggctaccaagattgtgctacccactgtagcacaatcggagacccacgccgaggctgcgggactcgtggagaccctcgacacaagaaccccaggtgcctatacccgattccattttcagttcaggcccaaatccccgggggattgatcggggcagaggaggagctcagtggctgaggctgaccgcgggcttggggacagggtctcccacctccagtggatacacagctgcgacctggacccggaccggagcctcttcgcgcggggatgaacataccctacgatggcgccagttacctcgtcctaaaccaggaactgctctcttggaccgcagcggahaaggcggctcagatgttytggaggaggaacatgcagagctgctcaaaacctacctgccsggaaggtgggcggagtggctcagcaaaggccttaagaatgagaaggagaggctgcaatgcgcaggtaccagaggccacgggkcgcctccctgatctcctgcagatatccctgagccaycttccaaaagaaggggaggaaaatgggaccaacgctaaaatatccctctccctcttgtcctgaggcagaagagtcctcctgggtttctaaatcctataccagagagtgactgagggcccgccctgcactctgggacaattaacggatgaagtctctgcgggaaaggaggggaagacaatccctggaatactgatacgcggtmccctttgaccccccagcagccttgggcaccaggaattttcctctcaggccttgttctctgcctcatactcaatgtgtgtgggggtctgattccagctcttctgagtccctcggcctccactcaggtcaggaccagaaatctctgtttccgcctcagacactagaactttccaaggaataagagattatcccaggtgcctgtgtccagaatgttgtctgggttctgtgctcccttccccaccccagatgtcccatccattctcaggatggtcacatgggtgctgtgtctcatgaggaatgcaaagtgcctgaattttctacctcttgccctcagatcccctgaaggcacaggtaacccwccaccccatctccaactatgaggccacgctgaggtgctgggccctgggcttctaccctctggagrtcacactgacccaggagcgggatggggaggaccaaattcaggatgcagagtttgtggagaccagacttgcagggtacagaaccttccagaagtgggcagctgcagtggtgtcttctggagagaagcagaggtacacatgccatgtgcagcacgaggggttgcctgagcccctcacactaagatggggtaaggagacgaatgaggggtcatgtctcttctcaggcaaagcagaagtccttctggagcctttaagcagggtcagggctgaggcctgggggtcagggcccctcacgttcacctcctttcttagagctgtcttcccagcccatcatccccgttgtgggcatcattgctggcctggttcttctagttgctgtaatcactgtagctgtggtcgctgctgtgatgtggaggaataagatcccaggtaggaaaggggtgagctctgagtttccttcttccattggtggatttcaagccccaggtaggagtaggctcatatcttgcctagttgtgaggcaccatctccacacacatttaccctgttcagaggccctgtctatcaacacttactcttttgtaaagcacctgtgaaaatgaaggacaaatttatcaccttgattgtggtcatgggaacctgactcccagcartcacaggtcaggggaaggtccctgctgaggacagacctcaggaggacaactggtccagcctcaacacatcctcttcccttgggttttctgatcctgacctgggtctgtagtcacagttctggaaacttctctaggatctcatgccctgcctcctccctggcctctcacagtttgttttctttccacagatggaaaaggaggcagttatgctcaggcttcatgtaagtgtggtaggggtgggaagagtgatccctgagatccttgggatagtgtagacaggagcccatgggggagctcagccaccccaaaattcctcctttagtcacatcacctgtgggctctgaccagattttgtttttgttccaccccaaacaggaasagtacccagggctctgatgtgtctctcamggcttgtaaaagtgacaccttagagggcctgaagtgaaagaggagttgggcagaggggacacaactargctctggagattctttgatttggaatttttcaaggtgtggtgggctgttcagtgtcacaacttactgtgactgacctggattagtttatgactatgttttttctaagattgccttgtgagggactgagatgcaagatttgttcatgcctcctctttgtgacattaagrgcctctggcttctctttctgccaaagcrtctgaatgtgtctatgtctacagtaacaggtaagaaatgggagaccagcccatcctcatgtccaccatgacccctgatattgtttggatctgtgtccccacmcaaatctcatgttcaattgtaatccctaattttggaggtggtgtctggtggcaggtgatcggctcatgaggatggatccttcatgaacggtttagaaccatctctttggtgctattcttgtgataattctcataagatctggtgtttaaaaatctgtgtcacctccctgctctctctccctcctgctccaggcatgtaagtaatrtctgcttccccttagccttccagcataatcgaaagttccctgaggccctctcataagatgagcagatgccagaatcatactttctgtatagcctgcagaaccatgacccaatttaaacctcttttctgtttttgttttgtttttgttttttgaaggaaaatttatattattttaattatttttacatacagaaaactcaacagcatacatttcacccaattyagtggcatgttctttaccctttgcctttttgagcttggcaatgcaaaccacatacttgagacccaggacactgtctccccagtgayggcggatctcatcrtatctgtcattgtaattggtcctgagaactyccaccagcttagccaaagcacctttgtcttccgagttaacctgtgtgaaggtgacagtggtgcaggtcttcctatggactagatgtcccagtcttgccttccctttgataatgcagtaagggaccccattttatgacacaggacaggcaagaagacaaccagcttgatgggatctacatcatgtgcwatcaccaccagctgagctttcttgttctccaccaaggtggygatggtgttaactcctgctcgaaggacaggtggactcttagtggggaatgtcccctttgccagcagctttcttcttggcccrggccaacagcctctgcttcttctcttggtttgtctctggtctgtattgtgggccagcttaagcagcagagtagctgtttggctgtctggtgcctgggtgaactggttaatctcaggaggcactttcagccacttatagaggatggttctctgctgctgcaacctgatatagcagggccatttcacaaagtgggtgaggtstcttttgggctggatatcctgtccagtgccaarattcttaggccttttctcaaacaagggatttaccactttcttggcctcctgcttcttcacgacagcaggggctggagccaccttcttctccttggccttctttccttttggcatcttggatggtgggaggagaaagaaagaaacctattttstttataaattacccagtctcaggtatttctttataaaagtgtgagaatgaactaattcagaaaatcggtaccrggagttgggtattactataaaaattsttgaaaatgtggaaacrgctttggaactgggtaacaggcagaggttggaagagtttggagagttcagaagacaagaaaatgggggaaaatttgcaacttcctagagatttgttaagctgttgtgaccaaaatgctgatagtgatatggacaatrgagtccaggctgataaggtctcacatggagatgaggaayttattgggacctagaggaaaggtcacttttgttatgcattggcaaagaacttggaggcattgttccccctccctagggatctgtagaactttgaacttgagagtgatgtataagggtatctggtggaagaaatttctaagcagcatagcattccagatttggcctgcctgcttgtaatagcctatgcacatatgtgtgagcaaagacatgacctgaaactggaactgatatttaaaggggaaatttaatatccaggacaattcctagtggagctgcaggaacaggacccctgccaagactactaaatcatagagccactggcaatatgcaagctcagcctggaaaagccataagcattcaatgttcacccatgagagcagctatatggattatgttcaccaaagccacggatatgaggctgaagatggcattgtgagtccattgcttgcascagccagtgtgctcagggttcaagatatagagtcaaaggagattattttagagctttaagttttaatgtctgccatgatgagtttcaaccttgtgaggacactgcattcatttcttttggyccatttatttcttttggaatggaaatgtataggaaatgtctctaccactgttgtattaatattttagaagtaaataactttttttaattttacaggtgcacagctataagaacttaccttgagtctcagatgagactttggaatttagagttgatgctggatcaacccaacacattttggacaattgggagaagattattgtcttttgcaatgtgagaagaatgtgagctttggctggctagggacaggatgcaatgatataaatatttatccccagatacctcatgttaaaatctgatccccaatgttggacttagggcctaatgggtggcgtttgggtcttgggggccaatcttttatgaacagagagatactgccctctctcgggagtcaatgaattgttgccctattagtttccaaaagagctagttgttaaaagagtctcgcaccttcctactccctctgttcctctcttaccacgtgacttytgcacataccagctcccctttgccttctgccatgagtggaagcagcctgaggccctcgctaaatgctcaaacatttccagacatcagaatcctgagccaaatgaaccttgtttatataaattagtcagtctcagacatttctttatagcaacacaaaayggaataagacaaccctctcatcatagstatgtgtctgtggcagccagcccccattctcaaggtatccaggatccactcagccaagagtcctttcctcagtattctaaagacactctaatcactcaagagattctaaggtttttaggagaaacsagggacaaaactaaatgtttttgtgataactcatattayccccttttctttgaccacatatttttcatacgaaaaggattataacagtaaagaagcattggcatattatccaagtctcattcggtcattcaaaattaggccagtttatcatcctcttgtatgaatatgtctcccagaatgacatcactcagctttgcagacaccattcaatcttatcaggttccaaaaacaagaatggtctcagggacatacagcttcacccttttaggcatccagtatagttgacctaagagacaacatctcttgctcacaccacttttgaggagataagctaatattgaattttcctcattacataaccctttgatttattcacctaccctcagccactattcctccttctgtccctttatatcagtcttttccagttctagaagtgacattaggtttggctgctgtgctggcctagactgcatgcagcaatagtattctaccatgtcttctcttaatctactcttgatcatagacagtaggttacataggttaggaactagtgcaggctatctgaccaccagtctacgtagctctacttacagttaatcccgactttgccagatgaaatgaaggcacagcgcaatccttgatttgcttgggaattcttacataaaggtataaaaatatagttatggttttttccttagggataattcctgtttctggcagttcgatttgcatccctgttcctggtaccactgcaccctgtgtaaaaaaagaaataagaaatgaagtgtagtcattattccagcatcctccccttaagaagaattgtatgtacagtcataacagcatcaccctgatccatcaggaaaaagagaggaagctacctagtggagtcagtttcgcagctccacccatgttgacagtaagcacattcatgaagatataaaagccagtccttcatgtttatattgcccaacaattatattggcagtttttagacaattagacaaccaatgtttcaactgactatttctttttttttttttttttgagatggagtctcactctgtcgcccaggctggagtgcagtagtatgatctcggctcatgcaacctctgcctcccaggttcaagcaattctactgtctcagcctcccgagtagctggtaatacaggcgcccaccaccacacgcagctaatttttgtattttcagtagagacggggtttcaccatattggccaggatagtctcaaactcctaaactcaggtgatccgcccgcctcggccaccaaaagtgctgggattacaggcatgagccaccgcgcctggtcagccatttcaatattctatcaaagtttcccctgaatagtacatttccctgtgcactgttggctttttaaggctgtaaagtgtgttttcttgtgtaaagaaatgtgactcaacagtccaaattggtgtaatctccatttttctggttcttgtatagcctttgaagcattgacatctacccctggttgatcatagcccaatccagagtcagtgacttccctgtcaagatccattggcagctcctttggggttgctggcattagtctggcttgccagctatgaatgatcaaagcttcccactacagaatctgtcacagagctgcctctgtctgttttcttgaccaaaagtcaaaacagacagtatgagaaatgagataaattaccaaaattgtgaacacaagagagagtatcactaatgaccctttagaagttaaaaaacattataagttaatactctgaaaaacctgaagccaatcagttagaccacttagataaaatggacagatttatacaaagatagaaattgctgaaactgactcaaaaataaatagaaaatctgaagagaactgtacactaagacagtaattttaaaaccttctcacaaagaaatgccaaagcccagatatcttcactggtgaattctatcaaatatttcaaaagctctttcagacaagaagagaggaggcaagactttctagctcatttacagaactgacattaccctaatatcaaagtcagagcaagactgacaagaaaagaataccatagaccagtgtcaccaataaacataaatgaaaacatccttaacaaacattggcagacaatagaaagccacgtaaaaaaggattacattccatgaccaatgggattcatcccaggaatatatggctggattaacaattagaaatcaattaatggaatgcactgtagtaagggaataaaagacataattatctcaaaagatacagaagaaacagttgacaaaaatgttaacaccactcatgttcataagtttcaacaaaataggaatggaggggaccttcctcaccctgataaagggcatctataaaaaacccacaactaaaatcatgcttgctgaagaaagactgaatgcttttctcctaagatggagatcaatgcaaggatgtccaatccaacacttctacttaacattgtactggagattgcagctggtgcaataaggcaaataattaaaagttaaaggcatccagataaaaaggaaaacataaaactctattcacagataacatgaccttgtctgtagaattcacaagcagataaaagcctgctagcactaaaaaatgaatccagaagctcccataggatataaaatcaaattaaaaattattaacatatttctctatacaagcaattaaaatctaaactttcctatcacagtagttacaaaaagagagaaataggaataaatttaggaagacagcagagtttgttgaaaactacaaaacattactgagagaaattaaaggtctaaattcatggagagatgcggttggaaagctcaataatattgttaagatgacaattctccaccaagagatctataggttctgtacaatctctatcaaaaccccagcaggcattttatggaaaattgacaatttaatcctaaaaatgtatgtgaaaatgcagaggatgcagaaaagccaacgcaaatttgaaaaaaaatggaatgtcatataaaactacaataatccagacagtgtgaaagcgagagacacagagattaatgaacagaagtgagaatctagaaagacattcttacatttttttgtcaattgatcttcaatgaagttgcataggtaatatgatgtgacacttatcgccatataaaatataagctcaaacaaattagagacctaaacagctaaaatttgtaagttaaaaccataaaatttctaaaagaaaatataggagaaaatttttgtgacattgagtagttaggcaaaagattcttacataaaatacaaaaaacatgatctacagatgaaaaaaaagtgagagacaaattgggcttagttaaaatttaaaacttaagtactccaaaagacaatattgagaaaatgagaagacaagccgtagattgagagaaaatatttcacaatttatcacaaattacatctgtgatgaagaacatgtatccagaatatgtgaaaagttcttaaactcaatgtaagaagatgagcaactcaactaaaaatgagcaaaacatgctcaactgacttttacaaaagcacaaaagcaattcaatgaaggaaggagagctttyccatcaaatggtgatggaacaactggacaaccacagtggaaaaaaaataacctgagccaaaacytcatgcttcatacaaaaataactcaaartgagtcacaagctttcatgtaaagcacagagttaaaatggcaaacattgagccaggtgtggtatcacaggcctgtactctcagctactcaggaagctgaggtgggaggatcccttgagcccaggagttcaaggccagcctaggcaagaattttttttctaaaataaataataaatttaaatttttaaattacaaaccttttaagaaaaagtcatcagagctaagactggacaaagagttcttagacataacaccaaaagtatgatccataaaagttaataaattggatcttatcaacactaaaaactgttgttctgtgagagacctatgaagagcataaaaagacaagctacagaatgagagaagatatttgcaggcaacatattmtgtaaagactgtattcagaatatatgaagaaattttaaacaacaataaaaatgaaatccaaatacaaaacaggcaatgagcaagacaygaacagacatttcactgaagaggataaatactgggctaataagcagatgaataggtgctcaacatcattatccagtaggaaaatacaaattaaaaccacagtgatgagaatggctgaaatacaaaataaaggtagcaacagatgctggcaaggacgcagaggaactgggacactcttatattgctggtagggatgtattttaaaatggtacagccactctggaaatgagtattgcagttttcttcaaaccgaacatgcaatttaccttatgactagcaattgccctcctaggcacttatttcaaacaagggaatactttatgttcacgaaaatcctgtgcacaaatactcttgcagctttattcatgatacccccaaacaggaattaatacaactgtctttccgtaggtgagtgagatctgctggttgaaatcataactgagtcacacaagtgccctttctcaaggctaccatcctgcttctctgtgcagtaagggtcttatgcatatttcccattttctcacaaagaatattaaagacgtatactcaaggatcaaactttaatccacataaattttttactgctccatcaaagacactcttaaatgggactgcagtttggagccactgcctggttctgctgaggtgctgggtgtgctaccgaccttggcatttgcagcactaatggaaaagtcaacacaatgaaacaggcagatggcatcttggtattactgtgaaaacaagcctgcctccaggactctctgaaggctgctcaggggacacactttcaaaatggcaaagatcaattatggttcctagtgggacacaacccctagcctattcctattcagcactgtcttgctctctattttccctcattcttccaacttataactgtataaattttcaaatgtgcaaagaagctgaaagaacggtgcagtaaaattcaagttaccactctgccgtatttggttaatatctctttatatacataaaaggagagtgtgaaatgatggaccatggagacccagaagggtaagggggttggcagttggtgtataatagaggggtttcttgatgggtacaatgtgcttgtctccagtgctggatgctctgaaggccctgactttaccacaaccaatatagcaatgtagcaaaattgcacttgtgcctcatgaatatatatgaatttaagaaataaaaaataaaataacataacatgtytctttatagatacaggtagacatgtttgtatagcatgtgtgtgaatgtgtgtgtgtgcckgtgtgtgtgtccrcctgtgtgtgtgtktccgtgtagagaggcagcacaaattaagagattaagattttgtgactgagctattccaaagtaacttaaacataaaacacacatggataaatgtgtctgtgacaacaaacctgaatacaaacatgaaataatatgtctataaacacatctctagatagatagcttatgaatgaattccctaccccagctcccttactggttgccctgtgaacacarggagtcagggaacaggacccagctagggtccctcatccttctcttgcatccaggcaggtcctgcatccactctggctgcacagaaggctcccatccctgccttggtctgtttcacaggtgctcccctaactctctctgccaccactgctttatctggatggagctgaggctgccctgaccaagaacagcaccacccatctgtgtccccaagaccaggaagttaggaggaaccacacaacaaggtcaggaactatcccacctccccaatcagtctgaactgatggcgggagatgctgatgcttgctttactcatcctcaatcccagctcacttattcttcattaattcaatccaatctccccagcagtcacttcaccccagaagctgactgacctctactcttcgtaatcaggaaaccacaaagcactctccgtcccctccctgatatcacccttcagctctacatcatcatatgtgggctctaactctgcagggaagatgttgccccacagggtcagcccctgaacactggctgcaaatgtccccccatcccttcccagccctttcggtgttgctgtgaatctgtccctcactgagaactggyggggagatgtgggggaggagggragrtttctttatgctgtgtcaaagcatggagacagacctctccttctctcctgaacctcacactatcccttcccagacacttgaaataaaacgcagaccagaaatgtctatttaagagttaaatatctatagtataaaatatgaagacagagtagaatggggtaatgcaggagagcatgacagagatgacaggacctcaaggtgccaggaaagctggtgctgggccaggaccaaggagccatcagcaggacactcactcataawgctcacctataataatacaattactgcatatgtaatatatcaaaatataataaaataacaaaataacaaaaataatatggcacagctgcaaataccccatatatactaacccttttcattcatccaaccacaagaaataaatgctcgtagtttccccatgtcatagatgaggaaaatgaggcacaaagagagaacatgctggtgaggcctaggcaaggagttgaatccagatcgcctggctgcagagtctagttgccctcagtggagccagcgaacccaggagctgacaccagagactgagatctcagctgtgcactgccctggtggtctcctgtcccaaccaggtgttgacccaggccttgcaggctcacgcgctctggaaaaaagagagaaaccaataaatgctcccctgggtgcagagtgctgctttttattycctgaggagttctccctcctcagtcactcccaaatcagatttaccctttctctgacggaagatgacgtccccacttttttctccctcccatsgcacttttccagcccctgccagtcccctcccgtgactccatcaacatcagcacctgccctgtgtccaccatccattktgcagtgagtgaaaggacccaggactaaggaacaagacccavgaggaaactcagtgccctttcctcctcctctcaagcctgaccagccctgacacagtgagaggcctccccaaagagaggccctggccctgtctccatgtccttccaggtctgggccaagtcacacacagtccttctcttcctgagaccccaggccctcttcacctgcagaggcacctgcataccagggcaggccctgcacrctgtgggttctgccctccaccagcagctcactgttcctcccctcccagctctgagcagacagctcctaacwagagatmcyatcaggaagccctggggctcacaggccctgcatggaaatatgtggctgccatggagtctgcacctgacctgatgctggggacccccttgctcaaggaggcccagcctgccctccccataacctgcatttgggctgtgcttgctcctgcctgtccactcaaccctggaaatgcagctccaccccagggctgctgcttggtgaggctgcaagcccttcctgtcccattcctaacagggattccacccaggccactgccatcgcagctcacaggggatcttcttcgcctgtggagtagggggtttcttcagacccctcatcctgaggctgcctctacgcaccctctgcacctggggattgccactgccacaggcactgtctcccacatggaccctctgagaaacgaagccccaaatttgacttcctgttctattcaacatcctttacaacatcagtattgggggaaatcctattaagattatccagctgaaattatgttgatggacaccaatacttaaagcaggaattttgagaaactaacatgtaattttcatgcctttttctggccaatgtcccagtgacctacgagaaaacctttcctgcctacagggaaccagaactgacaatccctctataggagacaccgcaggtgagagcaggagcaaccacagacctgcactgcccgtgctgtggttgcctcctggacggggccctcttgctgcagggcaggggatgaaccgtcccatctgcccaggcctgagtggccaactaactgtgcaattaggttcaaggatgagtcaccaccacctcactggccagacacacggaagtggagaaatggcagaaagactcgggtttcctggacaccccagactctcactgtcccctgcactgcctctgtctttgcagaaactcaaaactttctgcttgctcttttcctctcccctcaaacaacctgactgtgggggacatgattctgactgtctcttattttaaacttaccaggcagcgactacactaagaacaaaaaaattggctcaggaaaggcaaggtgaggccacagagcacagaacaaagcccaaaaaacagcccactgggtactatgaccctcgggggctggaaaaagtaacacctggacatgggatgaaaacagggaccacagctgccctgacagagggctggtccccactccccaaatagcccagggacatctgcttatcaactggtccatattatctgcaaggaaacacagggagacaggggccatatggtgggaacccagaaaaagcacggtctcgagggacccagaggacgtgacacccctgagacagctcccagatgaggcatatggggagctgcaaagtggacagaggatggccatgtgcactcaggactctccctgttacaaggggacctcaaaggggctgtacacatgggggccctcattctgggcctcgtgggtctttttcttgatgtcctcctgatggctggagaaacaggggagggggatgcagagaggaagggactagaggcaccacctctccttggattcctctccagtttctagccctccctagatcacatctgcctttactatttgctccctctgagatagtgatcatccaggccctcagcaatcagcacgcaattcccaactcacccacctggatgcaacctggtaagcctgagagacagagaccgggatggggacaaagcaggcaccacggccctccctgctgcccactcctcacctgcagcaggaggaggccacagctggatgttcgagggccttggcycagccctggcttgggcaggacttaagggtgtaaaaaataacctacatgtgatggytcattttcaattctatgtgccttagtataggtttaagcaggccacatggtcataaagagataaagaaggaaaatgtactaagccaccatcccccctacttcttgctttccctttcatgcactggccaggcacctatcggttggggccccctcaacgaccccttccccacctcaccaaaaaatgtagtttaggctarcttgcaacatagataattgtaccctttcttatcaactaagtgcagccattagggacataagtcaaatgtttaaagagtcctgagacaatcacaatgcattatgggctgcaacaaaatgcagcaaaaaaaaaaaaaaccctaaggaacatactwgaagtcttaaactaccaataggtgacatccgggaagatcgtaagtccttggtactcagctaatgagcaactgggggagggagttgcgcactagggaataaattgttgaaactctccctggtgtgcctgcattccagacacccaatattgcaaaaccgtcactaacactctcacttttgctgttctctgggtctcagagtccattctttgggtttggatgggtgcgtttgtttctcataatctagttgcctatatggggatctctgtgcttgygtgaagtgagtgagactctgcctgaaaggagaaacacrtaccaattgattcatgtggcccattctatctggatgtcctggctcctcgcagaagccatagacaaacttgaaactgttattcaggacacaatgaaagtgacatgggggtacgggagggtggggtggaaagcgggcaccacagcaaccaggcaacctcatgtgtcttgtggaaggcactgaaagtactgtgggggtcacatcaccatgagagagctgaaggatgtggggtggtgttggggctgtctatcgtctctacgtaatccagcaaactgtccctgagggagcctgatgakgcctaaagaatgaatgagattactctaggtatggccaagtaggagttataattgcagcttttatgttgtctggatatcactggtagagcagattaataaatccttgggcccacagtgtgcagctgcagacttggtgagtgcattcctttccactccaattagaaaggggatatggaatgattcacattcatgtgggatccacaacacatttatttatcatttgcctcagggctattgtaactcctctgcccgctatagtatatagtcttaagactacactagacatactggatatcctataggatattaaatcagctcatttcattgacaatttcatgtttactggggtggatgagcagcaggtagaaactgcactggagtccttggcaaaacaagcacactccagaaggtgaaggtaaaccttacagagcttcaagagtggccactgaagtgaagttttatgggtgaacaagtgccaagtgtttaggggaatgyaggtgtgtcccctccaaggtaaaagacaaactgtttcatcttgcatcctcaccagaaggaaggaagcacactgcctgatgagcctctttgagttctgatgacaccacattccacatttaggtgtgttgctttggcccacactctaggtgacataggaggaggccaccttcatgtggggcccacacaggaaaggaccctgcagcagatccaggccatggtacaagcagccagcatccctcagaccccttggggctggtggtgccagtggtggggaaagatgcaggatggagctgaaccaagcaccagtgggagagtcacaatggagggcctgggattctggagtaagatcatrtcatccacagcagagacatatgccccctgttagaagcaacatttagtgttacttgtmctgatttgatagaatgcttgaccaagagacaccaaacaacaatgtggttccaagtggctgtgtgacccacaaagtcataaattgcacaggcccaacagcattcatcaacaggtgaaaatggtccacctgggttgagcttgaatcccatgttgacacccacagaaaacacccaagtgtgatgtggcactgaacaaccaaacagacaaatggcagttagccagccttcaccatgggtcagcccaggcctggtaggatgggtgcatgaatggagcaaccacagtggcaggcatgaggctatgtatggggccagcagcactgactctcccagccctaccaaggtagatccagctactgccactcctgaatgtcaactcgtcagcatttggagcccatgatgtgccctagtggggcactatttctttcggcgaccagccactaagtaacaagtgactacatttagctacttccatcctggaagggccagaggttcatcttcacagaaataggctcatattccatgggtgggttttcctgtcttgctctgacactcagccagcaccactctccgggtgctgttgacattcctgatctgcaggctaggcggtgctcctagcccattctctgcctgaaggacccatttggcctggaaagttttaatgtttccatggctgtgggttccactaatcctatcaccatctgcaccacccaggagctaccagccacaaggaatgctggacaggtcttctataggcacaactcagtgccagcctggaggaagcactctgagagtgccatctttcagaacatggtatattgtttgaatcagagatgtctctatggtgctgtgttctcaatggaagaacatgtgggtccagaaatcaaaaggtggaagcaggtatggctccatgtccaatctcttagattcacccactaaggtattttgccttttttatctcccaacaatgggctgtgcgggttaggaggtcctggtttccaaaggagggtacccttaaaagtagacaaaagagagcccattgaactacacattactttagtcaccagagaagtttggagagcatgttcccagagaccacatcgtgagaagaggagtgtccttctctccaggcccaggtaataggccctcatccccaggaggaggcatggctgctttcacacaatgagggcagaagtgtgtgtggaaaccagacatccacctgggaaccttctgggtccccttgccccattgtaagtgtgagcagaatcatccagcaatttagcctgagaggatttgatttccaagaacccagacccatctgggcagcaggtttgagtcacactcctgggtaatctcccaaggccctgctcctgtgctctgacatcctcagtagcattggtatggaggccctgcttcccatgggctgttcccagtcagtgatggctcacaccagtgacactaaggcaggacattcctgggagacaggggactcctctgatggccaatggtggctccgggtctcctccatggccttgctcaactctccttagattgcctgtggtctaggaaacatccagtaaaccttctctccttctgtccatcactgggggtcacacttgcatctcggcctgttgcctttcccagggtaacctgactccctcacaatatcgtctgacaggtatgtcccctaataaaatgytgtaactttaaycccatgatggcacttgctttttggaggatttggactacaaaatcattttcatctrcacaccagtgtcctcttattccaatttgtaaaatccttttgtttattcaacttcttctacttgcgttggctccattttgctggtatttgtattatgtttttgagttcgtcaatgtttgttgatttaatcactaaatttgggggtagtttgttatgcggcaatggataactaatgaagccctcttacatttccattattctatacaggttacgtacatctgctttatttccttccattttcataacactggccatacgtagggtttctagtttctcaacgtgtattcttttctttattttagtttcttttcttttttgttccttccctttctccttccttctgtccctccctccctctctttcttctctatttccattcaacctctcgccttccctcctttttactctgctttccttcccttttcttccccttccccttccttcttttcttctttcactccttcttctcttcctccttctttccctcccttcctccattttttcctttttattatgaaaatttcctaacatataaaataaccctatgtgattgtgctataagtaagcattttctgaatctgtatgtcaaaagtacaatgccacggtatatgagaaacaagtaaacaacagaaagttattgacagaatctaaataaaaatgcctgctataattctgcagccaagacagyggctttcaactcaattccttcaactcartgttttcagaacacatcatcaacatcaagtattacrcacttatttcaaaagtttargccaggcgtggtggttcacgcctgtaatcccagcactttgggaggctgaggtgggtggaccacctgaggtcaggagttcaagaccagtctggctaacatggtaaaaccccrttgtcgcaatcggttactatgggatataatgaagggggatgaacacagaaataaagacaaagacaaaaagatctgttctaaaagaaggggtcgggggcttcttgcttctagtgattccttctggcagcaaactcagtttgtcagtttgccaacatcctgctttcatgagaacagtttgctgtttgctcatatagcctccagtggtatactgagttgatcacgaccctcattctttcggcctccaataccccgactctactaaaaatacaaaaattagctgggcgtggtggtgcatgcctgtaatcccaactactcgggaggctgaggcaggagaattgcttgaactgggaggtggaagttgcaatcagccaagatagcaccactgcagttcagcctgggcaacagagcaagacttcgtctcaaaaataaataaataaataaataaataaataaataaataagtttaagttggcacaatcactttggaaatcatattattattatctagtatggttaaaggccatacaacatatcatccaatcatcccactcctaatcatacactctgcgggctttcttgcctatgtgcccaggagacatgcacactaatgtttatggcaagaactggaatcagctacatatatatcaatagaaaactagtgcaattatggtataaccataaaatgtaaaccttcagcagtaaaaacgaatgaatgacagcctcccacaccacagataactcctatatgtaatgtgcatcatgggaaaataaatgcagtaggaatttgctgtactggaagcttaaaaaccatcaaaactaactaatatttggattggggatatatctatacttattacacaaatccttaaagaaactctataatttctttatagatattatgaaaacagcaaggtactggtacaaaaacaggcacatagaccaatggaacagaacagagaactcagaaataagaccacacatctaaataaaggaataataatcacaagactcaggrtggagtctccttttgggggatgtgaatgggmagcagcccagggtagtttacaggttctgtgttttacaacagtgctggctaaagtccaaacaacatatcatccattcccttttaaaatggaacttttaaaataaatgtgtaatayttgatgttgatgatgtgttctgaaaacattgwgttgaaagaattgacttaaattcctaattccttaaayagattttttcaaagtaaaatatgcttggtttttataaaaatgaaagagaaaagaataccaaagttcattgcaagcatccttaacaagaactacttacattggaacaaaaccacacagaattgtaaggagccatgtgacagagaggaccacsakgccatgaaaatggctttggctacaaataggtcatttgatccttggctcactggcatctctgtagattttcatgtatacaatcttcaatctgatgtgcaaggtaattccatcttgcaaaggatttgatgttacattctaccacacataccactgaattaaacttttacagaattggaaatgcacatcwttgatcaaaataaatgaaacaagaaaagagtagaaaggaayaaccagtgayrgaatagcaatatgaatagaaaacacaataggactgcgaaaacaaagaaacaaacaaaaccacttcagaagcacctgatggcatgctatttagaatcatagtggtgtccaaatcacttctatcacatatcattcaatatcacaacaaaagatgttaagtgtattatagaatgctgatcgaatagccagttattgaaaaaactagtttctcaattcgagctaacaatttcgtgatactgcatcaaaccgaagttattggcatgctagatgtgttgactgaagtatgagattcacatctttgtaaatgaaaagcaatctgattaagcaatatttttctaagtgaaagcaagttaattagagaaagaaacaaaggatggctactccagagacagagcagtacttctttttttaagtgtaggcaaatgttttttggaagacgatatttcaataagaaaactggcactaggggcatacttcccctaaatttgagacattttagacaaaacaaagacttattttcaaggcattatttttatagcactaaagtcttggaactatttgatctagttattctatgttctcaactgtgttaactcattgaagagaacattgctgttattaaagatattggcaagaaaaactcagagatactgttgtatctcctttctctgcctcaaactgttttcccctcaacacctaaggctctgtgatgtctcaaacttttagtcattaatttaaaaagtgaagcttatcatagaattagaaaaaaactattttaaaattcatatggatccaaaaaagagctcctatagccagaagaatcctaagcaaaaagaacaaagctggaggcatgaggctacctgacttaaaactatactacaaggctacagtaactgaaacagcaaggtactggtacaaaaacaggcacatagaccaatggaacagaatagagaactcagaaataagaccacacatctaaaaccctgtgatcttcaatgagcccgacaaaaataagcaatgggcaaaggattccctatttaacaaatggtgctgggagaactggctagcaatctgcagaaaattgaaactggactccttccttacaccttgcccaaaaattaacttaagatggattaaagacttaaatgtaaatcccaaaactataaaaaccctggaagaaaatctaggcaataccaatcaggacatagggatgggcaaagattttatgatgaaaatgccaaaagcaactgccacaaaagcaaaaattgacaaatgggatctaattaaacaaaagagcttctgtagagtgaaagaaactattatcagagtgaacagacatcctacagaatgggagaaaatttttgcagtctgtccacctgacaaaggtctcatattcagaagctacaaagaacttaagcaaatttacaccaaaaaaaaagcttcattaaaaagtggacaaaggacctaaacagacacttctcaaaagaagacatacatgtggccaataaacataagaaaaaaagctaaacatcactgatcattagaaaaatgcaaatcaatactacaatgagataccatctcatgccagtcagaatggcaattattaaaagtcaagaaacaacagatgctggcaaggttgcagagaaataggaaggcttttacactgttggtggaaatgtaaattggttcaaccattgtggaagacagtgtggcaattcctcaaagatttagaaccagaaataccatttgacccagcaatcccattaaaggttatatacccaaaggaatataaatcattctattataaaggtatatgcatgtgtatgttcattgcagcactattcacaatagcaaagacatggaatcaacccaaatgcccacmartgaggaactggataaagaaaatatrgtacatatacaccacggaatattatgcaaccataaaaaggaatgagatcaagtcctttgcagagatacgaatgaagctggaagccattatcctcagcaaactcacacaggaacagaaaaccaaacaccgcatgttctcacttataattgggaactgagcaatgagaatacatggaaccagggagaggaaaaacacacaatggggcctgttcggggagggcagtgatggggggatcattaggaaaaatagctaatgaatgccagggttaacacctaggtgatgggttgataggtacagccaaccaccatggcacaygattacctatgtaacaaacctgcacatcctgcacaygtaccctggaacttaaaattaaattaaattaaattaaattaaaagataagcttaaagcattaaagaaaaataattagataaaagaagtctttgatttacaaaatcctgaaacaatagttttaattttgcttttaacatatacgtaagtcctttagtacagctctctttcagaggtgcagcttaattccctctcttaagtgtggcttggacttaatgatgcacttctgatatggcctrtctctgtgttcccacccaaatctcattttgaattgtcatgcgaattctaatccccacatattggcggagggacttcatgggaggtgatcgaatcatggggatgattcccccaagctgtggaagtcagcggttgaacctatttttcctaatgctcccctcagcactgccctcccataataggctccagtgtgtgatgttcctctccctgtgtccatgtgttctcattgctcagctcccagttacaagtgagaacatgtggtgtttggtttcctgttcctgtgttagcttgctgaggataatggcttccagcttcatccatatccctgcaaaggacttgatctcattcctttttatggctgcataatattccatggtgtatatgtaccatataaggggattttccccacttcactctgcatttttctctcctgccaccatgtgaagaatgacatgtttgcttccccttctgccatgattgtaagtttcctggggcagcctcctcagccatgcacaactgtgagtcaactaaacctcttgcctttataaattacccagtctcaggtatttctttatagcagtgtgagaacagactaatacaacttctaactgatagagtaatgttgacataacagtttgtgactctgggtgtagaatgtgaaactcactatggcttccaccttctctctctctgtctctgggatcatgagctcttggggacccagctgctgtgccataagcagccctgcaggaaggtccatgtggctaagaactgaggccccctgggaccagacagcaaggaactaggcttttccaacagccatgtgactaagccatgtttcaygtgaatccctagccccagtgaagccctcagacgatgcagccctaggctgacaactggactgcaaccttgtgagaggccctgagccagaagcactcaggaaaaccgctcctggattcctgaccattagaaactgtgggagatgatgaatatttgytgttttgagctgctaagttttacataatttgttacacaatagtaaataactaatacattttcacaagagaggatgtattattacacrttaatttgcatttgctctaaatttatcatcatcatattactatttttgagacagggtctyrctctgtcacccaggctggagtgcagtggcatgatcaccatgcactgcagtgtcgacctcctgggctcaagggatcctctgatctcagcctcttgagtagctgggactataggcatgaattaacatgcctggctaattttctaatttttttgtagagatgggggtttcaccatgttgcccaggctgatcttgaacttctggagtcaaatctgccttcctctgccttcaacagtgctaggattgcaggcgtgagccaccacacctggtctaaattaactataagatattaaacatgtaacttagttttaaaaggaaaggagaatttccacggctgaagaggatgtattttattactattcacaatgatcactttacttgaacttcaatttccaactgtgtccaaattaaacacaaaaggaagatccagcccttcctgggctgattctatcatggctcccaacaaccagctcctggtcattcaccttcccccagttattcaaccaactctaatgtaggtgctgctgtgaagggatttagcagatataattaagggcctcaattagttgactttaggctgagtttatcctgcttggactgtcctaataaggagagtccttgaaaggactgggttcttcctgagcatagagattcacagtgtgagagggattcagcatgaggggtttcctccactgtgggctttgaaaatgaaggggctgtgtaggaaagaacgctggtgggcaccatgcattaagtgcagccctccctgttctctacagtgacagccagtgaggaacagggacctcagtcttacaactgccagaaactgcattctgccacctctgtataagcctgaaggaggattcaaaatgaaaacacaggtttaggaagaccggaacagagattccatccacatcatgcccagatttctgattaagaaactataaasaacaaatgrgtgttatttggccaggcgtggtagtgcacacctgtatcctaacatttgaggagctgacacaggaggaacacttgcagccaggactttgagaccagctaggataatatagtgagacactcgtctctacatttctytttaattagctgggcatggtggcacttgcctgcagtcctagctactctgaagactgaggtaggagggtcccttgagcccaggaatttgaggctgcagtgagccatgatcatgtgactgcacttcatcctggatgacagagggagactctgtmtctaaaaataaatcaatgaatacaataaatgggtgctgtttaaagccaatgtttgtgacaatttgttacccagtcttataaaattcatacacagactcaaaagactcctggaatgaactgatgaattgatacgcacactagttacataaaataaaatcttttttaactttttyagtgttttacattttataattttctgtgatgcaatttaatacactcataattcattcattcagccaagaaaaaataatttagtccctacaatgaaccaggtatgccctcatatgctcaagtgcctgacattctagaagcttcacaagaatgaggtggagccactggagtgttttaggtggagaaatgacacactctgactcatagtagcaggaccactatagagagaacactcatgtagcaggtcatggaacagtgctagagccacagttcaggagtgagagggtggtggggattaaggggagaagagggcctgagggatgagagggacggagggaagggctggaggagcaggaggtgaggaaaaggagcagaggaaagaattccaaagcagcagaactcttaggtttaaacacattrttttatagattttaatacatccatctacagagcctcgctgggtgttctttgcagttggcctttaatatcttatgtgggtctgcctagaaactaattgttttttatgttaatcaggtttaaaaaatactaagtattcctaaaaaatatacactccactcacatgtggatacttcctaaaaacaggcagtgcgtgagcactagtgaggggcattgtgactgcactgaacacttacaactgtgaggtgaataaagtttgtgctggctcctggttgcaacatatagtaacatagtgtggtactttgtcttgaggagatgtcctggactcacacggaaacttagggctacggaatgaaggtaaatttaaaataaaacaagcgggagtcacagatacaytgtctgggaaagtgaaacttaagagctttgtgagtcctgttgtaakgcttttagatgcatttatataccaacaggccaaagtcacattttttacckattagattcctgatcattcaggggttaccaagrttatgctacccactatagttaataaacaaaaagcaaactggtctctattctatctcatgcactcaggcacaacttttccagatttaagggggaaaaaaaaccctgtctttacacctacaatcccagggcgagctcactctctggcamcaagctccstggggtgatttttcttctagaagagtacaggaggacaggcaaggagtgggaggcagggagtccagttcagggacagggattccgggatgaaaagtgaagggagagggccagggaccttgccgagggtttctccctggtttctcagacagctcctgggccaagactcagggagacactgagacagaacgcttggcacaagagtagcggggtcagggcgaagtcccagggcctcaagcgtggctctcagggtctcaggccccacaggcggtgtatgggttggggaggccccgcgttggggattctctcctccttctcctaacctgtgtcgggtccttcttcctggatactcaccgggcggccccagttctcactcccattaggtgacaggtttttagagaagccaatcagcgtcgccgcggtyctggttctaaagtcctcgctcacccacccggactcattctccccagacgccaaggatggtggtcatggcrccccgaaccctcttcctgctrctctcgggggccctgaccctgaccgagacctgggcgggtgagtgcggggtcaggagggaaacrgcccctgcgcggaggagggaggggccsgccyggcgggggcgcaggacycggcagccgcgccgggaggagggtcgggcgggtctcaaccyctcctcgcccccaggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagtgagtaaccccggcccagggcgcagatcacgaccccccacctccatgccccacggacgccccgggtactcccgagtctccgggtctgggatccaccccgaggccgcgggacccgcccagaccctctacctgggagaaccccmaggcgcctttaccaaaatcccygcgggtgkgtccgggcgagggcgaggctcggtgggcggggctgaccgarggggtggggccaggttctcayaccctccagtggatgattggytgcgacctggkgtccgacggwcgcctcmtccgcgggtatgaacagtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcgcgggtaccaggggcagtggggcgcctccctgatctcctgtagacctctcagcctggcctagcacaaggagaggaggaaaatgggaccaacacyagaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggargactgatcaggggttccctttgaccccacagcagccttggcaccaggacttttcccctcaggccttgttctctgcctcacactcaatgtgtgtgggrgtctgactccagctcctctgagtcccttggcctccactcaggtcagaaccrgaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgasagatgcaaagtgcttgarttttctgactcttcctttcagacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggagtaaggagggagatggaggcatcatgtctgttagggaaagcaggagcctctctgaagacctttaacagggtcggtggtgaggsctgggggtcagagaccctcaccttcacctcctttcccagagcagtcttccctgcccaccatccccatcatgggtatcgttgctggcctggttgtccttgcagctgtagtcactggagctgcggtcgctgctgtgctgtggagraagaagagctcaggtaaggaaggggtgacaagtggggtctgagttttcttgtcccactgggggtttcaagccccaggtagaagtgtgccctgcctggttactgggaagcaccatccacactcatgggcctacccagcctgggccctgtgtgccagcaccttctcttttgtaaagcacctgtgacaatgaaggacagatttattaccttgatgattgtagtgatggggacctgatcccagtaatcacaggtcaggggaaggtccctggctaaggacagaccttaggagggcagttggtcgaggacccacatctgctttccttgtttttcctgatcccgccctgagtctgcagtcacacatttctggaaacttctcgagggtccaagaytaggaggttcctctaggacctcatggccctgccacctttctggcctctcacaggacrttttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgagggvaacagbggacatagctgtgctatgaggtttctttgacttsaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaatggaagacatgagaactttccacagtacacgtgtttcttgtgctgatttgttgcaggagaggagagtagatggggctgcgcccagtgggtgctcaggccaccatgaactttatgtggtcactgctcagctgggtcatctttgctgctccattgtccttggcccttcagtagaaccttgtcccaccaggacctgtgatcacatagacttggatatcacctaggrtggtccctacacktagaagttcctgtgttatcagaagaaaaattttcagacccctacacctcttcccctccttccaggtctctttcaattgtattttccatcttttttttttttttttttttttttttttttttttttttgagatggagtctcactcaggctggagtgcagtggtgcaatctcaactcattgcaacctccacctcccgggttcaagcaattctcctgtctcagcctccctagtaactgggagtacaggcacatgccacaatacccagctaattttttgtatttttagtaaagacgggatttcaccatgttagccaggatggtcttgatctcctgaccttgtgatctgcccgcctctgcctcccaaagtgctgggattacaggtgtaagccaccatgcctggcttccccaaccttcttaaaggaagcagattctgaaacttcccgagaggagaggtcccagagtttttcattgtagtttactttctgttggaactcctcttctgctctctctcctactcttcttcctgccctgagttgtagtaatcctattgctggctccaaaccaaactcatggatttgtaaagcagagtctaatttagattcatatgtggttggataattggagccataagccttgggttatctttcctcaagagacaaatatggttgtgtgctgcagtgtgcaggaggattggtgtgggaggagggagggagggaggacacaaaagcagccctggtgagaaaagcactggtgcatttatatccacatgagataatattgttccacagcggctacaaaatgacatttggcctgagtctacattaataaagatattgcctttagaataggggggcgcactacagtaatcatccattcaagtggcatttgttgtctgctaggtatttgactgtttttgcatttagaaaacatcgttaaagtaaaaacagaaaaatttctggccttgtcgtgtrtacattctagatgcaagcttgtccaacctgcagctctcgggatgcatgtggcccaggacagctttagaatgtgacgatttttttgcttatctgtagtggcagatatcatgaaaattatccatgcattttttttcttttttctatttttttctgctcatcagctgtcattagtgtattttttgtgtggctcaagacaattcttcttcctatgtgacccagggaagccaaaagattggacacctctgcaggcagatgatatagtataagcagagtaggaacagaaaatgcttgagttagaaggtggcaagtgctgtgtggcaggtgatccagagggtgggctgtgggtacagggaggtggctgttgtgctgggtggtcagcatgggccttgttgcaaatgtgaccttggagtaaagatttgagggatgtgaggagttgtctacacggatgtctcagaaagttcttttcaggcagggaaaccttcagtgcagatgcactagggcaggaaattgtctgtgttcctggaaggaggaagaggccagaagtgttgaacagagagaaactgaaatgaagtcagaggtgtgcccagagcaggttgccctggagggtgtgggaaggatgttgacctttgctctgaatgacatggggagttagaggacagttttggaaagtgggacatggtaggacttatcctttgaaagcttctctctggctgctgtgctgagaacagaattgagaggtgggggactagtgaggcagtgggaaaaacggtgggaaaggagtgcagtattccaggatggagacgtcgcttaccttgactggggtgtgagcaggggaaatagtgggaagtgatgggattctggatgaattcacagcacttgctaatggatttatctgtggtgtgagaaagaagaatcaaggacacccacagtattggactgagtgagcagaagggtggagctgctgtcartggagatggggagactctggcaggagcatacagaggagagggcattgcaggcatccagtggaggtgacatctacraggaatgaaggtgaggggcccagatgcctctgcagctacagattcatcatccaatcactatcctacttccaccacccctgtgtctcagagccagagcattgattctcccctgtgctgtctgcacaggtaggtgaaagtcagggaagttatggtctgctgttggttataataagtcacagattattgtgctttctcagataattaaagaaataayaagagaatttgtaactagaacacttactgagaagaccacaataatgcaaagttttttattcatctaaagaaggcaacagaagaaaaatagttgagcaagaaagataatattagaaggcagtaaatgaaaatggacagacttaaacccaaygaggtcaacaatgacattaaacgtaatggactcagacactccaattacaagacaaatagtgcagagggataaaaataaataagtaaataaataaataaccgtaggctatttacaaaagccataatttcagtagaaggtacagaaaagttgaaagtaaaaagatagaaaagaaataccagacaaacattcatgaaagaccacatggagatgccatttagaaaaattacagcacatgagtctcctgagacatagagtacatgtagacagctcacagtgtctttttcctttttttcagagacagggtctgttgcccaggttgaaatgcaatggtgatatcagaccttactgtaacctcaaactcctgggctgaagcaattctcctgcctcagccttctgagtagctaggacgagaagcctgtgccgccacacctggctataatgtctcattttctcatttgctgtggtgtgaacaaggaaacaatatcataccatgtatttgacttgcagcaggtacacaacaaatgtcaggtgaatgaagaaataaaaccacttagtaatccaagccatatccacatttacattttacaggtgaggagcaacatcccagacaagtaaagtaaaataaattgatttacatcatccagagcagaatcgagaacacattccctgtgctaaaggaatcagaactctactaggggtcatagcagatatcatgcaagtcacatatgttaattactagaactggagttgatacattttgagatatactaaaccaagggtttggaaggattaactgaatgcagaaataaaggaagaaaatagatttgtttaaaagatggttagaatctttaaagaaacaacatctttttaaagtggccttatgtggaccaaagcagagatgagctcaaatgtcaggtgggaaaatgcttgactaaatgcagctctagacccaagggagacctaaaaatcctgggacattttcggttgtcacgtggggattggtgggagggggtgagtggggtgctgctggcaaacctcccacaatgcacaggacagaccacaagggattctctgtctcaaattcttaatagggctgctgttgagaaacccgcccgagaggtaagtgctgtaatgtcctcaccatttcacagattaagaaactgaggcaccaggaagaaaagtgtcagtaggaccagagctgaaggttgaatccaggccacctggctgcagggtcttggcttccctggttaagtcagggacccaggagcccaccacaaacaatcccagctgcgcggtgccttcatggtctgtggcgccccctggtgttgacactgggcctrtggccaaatgaggcttgagggaaaaggaaaacgggtttaggtagcgggatctccttcaggctctccagatttcaagccatgacttacactcagaaaaaataatgttcaccttaattatctccccaaccctgtttttcccagttccggccagtaccctccctcgactccatcaacatcagtacctgccagatgcccagcacccaccatgtgaggagtgaaaatgccccaggactaaaggacaagatgacgttccaccccagccatcccgcccctcctagagctctagctctgtgcatttagtgcttaggcttttaacctggggtccgcgaacccactttcccatgacactgcgtgcagaagtgatgttacatgcacacatgacttcattacaggacattggatattaatattcatccgatcaactgggggcccaagataccactcttcccccaacagtttgtgatcctctgaattaaagaaagggcagagattgagggaggccctaactccaaatcttctaccacttctagggaagtgctgaaaagaagtgcaaggtactcaacccgctctgggaatacagcaggaaagcagagtgttcatggatttcgaattccatcaaagaaatacaactttggcaaaatatccaagtcacttttctaagccccaggcagcagctcaaaacaaacaacaccaaaaacaaaacaaaatctcggcccaggtgaaatcattgaagacataaaactttgtgagacctgtatttagagcgaaggacaattcaatttagggctgcagcagaaaacccctacatcatattgggtttttcctcatcatgaagttctcctggagggaccttctcccttcagcagtgcatagtgaggccatttctgtgtaaaaagatagaatctccttggattcctgatgtttacatttactactcacttctttgactttgtagatgccaacttcacattcaacatctttcaattattttctttactttgtctaagcagagaatttaaacttgtttctgaagcagaaaaccagggactggttatttgagctatcrccccactctgtggctctcttatgcaataagcataagagattgtgggccaacagaatttgtagcaagataaacataaacccttcatttcagcctatgtttctgtttgtctggtgatgttccagtcttgctccagtcttaacattttaaaaagtataattttacttaaatttcattttataggaagtcatatatattcatttctgttaggtttctcagtgaaagcctcctcaaaacaactgtgaagtaaagacatgtaaataaattcatggtgctcccatgtattcrtgctcattgcatcttacaaatgtgtcagccccactgcaacagatggtgcatcaacaaatggtgctggaaacctggatatccacatgcaaaagaatgatgctggacaaaatttatgcccttccattacacccttttcaaaaattaagtcagaatgccttaaagaactaatcttaagagttaaacctgtaaaactcttaaaagaaaatactgagggaaagtcttatggtcattagaattggtagtggtttcttggctggtgaccaaaagtacaagcaataaaaggaaaatgacaaataagacttcatcaaaatgtaaaaacttttttgcatcaaaggacgctattaagaggtgaaaagaggctaggcgcagtggctcacgcctgtaatcccagcactttgggaggccaaagtgggtggatcacctgaggtcaggagttcgaaatcagcctggccaacatggcaaaaccctgtctctactaaaaatacaaaaattagccgggcgcagtggtgggcacctgtaatcccagctactcgggaggctgaggcaggagaatcgcttgaacctgggaggcagaggttgcaatgagctgagattgcaccattgcactccagctggggcatcagagagagactctgtctcaaaaaaaaaaaaaaaaaaaaaaaaaaaagtgaaaataaaagaaactgcatagaataagataaaatatttgccaatcacatatctgataaagaattaatatccagactacatacagaactacaacttaacaatagcaaaacaatctcattcaaaaatgggtaaaagacatgaatagacaattctccagagaagatacacagtaaggacataaaaataaggaattccaataaggacatgaaaatatgctcagcttcactagtccaggtgttggtgaggatgtggagaaaatggaatgcttgtgcactgctgctgagagtgaacaacagtgcagccatcatggaaacaggatgacgctttctcaagaaggtaaacatagaatttccatatgaagcaacaattccacttttgggtgtataccccccaaaaattgaaagcaggtatgcacacagataattgtacagtcatgctcatagcagtgctattcccaatagccaaaaggtggacgcaacccaagtgtccatcagaggatgattggaaaaacaaaatgtggtgcatatacacatggaatattaatcagccttaaaagtgaagaatatttggattggatggaaccttgaaaacacgctaaataaaataagccaraaaaaagrcaaatatgatatttcacttatatgaggcacctagaataagcaaattcacaaaaacagaaagtagaatacaggttaccaggggctgarggcaggaacaatgggcagctgtcatttaatgggtacagtctctgttgggatgatgaaaatgttctgaaaatgcatgttggtgtttgtgtaaccaccatcaattgtaaatgtgcttaatgccaatgaattgtacactgaaaaaaattgttagaaggtaaatcgtatagtatgtgtgttttaccacaatttwaaaaatatatatcaacaccaaatccaatcacttytcactcctctgccacctccaccccagaaccatcmtcactaggatagaaaaccggaagggccttccagctgggctgcctgctgwctctcatgcccactgtccatcacccacacaacagagagagcgtgcctttccaatgggaattagrgcatatcctatgaacgctccagctccttcccttcttaggcacaaggaaaccccagtttcccaccatttcctatgcactccttatcacagggtcccctctggccactttggcctcatcccattactctcagcctagctcaytcttctccactcacaccagtttcttgtctactccaccctgtctccaccacctgcccctgytgtgactcccacatgcatgtgctgcccagtgatccacatggctcactcctcacaccattaaggtccctgctyaaatgtcccatggtcaagtgttcagaaatgtcttgtccagtgacctcttctgaaatctatcccctgccattcccaccacygccaccaatcttctaacccaagcatatttttcttaatggcaattatcagtgatactrtgacaggttttatttgtttattgtctgttgatttattaaggttaccaagaaagaaagaaccaatagcataggtacatagatgatagatagataatagatagatagatgatagwtgatagatagakgwtagatgatgatagatagatagatagatagatagatagatagatagacagacagatagatagataggtgatttattgggctaattggctcacacaattatggaggctgagaagtcccatgatagactgtctggaagctggagaactagaaaagccagtagcgtggctcagtccaaagtcaaagccctgaggacccagaatacagaacaggaggataaaggggctcactggtgcaaaagtcagagtccaaagatcatcgaacctggagttttgatgtccaaggcaggagaagaagggtgtcccagccccagttccagagagagagacagagacagagagagacagagagacagagacagagagaaattttacttctatctacctttctgttctatctgggccactaggtgattggactgtggctgcccacagtgagagagcatcttccccaccagtccacccactcacatcccttccagaaaaactctcacagacactggtttaatacttacaatttgagtagtctataatttatttttttgagattgggcttgctggctggagtgcagtgttgttcatggctcactgcagcctgaatcttccaggcttaagcaaccctcccacctcagacacccaagtagctgggactacaggcatgtgccaccaagcccggctaattcttttgaattttttstagagacagggtttctctatgttgcctaggctggtcacaaactcaggggctcaagcaatctgccagcctgagcctcccaaagtgctggaagtacaggcatgagccaccatgtccrtcctgagtgttctatgaatttttaaaatcacaaccatagaagaatcttcatgtacaaacatgcttgtcaaaatattctttaccaaaagacaagatgaaagcacatggatctaaaagaaccctggtgacttctccttgtttgagatgggatgcagcttctagaagtgtgtaaattttatgcagactttatgacatggaaaactactttcataataatacattcaaaaagcaacttcaaaataacccacaaccactctgggaggccaaggtgggtggatcacttgaggtcaggtgttcaaaaccagcctggccaacaagtgtaaccccatctatattaaaaacacaaaattagccaggcgtggtagtgcacatctgtaatcccagctactcgaggggctgaggcagaagactcacttgcatccgagatgcagaggttgcagtgagccgagatcatgccactgcactccagcccctgggggacagagtgagactccatcttaaaaaaaaccccaaaacttatgaatgcaactttctacaatgaaagcatatataaaaatatatacatagaaaacaaaagaatggaagtcagcatcactgcagaagatagctccagggatgaccattcacactgcagtccaggaagtttcaataatatgatagcagtggttctttggaggggaagcctgggtgatatttctttcttctctgcatttttttttctttaaaattcaaccaggtgttgatgtgtgcattttaaattcttstgtaatcaaatacattttcatatttctartgtagaaacatgtatttttaacattcaaaataaaacatttgaagtaaaataacaatgaaaagtggctgaacactgtggtgggcacctgtagtcccagctactcaggaggctgagataggagaatggctcgagctcacgaatttgaggctatggtcacacctgtgaatagtcactgctctccagcctggagaacatagtgagacctcatatttaaaataataataataaaaagaagttcagatctccttccaatctcaacctaaaacaaatttctcatttgaagtccatatggcagaaatgcctactgatggctcctccagagagtaaaaaaaatattgttcctctacaatccatgactcatccttctgttacagtgttcacctgggcaatgaagtcaacactragaatatcatcaatttatggaatactgattatctcttttatagatatataaattataattatgtatatatayattatattataatatatataattaccatcacacctgagagagtgagatggattcttttcttccacagatgaaaatctgagtccctgagaacctagggktttggtatgggttcactgaaaatgttggccttgagaattaggaaacagcttcctgcaggcctgcctggatgtgagccacaccaatggagtctccacaacagcaggaagagcaactgagaaccctggaagcttcacacttgyaatgttccatgtccagcggcattcagttgatggatgggccaagataagaatacagctccttccttcaattgggggtggcagaggggtgaatcagtcagctacacataatgtgtgtggtgtttctacagatatctttaattactctgctgagaactccacctcaaatgtacaaaaactctgtactcactggtaagcaggatcctttttaggaaagcaaaggactttgctgacttaagcaaaacattttctctccaaatgaattatcctgattggataatctcttactcccactgaaattagccccagagttgcatttgagcatttgggtcaaagacagaaagtcattttgagggttgggcctggctgatcttggacaatgttctgaaagagggctttctacttgcagaagaacaaaggtttgctctgggtaggagatgatgtcctgagaagaaaagacagataggcagattctcaagcaaactcaggagtttactatacaaaagattttggaataccttcctcagcctctttttcattgtggtaaaatacacataaacacaaaggataccaccgtaaccatttaaagtgcacaatgcagtgacaattygtatgttcacaatgttatgtaaccatcatcactctctagttccagagtgtttttatcacctcagggggaactctgcacccattaagcagtcaccctccatttccacctgccagcagaccctgtcgycacaaatccacttctttctctatcgacttgcctcttatgaatatttcacaaaaatgggctcataagttacktagcctcctgtgactggcttccttcacttgtcttgttttcaagattcagcaatgttttagcatatrccagtgctttattcattttatgaccaaataatattctattgtaggaaaaaactatatgttgtttctccattcattggtcgatggacattttcttttaaatcaaataggaaaaacaagagaggaattacaaatatatatakgtgtgtgtgtatatatatatgtcttgtagggttgagacaatctcagtcagctttttttaacctgtgaatgtcgtgatttctccatcatttctgaaggagagttttgcagacatacaattcttggttgatagtccttttactttctcagctttaaatttgtcatcccaaygcctcctgaaccccatggtttctgatgaaaatttgtatgttaatcttattgaggatccattgtacctgaaaagttccttctctgttattgctttcaagatggtctgtttgtcattggtgtagactggttgattataacgtctctcagtgtggacttctaaaattcttgctgcttaaaatgtatcaagtttgttggatgagtaaaattatatttttcatcaaatttaggagatttgaagttattattcctccaaatagccattcttctttttctctctcctttctttgaggattcccaaaatgcatatgcttggtgttgtctcacagttttcttaagttctgttcatttttcttcataatttttttttatttctgcacctcaaactggataatttcaattgtcttacctttaagcttgccgattcttcattctgcatagtgaaagttgcttttgtaaaaaagtaaatagtaaatttactctagtaaaatatagtaaaaaatagtaaaattactctagtaaatttttcatttcagttattgcacttttcagctccaaaatttctatttggtttctttttaaactttctrtctttttattgatgttctctatttgagttaagatagttcttctgatttcctttagttttttgcccatagtttcctttagctctgtgaacatatttaagcagtcaattcaaagttgtttgtccagtaagtatgttcaatggcctttctcaggaacagtttctgtcaattcctcttttttcttgagaatgggtcttactgtctagtttaattgcatacctcatttttattttgaatactaacatgtggtgactttgaaaatcatgttttctaaactatttttgtatagactgtattctttattgtgtgtcatcactgaagtctctattctgtaagcttagtggtcaactcatgatttgatagatatttcctgaaacatcttcagccaaaaagaaataagaaaagaaaattcaatctttttatctgggctctctgtgtgttttggggcatgccctcaacactctgctgggcagtttacaatactgctttggccttcatttcctacttgtgcagatattgaaagttagcaagaggtgtgaacacagggcattctcaggtgctttgtgagtctgtgcgacatactggtcatgaaggaggctatacagattcccagggatatggaagcttttcaaaacccatattcccatctcactcacccagtttctcctccaggcttttctgtatgtctattacctttctcatgtaatatatttttgccccaagggggcagctgctggttcagtggcacttaaatggttttagcagatgccctctgcctctgtgacctaagagagttctgagtagggaaaataaatgcaaaccatttattttctttttctttcttttttttctttttttagacaaggtcttgctctgaagcccaagctggagtgcagttgcacgatcctggctcactgtagcctcaacctcctgggcttaagcaatcctcccacctcagcctcttgagtagctgagactacaggcacatgccataatgcccagttaatttttgtattttttgtagaaatggagtttcaccatgttgtctaggctggtctcaaactcctgaactcaagaaatgcacccagctgagcttcccaaagtgctgtgattacaggcatgagtcaccatgcccagcccaatgtaagccatttcttatcatccttcacggagtcacccaacaggaaaaggtagacaaccacaacactttgagaacatggtccactcggctcccactggcattggagcccacactaaggaaccaggctgctgtcttcaagatcactactgacttgaacagggaggaatgggccaagggtaagatatggtgccacaaagctctgctcctgagttccagttgatttttctggacttgctaggttgcaataaacctttgatgatttttcagggttccaatgcagttgattctttatcaacccaatcagaatatctggtggtaggtccaggaattcttgctttaacagctctccgagggaatttttttttttttttttttgatggagttttgctcttgttgcccagggtggagtgcaatggcatgatcccggctaactgcaacmtctgcctcccgggttcaagcgattctccttcctcacctcccgagtagctgggactacaggcgcgagccaccacacccagctaattttgtatatttagtagagactgggattctccatgttgatcagtctggtctcgaactcctgacctcaggtgatccccccacctcggcctcccaaagtgctgggattacaggcatgagccaccatgcccagccaagggatttttttttatagtgatgttttacaagcacattgtctctgtgcagaggtggcccttggagttcctatgccactatgttctctgatgtcactcctcagccacctttgaattgtgcttatgcatcagaattcctgatctgctaagtacttccaggaaactcattcaaatggtaaacatcattaagcacctaccttattctgggtactgtgctctatggagttgagcctcagataaaagaatcaaacttccttggacttcatagaagtcaaaggtgggggtgggaagataaataaagaaattatagcacagcatgttatgtattttacatgacttttttctttgaaagctacattattaatattttatgacagtactgagttacatataccaaagattacaaattaaaatttatgctttctttctctcttttgttcttacatatttctctgttcttgtagatattttgaaattgggtattatggagacagtgcaacagtttcatttatatgataatgttttgttttacctttattcatcaaagagagatttgtcagctgcaaatttctagtttgacattggttttctctcagatctttgatgattatgttgcttctggctgctgtggctgacaggggatagtcagttacattttaaccagttgcttcttagaggatctgtgtttctcctgtggcaaattttaagatatctgtttctctttaacatcttctgttccagtgcagtatgagtaaatgtggatctctttttattcacagtgctatgatactgttaggtatgagttctaaatttctcttaaaataattaacatgtcagtatgttcaattctttgccctctacttttaaacttaacttcctcataaagcaaccttttttgatcacctgttccaccctgactcatcctgattacttgctccagcctgactcattctggttacctgctccaccctgactcattccagtcacctgctccaccctgactcattctgattacctgctccaccctgactcatcctgattacttgycccagcctgactcattccagttacctgcwccaccctgactcattctgatcacctgtttcactctctttaaattagccaatctgaattagtttagcctgtgcggtctaaccctagccaataggggaataacacagcagcaggggccacrtgcatcagggataagaaccccttccccttccttgtccaggggtgygctcaccattgctccatctgtgagggcacacccttgtatagaagtaattgccttgctgagaagaaaaaaagaaaattttatatttgagtgctatttctttgtggcatcragactttatttacaataatacatttccttaatattttaagataacctctttctggaatgcctctttccatttactcacttctcttcttctaggaatttaattagagaagaattaaattaaacctcattcaaccaccatatacactgtggaatccaaaataatggcctcacacatatgtccaagccctaagacgcagaccatttagatatgttactttacacagcaaaagggactttgctgatatgattaagagcatggacctttagatgtggagattattttgtattatttgagtggccccaatctgattgcatgatttctttaacctggagatgactggagaaatatgggtcagatggagtgctgaatttcatctagaataatttcttaatctagtaaaataacatcatctctgttttttattctttaattaagtggcaaaatgcattaaaaggtttaaagtttaaatatccttgcattcttgggctatataccttggtcaagacagtctgtttataacacattggttaatacagtctactaatatttttcttagaattttcacatctaattaattaaaagtgattttcctataataggtaaatagtagaagggggtaagtctcttattttacaaattattcaaataatacatgaaaagaaatggaagactgagactacaactctttgccatccgtaatgaatgaacagatctagccactgaacagcaatgacaattttcatcaccaaagggaaataaccagtattaaactcttccccttgttgaaaaacatgatatagtaccaccaaaactcacggggaaaaaaatctgaatagatgcaaacctctataccaaactacaaatttctagaaaatgcaggtaatagagatgcatattaaaccatagtttggggtgcaatccacaaaatacaaacaacaggaaactctaccagacaatattaatttcaaagggataacctatagaacaaataagaacaaaaaacttatttttaaaggtaaaactaaactatcatttgggatgatgaaaatataaaatagaacaaagaagtgaggaccacaaaagtcaggatgtgattgatttttatttgaaaaaataaaaatttactattgaactgggtcaattgatggggcttctaggtcagctgacaaacttctctctctttctgatggttaaagagtgtttactgttgattaaaggtcaccattttaagattttttttcttttatgtcacctgtgttttatgacaaaaaggcgaacgcagaataaaatgagttatggggcacggttcctgttctgcacaaagcctcctccccatcctcctctctggacactgagcacccagaacaaccggcagccccaggacccctggcagggctgtctcattactgagtgtgcatccagctccacggttcctgttctgcacaaagcctcctccccatcctcctctctggacactgagcacccagaacaaccggcagccccaggacccctggcagggctgtctcattactgagtgtgcatccagctccacggttcctgttctgcacaaagcctcctccccatcctcctctctggacactgagcacccagaacaaccggcagccccaggacccctggcaaggctgtctcattactgagtgtgcatccagctccacggttcctgttctgcacaaagcctcctccccatcctcctctctggacactgagcacccagaacaaccggcagccccaggacccctggcagggctgtctcattactgagtgtgcatccagctccacggttcctgttctgcacaaagcctcctccccatcctcctctctggacactgagcacccagaacaaccggcagccccaggacccctggcaaggctgtctcattactgagtgtgcattcagctccacgtcgctggagacaatgtccacagtttattttttgagtcctggatgaacctgacaggacatagctgaggggaagcctggcccagtctgcaggctttggccatcagtgcagagggaggaggtcctcatctctccactggagcagttacaaccagagcctcctctctgcgtgggagtgaggctcggtccttcccctgaacacggtgacagggatctctccacaggtagagatgacaccattcctcctgtaacatggtccaatctcacgcttgttnnnnnnnnnnnnnnnnnnnntgacaaacttctctctctttctgatggttaaagagtgtttactgttgattaaaggtcaccattttaagattttttttcttttatgtcacctgtgttttatgacaaaaaggcgaacgcagaataaaatgagttatggggcacggttcctgttctgcacaaagcctcctccccatcctcctctctggacactgagcacccagaacaaccggcagccccaggacccctggcagggctgtctcattactgagtgtgcatccagctccacggttcctgttctgcacaaagcctcctccccatcctcctctctggacactgagcacccagaacaaccggcagccccaggacccctggcaaggctgtctcattactgagtgtgcattcagctccacgtcgctggagacaatgtccacagtttatttcttgagtcctggatgaacctgacaggacatagctgaggggaagcctggcccagtctgcaggctttggccatcagtgtagagggaggaggtcctcatctctccactggagcagttacaaccagagcctcctctctgcgtgggagtgaggctcggtccttcccctgaacacggtgacagggatctctccacaggtagagatgacaccattcctcctgtaacatggtccaatctcacgcttgttctgctttacaagaaagttgacccacgctggtgtcccctgaagaaatcacaggcacagaggagggacaggtggatttcagggctgtgcttgatctgggaaaggaagaktgcagaccgccaggtggcgccgctgmactgcttctgcgcccaggaggtgcctgctggggctgagattgaaggtggggagaaggatgtcacagctcatcgcacaggttcccggtaaaaatcctcctgcccagcctagcgggctctcccttaatcaactgtagcgaaaactgtctccttctcacgttcctggaaggtgctttttgacacaagaaagaggatgtgaytgctagggtcatcatgtcattgtttattgtgttgccagtaaagtgaaatcaaaatacacaataaataataaaayaacccatgataagccaatgtttataatgtactaacaccactgagccagtgtttataatgtactgacacactccaagtgtgggcacagckgcagacatgccttgtctcttgggtcaggacacagggtagagtgaaatggraagaaatcccagtcactgcagaaaagggcccccatggaagaggcctggcagggaggccagctgtcccagggccgccatatttagggatgactccccctttctgggcagcactggtttttttaattatttttgcattcacagtagttctgaaattgcaggatgctgagacccagcactggtcagttacaccgtctcttcttcaccattaaatactgtgccaaacagcaccttcatacatttccatcctcttccaggagagaatcaaaacaacaatggacacattgatgcatgcaaaaatactttaaatatgtgctatcagaagtagctactaaaacattaattccactgaaatgagggaggctgtaaaaaagaaaaacattgcataccygtattcacagcaacattactcaccatagccaagacaaggaagcaaacaaagcacccatcaacacatgaatagatgaagaacatgtggtctatgtaggcaatggaatatgattcaaccttaaaaagaaggaaattctgttacatgctgcaacatggatgaacctggagaacaatgctaagtgtaataagccaatcacaaggaaattccaatactgcgcaattcgttatatgcggcgtctaaactcttagaacctgaaagtagaatggcggctgccagtggttaggctggggggattcwtgaggagattttcagcgtagagtttcagttttgcaagatgaaaagttctagagatctgttgcataacaatgtgctacagttcatattatagtactctatacttaaaaattgttacgataccaaattttatataatatrgattttggcgcaatgaaaaaaataattagctctgataccaacttaggaaaagagcacatgaatttattgaaaatatattagcatgtgcttactatgaaaaagagatgcagaaaactgtgagacaaaaagagagayccttgctaccccagctattatccatgaaccagcagaaccagcatctcatgaaactggacagaaaggctcacaggcccagccttgacaggttgatcagtctgcatttgtcaggaccccaggtggctccactgcatgtaaagcaccgccccagatggtggtggagggagatcctaggaaggtgactctgtcccacaggtagaagcctccagtccagatgggagcagccagaagggcccaagagggacatttccaagaaagtaaaattaatagaaagttcaaagtctctaatttcttaacagagtcacagaaatggaacagatatcaaagttaaattaatgagagttatctagaacataaacaaaaacaaaggcaagtattaacttgaggaagaacaaatactacgaagcaagtgaaaagtagtcaagttgacatatgagaagatgagtcacggaaaaaaacaaggagtggctgaattaaacataattactatataaatatactgggaaaaggaaagaacgggaagagtgaaagagaacaagtgatggatgtggtgacgtcgcgttctcccgggcggggccggaggcggtacagatgagggacacattcatggctaacgggaccgctcttctcgttctgcgttctgcttgcggccggtagtctctcctccccgcccatgggcggtggttggaggcaggggtgcggaatccggccgacctcgctgtcctcgccctctaccttgtggcrtcggtggggttggggagatgagttctccgacgcagcaggcacccctgctcatctcctatggctgttgccttttgggcagcccctcttcgcggcggtggggctgtcccgccggcctgtcacgttgcccttccctgggcttgtgaggattggctccgcttggacctttgcggtgctcccggagccctccaggttgtccctccggtgccggaggccaagcggtggtgtccttcctgttcccagcgccccctcctcctgtcgctgctgcagtgcctgtgtgtgggtcctgaggggttttggggaggtagaatatttttatttatttaaataaattaaaaaataagaaaaaaatacaaaaagaaagagaacaagtaatcttaactattgattccaccatcgtgcagtgcaatagtcaatggctgcaactgaaaaatcaagcaatgttaacaaagaaatggtgctttggtgcttagatatgtgaaagtaaagtcaaaagaatcagctgaaacttgaaagtggttgctccctagaaaggcagaaacagagaagagaggactctccctagaaaggcagagaagactcgtttttctcaggaagtcctgcgcaaatatttactctttcaattatgtgcaattgtaacttcgaataaaataaaaacaaaagcttcagttaacatgcaagtttatgcctaatgacaactttgtttaacaatgataaaaggctaaccaaaatataaaaacacttaaacataaaacagcatgtataaatgtgtatgtgacatcaaccctgaatacaaacttgaaagaatatgtctataaacaactctggatagatagcccatgaatgaattccccactccagcatctttactggttgtcctgtgagcctaggcagggaggggaccaggacctgactagggtccctaatactcttgcttccaggcaagtcctgcatgcactcctgctgcaccaagggctcccatccctgccttggtctgtttcataggtgctcccctaactctctgccaccactgccttacctgggtggagctgaggccgccctgaccaagaagagcaccacccatctatgtgccccaaaaccagaaagtcaaaagaaaccttgcaacagggtcaggaactatcccacctccccacctccgaatcagtctgaactgatggcgggagatgctgatgcttgctttactcatcctcattccctgtgcatttatttttcactaattcagtccacatctcctagaagcagactgacccctacccttcataatcaggaaaccccagagcactttttatcccctccagaatataacacttcagctctgcatcatcacatgagggctccaactctgtagggcaggtgtactctcacagcttcaggccctgaacatttgcttcagatgtccccccatcccttyccagacctgtctgtgttgctctgaatctgtccttccctgagaactggcggggagatatcagggaggaggggagatttctttgtgctatgtcaatgcatctagacagagctctcattctcccttgaacctcaactctatccgttcccagacacttgaaataaaacacagaccagaaatgtctatttaraagctaaatatctatagtataaaatatgaagacagagtagaatggggtaatgcaggagagtgtgacagggcraggggacctcaacgtgccaggaaagttggtccttggctcccctggaggagccgtcaccaggacactcactcataaagctcacctgtgataatacaactacatgacattaatgtattaaaatataataaaatcataacaaaataacaaaaataatatggcacagctgcaaacacctcatatatactaacacttttcatccacccaaccacaagaaataaatgttgttacattccctatttcatagatgagaaagctgagccagcaagagaaaaagtgctggtgagacctgggcagggcgttcaatccaggccgcctggctgcagagtgtaggtgccctcagtagagccagtggacctgggagctgagagcagagactgaaatcccagctgtgcactgccctggtgttctgtctgagtcaggtgttgatctgggccttgcaggctcatgtgctctggagaaaagagaaaaaatagtaagtgctcccctgggtgcacagtgctgctttttactccctgacgacttctccctcctcagtcagtcccaaatcagattcaccctttctccgagggaagatgatgtctgcacttttttctccctcccatggcacttttcccagcccctgccagtcccctcccgtgactccatcaacatcagcccctgccctgtgcccaccagccaccatgcaaggaggaaaagagccccaggaccaaaggacaagacctgggaaaaacccagtgccctcccctcctctcaagcctggccagctctgacagcaggaggactccccaaagagaggctctggccctggctccatgtccttccaggactgggctgggtcacackcacagtccttctcttcctcagtccccagtcccacctcacctgtagagacacctgcacacaaaggcaggccctaaacactgtggttctgccctccacctgcagctcagtgctcctccacttccagccctgagcaggcagctcctaactgggaagcccattaagaatcccatcagcacggcaggcccagcatggaaacatgtagctgctatggggtctgcagctgacctgaccctgggaacccccttgctcaaggaggccctgcctaccctgacccccaggcccatgacctgcacttgggccaagcttgctccagcctggtccactcatccctggaagcacagcttctccccagggctgctgcttggggaggctgaaaggcctttctctcctgttcctagcagggattcctagcagggattccacccaagccactgccctcacagcccataggggatcttcttctccctgtggagtagaaagtttcttgagacccctcagcctgaggctgcctctgcccaccctttgcacttggggattgccactgccacagccactgtctcccacatggaccgtcctggagagggagctccacatttgagttcctgtttcatttgatataggttacaacattagtattggtggaaatccttttaagacccagctgaaactacgaacatctttattggacatcagcatttaaagcaggaattttgagaaattagcacataactttcacacccctttcctggccagtgccccagtaacctacaaggcaaccgttcccgcccacggggaaccagaactgacaatccctcttcaggagacaccacaggtgagagcaggagcgaccacagacctgcactgcccctgctgtgggtgcctcctggacagggccctcttgctgcagggcaggggatgaaccatcccatctgcccaggcctgaggggccaactgacagtgcaattaggttcaaggatgagaaatcaccaccccctgccagatacacagaagtggggaaatggcagaaagactcgggtttcccggacactccaggctctcagtgtctcctgcactgtctctgtctttgcagaaacacaaaacttgctgcttgctcttttcccctcccttcaaacaacctgactgtgcgggaaatcatcctgaccatctctcactccaaactcatcaggtagtgcttattctttcaaaggtattttgtgactgtgcaagcaaatataaatgtatatgtatatgttctttctccctttgcacacaaattttagcaaactatatatgcttttctgtaccttgctgttttcccttaccattgtatcatggagaccatcccatgaagaaatatcaagaactacactatgtctttcttttttttgttcaaaaatttcttggcaatccattgtataggcatgcattttttaaaatagagattaccctttttgaatgcaatgctttttaaccagctccctactgataggcatttggattatttctttcagagaacaatttgacatcatgtagcatcatatgggaagggtgcagtgaccccactcctacatgcatatcctaggggagctcacatattcttggaaccagaaagcaatgtcccagcatgttcattgcagcagtgtctttaataaagactatgtagaggtcaatgaagtggggaagagataaattgtagcatattcctcccatggaatactatctagcaatgaaaacaaatgaactatttgtgtgaacattgatccatctcatagaccatgttaacggaaaaagcaagcaaatgcataacaaaatcagcaagaaacaatttataaaaagtctaaaagtaaagccaggcaagggggcctatacccataatcctagcatcttgggaggccaaggtgggcagattgcttgaccccaggcgttccagacaagtctgggaaacatgataaatccctttctctacaaaaaatacagaaattagccaggcatggtggcgcgaacctctagtcccagctactcaagaggcctagaagggaggaattgcttaagcctggcaggtagaggctgaagtgagttgtgtttgtgccactgcatttcagtccaggtgacaaagtgaaaccatgttaaaaacaaacaaacaaacaaacaaaaacaagagactttttaaaacttagtaagaatataggggcatacagcaaattcaagacacacattcaccaacagttcttgctttgctcagtacagtattgactgaaacacatgcataacagaactgtggaaaatcagggctatctacacgtgtttctgttattttctatgtatactacatacagccaataatattaaaatgtcacaaattgacaaacctgggtggcagcttcacaaagatttcttataattctctattttttcttctagctagaactaccttataataaaatttgtgaagtgaatccacagaaattgagcaaaataaaaaggagtcgttgagtgtgaggaaagctacagagaagtaaagacaggtggagacatgacaatactgagcatgttagtgaccttcacagtaactgacttcctggaggagtgtgagcttaagccagaatgaagtgatagaccgtgaaagacggatgaaggagtagsagcttctggaggcaaacatggtrtgtggttggctggattgggatatgtggagggactctgaacattctgctttaggtccagcactagagaaagaggactcatctttatttagcaccttccacaatctgtagagaaatctgaaacattgcaaaagaagatatatgaatggccagttcagggaaaaatgcaaagtaaaaccacagtgagaaaccactaagcaaccattagaatggctaaaattaaaatgattaataactataaatgctagcaaggatgtggaacaatctgtactctcctccattgcctatargaatataaaacatccattttgaaaatcaatttcatatcatctaataaagttaaacaagctagtcctctacagctaccatttccactcctaggtatatactcaagagaaatgaagattttgtcgataatccctgcataaaaatgttcatagtttctttatttataatagtaaaaaacaagaaataactgccaatgtacaaaaatcatgattcagtcatacaatggaatattatcagcaatgaaaatgaaagaactactgatacgtgcaccaacatgggttgatcacataggtattacaacaagcgcaaaaagccagatacaagggaggccatatgggatgagtagatttgtatgaagttttaaaacaggaagaactgtgctatcctgatagccgtcagatcaatggctgctggaggcatggaagctgagttgaagggagaaaaagggatctttgtgtacattgatagtggcaagagtaatatgctgcatttgtcaaaattcattgataaatttgatgaagatctgattattttggtatatgtacattttataagtttaaaaatcttataataaaaatcataatgttgctgataaaaataataattaaaaatattagcaacaaaatccaacagtataccaaaagaataatacaccatgatatgtccatatatggcaaacacagagctaacattatactgaatagggacaagcttatagcctctcctccaagatctggaagaaggctaagactcccactttcatcacttttattctacacagcactagaagtcctagcaagagcaatcagccaagaggaggaaataaagggcatccaaattggaaaggagaaagccaacttagccttattcgcaaatggcataatcttttactcagaaaaaactaaatattggccgggtgcggtggctcacgcctgtaatcccagcactttgggaggccaaggcaggcggatcacgaggtcaggagatcgagaccatcctggctaaaattgtgaaaccccgtctctactaaaaatacaaaaaaaaaaaaaaaaaaaaaaaattagctggtcgtggtggcgggcgcctgtagtcccagctactcaggaggctgagacaggagaatggcgtgaacccaggaggtggagcttgcagtgagccgagatcgcgccactgcactccagcctggatgacagagcgagactccatctcaaaaaaagaaaaaaaaagaaagaaagaaaaatctaaatattccaccaaataaatggtgagaactaataagcaaattcagtaaaattacaggatacaaaatcaatgtgcaaactttcagagcatttatatatacaagcaccatataatctgaagaagaaatcaagaaagcaaaactatttacaaatcataaagaggataaaataactaagaatcaatttaccccaggaagtaaaacaaaaactataaggcactgatgaaggaaattgaagagtacacaaaactggaagagccaggcgcagtggcacatacctgtaatcctggcactttgggatgatgagacaggagaattgtttgagcctgggagttcaagactagcctgggaaacatagtgagaccttgtctctaagaaaaaaaataaaacacayaaattgggagaattaatattgttaaatattaattttaaaaatgagacacataaatttcatgcacataaattgggagaatattgttaaaatgttcatactacccaaagcaatttacagattcaattcaatccctatcaaaataccaatatcattattcacagaaatagaaaaaatcgtgaaattcatatggaatcgtaaaatatcccaaatagccaaagcaatcatgagcaagaagaacaaagctagaggcatcacacttactgaattcaggatacaatataaagttatagtaaccaaatcagcatggtgctagcataaaaacagacacatagactaatggaatacaaaagagaactcacaataaatccatgcattgatagccaactcatttttggtaaaggaactgagaatatacaatggagaaagaacaaaagcaacaatggagaataaatggagctgggaaaatgctaccagatgcagaagaataccactagaaccgtctctcaccatatacagaaatcaactcaaaatggattaaagatttaaatgtaagtcccaaaactataaaactactagaagaatgcttacaggaaacactccagacatgggtctaggcaaagactttatggctaagacctcaaaagcacaggcaacaaaaataaaatagacaagtgggactatattaaactaaatagcttcagcacagcaaatgaaacaatcaacagaatgaagaggcaacctgttgaatagagaaaatatttgctatgtattcatccagcaaggaactaacatctagaatatacaaggaacttaaaaaactcagcagtaaaaacacaaataatccaattaaaaaatggacaaagtgtctgaatagatgtttctcaaaaggagacatacaaatggtcaacaggtatacgaaaaacactcaaccttattaaatatcaggaaaatgcaaatcaaaactataatgaaatatcatcttatcctatttagaatggctactaataggaaataaaaaataatggatagtggtgagcatgtggagaaatgggaactgttgtacactcttgggaaagtaagtacagcaattatggaaatcagtataatgatttctcaaaaaacaaaaaatagaactactattggatccaacaactccactcatgggtatttatataaaggaaaagaaatcaatatatcaaaagactacctgcacccccaggtttattgaagcactattcacagtagcgaagttatkaaatcaatgggtgaattcatcaatgggtgaatgaataaatggtggtatatatatacacaatggaatgcaattcagccataaaaaagaatgaaatcctgtcagttgcagaaacatggatgtaaccaaaggtcattacgttaggtgaaataagccaagcaaggaaagacaaataccacatgttgtcactaatatgtgcgagccaaaaaggttaatcttagggaggtagagagagtagaawgacagttcccagaaactgggaagaatgtaggggtgggaaaatatagagatgcaggttaatggatgcaaatgtccaattatataragaaaataagttctaatgtttgatagcacagcagactgactaaagttaacaaaaatgtatatttcaaaatagctataagagtggatttggctgggcrtggtggctcatgcctgtgatcccagcactttgggaggccgaggagggtggatcaygaggtcaggagatcgagaccatcctggctaacatggtgaaaccccgtctctactaaaaatacaaaaaaaaaaaaaaaaattagccgggcgtggtggtgggtgcctgtagtcccagctactcgggaggctgaggcaggagaatggtgtgaacccgggaggcgaagcttgcagtgagccgagatcgtgccactgcactccagtctgggtgatggtgtgagactccatctcaaaaaacaaaacaaaacaaaaaagagtgaatttaaaatgttctcaacagaaagaaatgataaatgcttgaggtcatggataccctaaatatcttgactgatacacacattctatgcatgtatcaaaatgtcacatgtatccyataaatatgtacaaatattatgtaccaattttaaaaaatttaaaaaataaacaacacaatatggggcatttaaaaaggtacaaaaattatgagcatgataaaaatttggcaaatattttcctttttattaagatctttttcattccataagtttaaggagaataaagcccataaagcatcagaagaagttgctctcctgaaagagactcttctgctcagttaaaaagacagaaacagaatcactggagtgagtaggactttggagaactgcacagcaccatgtcttagtgtctgggattacacagacttagggaggaggcctcaccttccgggaagaactaaactttggttctctttcttgttttttctattgcaagaccaaaattttagaaaaccaagagaaagatttcagccaaagggttgtactgtctattactctcttttattttttagaacatccattgtcaaagacgatccagactgttacaagaggaattgtgttcctacgccaccaaaatccacatgttgaagccctatgttgagaaggcagaagaagtggccatctacaagcaaaggaaagaggcctcagaagagatcaaccctgcagcaccttgaccttgcacctgtggcctctggaactgtgagacaacacatatttattatttaagtcacccagcctttggtactttgttatggcagccctagcaaattaaaacaggaatattaccttttctaccttgtcctatgtatgaacatgagatttttttaggagtatgaattacctgagatttcaaaagatagagtgaggcaattgaaaatagatgatatagggtcatttccaagcctctgagtgtcccctggccaccacagaaaaatgaagatgttcccattccctttcagtttcacacaaagcaaaagttgtagacctaaactgacatagaatcgccaactgcattaatttatttgagataatgagggagctagttttgcccaaatttcacagaaagacgatgaacaagtagtaagctaaagaggcttcttttgcaggggattgcaggtattatatgtttttctcctacttttaagatacattttcctaaaaagttttgtctaggagtaaatgtcatcactttgctttttttcctcccaattgaatcacttgttcctccctgcatttcagtaatgttgctagcatggaggtgtttgtccatgattcacagatgattcaaagagcagagagcttctcctgaggtcacacagcacgtaagcggtggaacaatggcaggcacatgactctctaggcccctagtccagttttctgggttctatgagaattgtagcccttggtttctgttacatgtggttctcttttgagccagagaaggaggacgcacagtgagaagaaagtgccagagccccaagtcctggcttagatttactgggctggggcatggagagagaggctgccactgattctcttaactccagcttctattaccagtcactaagctgaaagcaggaaagtttatcttctgcacttggtccatcagaactaagatggcagaaagccccactatctaccacggaaaagacaagggtccctcttaccttgaaccatgacccagctttctaactacatatgtttttctgcacatgtagctatttttcttctcatcaagctccagtactcacagtgcaaacacaggagatactgagcctgatgctctgatggaagctctgagttgagattttattttatacttaggtgcctctgagtcattagagttttttgcctgactccactctggccccatttcaatcaaggtctatatgctctgggacctctccaggttctcatcagaaatgaaaaaaaaaaaaaaaaaaagccatgtccagctcctgggtcctccctgatagcagtgagaggcagctcctaatgggagagagccttggggtgaccaaggcctcacagacttcattattcctggaccacatggctccagcctcctgatcacaatggatcagtggtcttagattccgctccaatatttgaagttttttgttcttcggcctcggcaaatgctctctggttgagatgaagggaaaagacacagagacgcaaaagctgtgactgcatggaactctgtccaaggtacctcccggtgttctcttacttatgttggccatgtcctcatgaatttagtgaaatgggcatgttgtctctgagtggaagtgaggggacactactgggcagagctccatcgaagggtggctggtgtcctctataccatttatctacacatgttggggtttttctagcatgaaatgtcccagaggcagccaaacccgaagcttggctcctccaaggaatgagtgtgagtatcatagccctggccaatgagcactgaactctagagagaccaagagaccttctaaatattgggacactttagttctgaatcccagaagttggcttcttgcctgggaggcaggtgtcactgcatctgatccaaaaaagcagccccatagctcaagatgctcttctggatttctgcctcttcctggttcctggccaagcaaatcttcactgctttgctagcccatctataaattcaaccagacttttcaaatatgtattttcctcccatttttccagttgtactcaatgggagaagtggtccaaatgacctaatcagcaattgctggaaaccaaagtaacagtatacaattctatgtgttaatatcatataccaagagagaaaatgtatagatatcagtagtagccatttaagcactgtaataatatctatctatatcccatgagtataatatatataaataaatgataacaagaaaataatctttatgtgtaatacatgactatgactctgacagacaaacctgagagcatagtacgacacttatcaccttcactcatgagccagatagtgtgaaatgagaagcagagatttgaaatgtgttgcaaaactctctcaaagaaagtagagtaatatttttcgtgagcaaatcaaagcaatctcctcacaaatcacattggacttataatgtgtgggatgtgtctttattaaaatggaggtaatcctaggtatgtggtcttttttacatgaaccgtactgtcactggctcactagctgtcacttcaccaacaatcattccatttaataaaagggagatccccccatgggccagcatttcccaggtggaggcctcttgcaggcataatcttccaacagagaatttccctgggaacctagaaagaagagaagaggctcaagcaaaaaggatgaaagaaatagcaacaacggcggggcatggtggctcacacctgtaatcccagcactttgggaggccgaagagggtggatcacctgaggtcaggagttcaagaccagactgcccaacatggggaaactccgtttctactaaaaatacaaaaaattagctgggcgtagtagcgggcgcctgtaatctcagctactctggaggctgaggcaggagaatcgcttgaactcaggaggtggaggttgcagtgagccgagatggtgccactgcactccagcatgggcaacgagagcaaaactccatctaaaaaaaaaaaaaaaaaaaaccaacagcgataatatcatacactgtcatggtgctatgtgttaatctgtgtccttagcactttcaaaatatgaattcatttaattgtcackatacawctatggggtgtgcctgctaattttccgttttcaggtgatacaataggaaagaaggtcgcctacaagtcgtggtggagctgggcttgcacgcagacaatcctgccccagggccatgctcacatctctgcactatccaraatgtgagggtgggtggagagtccagctcagggagagtgattggagagacagaataataagaagagtgggcagactggatcactctgatggttctggggcttctcttccaggagagaagaagacaaaaattatgtcaccatcaaggaaagtatccaaartctctggcttaaacctgggcrtctccagctctgggacaggtggctgggcagggaagacaaactaagscaagggcccagctcggaagagtttcctttcctgagaattctgcaggagtttccctgacctcatggccacctctcatactttgctcttgttttttccccagggccgatgagggcgtcgtatctggtttccagtggggtctaaagacgccatcasagtgagtggagattgggcttcataaagtgggagatctccaggatccttcctggaatccaagattcccagagaagccggatcccgcgtcccggaacccaactcctgctgctctatgagccctgaccttggggagacctgggctagtgaggagaggatcaagatgaactgggctggggaggcaggaggtaaagggcggcctggagagctcagcagctcctcccacggctcttctgccccggtctggggtctgcagactcctcaggtcatatctccaagtacgccgccccacgccaccctcccgtggtccctgtccctctgtcccctccccagctccccctacaccgtaagaagctcccaggtaagcggctccagggccgggcggtaggcaggagggagcccgggaggctgggtccccgcggggaggcggagagagcgcgtcagggagacagggagcgggcggggtccctctccagccctcaaggtgccggttcccggggcccaggctcgcactcccgggtacttggaggccaggggagagggaggactgtggcaggtgaggcaaggagctgtctgagccgctcagcagcctccaggagtcagctctctccaggcctgtcttcactccagtgcctggtcctgcccaggcccccactcccactctgctctcaacctggccccagacaggatcccaaacaactcctgttcctaatgtgaaaaatgtttctgccgctttaggcagaacttgctttagagcactggcgcagacttccgcaggtcttgtgtctgaatttcttggcactgtgtcttttctcacttattcttctgcaaggaaggaattatatcactggttggatgagacaattggctcagatgggttcattgagcactcacccactgggmaagtgtctgtcggggccagctctgggccagatgtgcccaaggctctatagctagttggtggaaaggcctggagggttcatattcaagtccacctgacttgaaaactcatattgaccttacttaagtactgattccccctttataatccatgccataaacttcattgtcttattttaagaaattgccacagcagcctttagcaaccaccctcttgaacagccggcagtcatcaacattgaggcaagaccctgcccagcaaaaagattaaaattagctgaagcctcagacgaccgttagcattttttagcaatagagtaattttaaattaaggtatgtacatagttctttcatacataatgctattgtatacttaataggctacagtagagtgtgaatataacttttatatgtactggaaaaacaaaaatttgtgtgacttgtttgttgccatggtctgaaaccaaatctgcagtatctctgaggtacgtctgtagtttccctttccctcttttgaacttgtttcttgtccttgtctggtcctgcaagctgtatgagtttgccttctctggtaggtctggggacattgtatcccttataaccttggttcctggcatatgacactggtaccaagctctgttggactagtgaggctcccyacacacctcctgaactagagcaaaagctctgtgcacacaccgtgcatgtgtgagcctgtgaggagacggtgccttcctgcaggctgttctgaaggggtgttctgttgtgactggaggaaatagccatgggcccctgggcagaagtggctcagaatggaatggatggccccagttttgatcatctgggaacaggaagattctcagataaaaacccatgttttagaagacaaaactgcccaagagtggacagcagctaaccagtaagctatctgggatatcactgtacactgggagggaagatggcctctgccatggtgtagggtgcctgacccagacaaggaggccttcctaggggtcagtgcttctgaagcacctttaaatgaggacaaatacctcatgttcatgattagccgacttgtgcccactcagtggaaaaagaacccagaattttgcaaaattttcagagagagggattcccctcttgtctcttagtgctagggttatgcatgactcgtgcttgaattacagtgtgtacwcagctgaaagtcttaattattagaatataagaggcccaaactactgctgttacagatatgtaaaactacacagtataagtttaaacaacccacaaccaattaacagtgaagatarattaacaacctttgtaaatttaaaacaagattggcaaccctttagaaaaaaaatgagactkttgcaaracaatctaaatgatacactaataacaaacsttcatgaaaatgacatttcaaccatctgaatttctgctttaagttataaactccaaaatgaactaactcccaataatttacagtagggagctctaagccacaaataaaggtgtcaggacagacctgagacctggagtgagcacatccctcagggtcatragtcaatcctgtaagacccytcctccctcagacactccatccagtcatcaggaggtcaagaaaagttccccacagcactaagacccaaccacctcactgtcctcacctccatggacagagcccaggtgaaagccacccctgctcctcctcccgcatcycccacaggctcagcaccatcgtcggcctggagtgcacctggactgagctcatcatgctctgtccctgtttgtgtcagtcacactgggtcccccacatactctgcacttgcatccccacaaggctctgcacacctctattctgtctccccgacctccccagccacagaaatcttcccagtgcaccccctggatttctcagtccacatcagcaaaacctcctcagcctctctcaggatgttcctgcatctcrcagctccagcagcaacctgggtytccctgaggacatgaccccctccgaagtcctcccacatgggggagtttccccagggacttgtacccctgggttcagaggtgaggtggggtccttgctcctcattgtggttctcagaactttctgcctccctcctccctaaaacccctaggctgtcatcagattagagccccatttgcctcactgtaaccattccctgtgggccccaggctgttcttctcaatcctgagtcttgtagctcctggttcactgtcaccctctccagcattgctgtctccttgactcttggtgacttcaacatacgcagatgtggtgggctgagtaatggtccccaaagatgtccagtcttaatcgttggaacctgtgaacaggttgcattgcgtggcaaaagggatattactcatgtaatgaagattaaggaccttaaaatagggagattctgctggactctctgtgtgggcccaatcaaatcacaagagccattaaaagcagagagcctgccctggttggagtcagattctgcagaggaggaaggcagaggagaagctggagaggggaggtcagaagttccaagcaggaggattgaatgtgccttaggcaccgtgtgtgagtatctgagagaaggctctaggagctaagggtggctcttaacaaggaagtggaaacctcttttctatctgcaaggaagtgaattcaggcaagaacctgaatgagcttggaagtggattcttccccagagtctatggaaaggaatgcagaccttcccgtatgttgatcttagccccatgagactgggtggacttgcaatccacacgactgtgccatgatacataggtgctgtttaaagccatttggtttgtggtaatttttatggcagcaatagacacccacacagcagagaagatgccctcgcttcctggcctctcagatcctggaactcctctcctccatgatcttctcctgtctgcctgaatctcatgcccttgttatcccctaggcctcatcatggctaagaaccccagcccttccatactctctatctcacacttcccactctctgaccatctttccactcatccccttgcaaggtggccacaggctctgaggacacagatactatcattttatcatatgctgtgatgtaatatcagtggaccactcattgcatatgtgcttgctttccacgcttggagtctaccctgtagtacatcaattccaacaatcgttccaccctcctgggattcccaatccagtgatcctgccatctactcactgtccctcaccctgggtgtcctgtcctccctcctcacccattttgaattctatggtaaataatttccatccctcccttccctctcccttgaattgtcacactcacctggcaaaactacacagctggtgggttccacctctgcctatgctgagcctgcccccatgagctgcaggaggctggagagcagcacacagtacgctgactggtctcttaaaatttaggattccaaaccacataggaagtccctaccatggccagcaatcaccctctccctgcatggctcaccctcagcctcctcctggcctgggtgactcttacacactttttctttgtgctcacacatccaacctgccttccccattcttacttcagctgatgaccttgcttcccacttcactgagaaaactgaacacattagaagacaacttcacagattccaccactgtctgctcatgcatttgcagctgcaccacatgtcaggcgttttaccatgtgagggactgttgtgggttaacccttctgctcccagccagagccagaccctcttctggtgccccaattgccaycccttatcatctacttaaaggtgtcagttcatcaattaataccatttttatctttatcgtcaacctttttcctctctccccactggatcattgtggcagtcatgagaatgcacatcccagcccctcatctagaagaagcagaattgatgatggcyccagctcttgaagtctgaaatctattgccacatttgctctgagactatgcccacccctggctttttccagccaatgattgaggaaagtagggcagaaactaaggcaggacattcctcttctgaaggctgactgaagctccagggctccctgccacccttactgaacttcccttagcctgcacasggtctaggatgcttccagctgaccttcctgcactctctacatcactgaggctcagagttgctttgtggtccagtggctttcccagcattttctgtctcatgaatttctctcacaagtatttcccctaataaatccttacatgtttactactgtattggggtccgcttctcaggggaccctaactaacacaagtggcatgaagggtgatccatgaaaacaggcaaaaatgggaatttgaaataagcttcccactgcctggcaggccaagaggatgccacccgggttggtggcagacacagaaagtccatggcacaaggtgcagctgagcagctgggggtctcaccagtgctgagctgagaagttgccttggttagggagtgctatggcacatgcagtgatagaatgccctgcataataaggacagggttggaagaaacctacaaagacagtggctttggctagttacttctcagctgcatcgatgctgtgtaaaaagataatgagaatctgyggattgttgacagctatgactggctacatttgacaccctcggcagtgtctcatggacaggtcttyatctcctgtagcaaaagggcagatagcaaggaatgttagctctacatcactatgagggccacagtgctccagagatgtttgacactcagccaaggcaggcctgttacaggaaagtcagggctttggtggggaaacctgagattctgcaaactggaacaggattatgcgatgcgtgccctccaggatcttctgggcatgcagaggaggctcacccttctctagtaatggttcccactttcactgctggaagatgctacacaatcctcacccctatgatgccgcgvgaatcccactcaggaggtttgcaggaactagccagcacgtccccataggagcccagggactacttctgggattggaatttgagggtgtttgatcaaggaaccagaatttcaggctggatgaatataatcctttggcttgaagacactttctcagggcatggatttatcaaacactccaggactttgataagtggagtaaacccactgctggggtgtatccacatagtctagaaaaaaacatgcccaactctcaacaaggtagacatgtcttagttgccctggaacatgtagaggatggaataacaagctgaggggagtgggcttggtgaaggcctaccaaaaccatgctcyacaagagggcccagaggacacaccttccaccagagcctcaggaacttgatggtgagagggacctgcatcactaagaagtgtcagggtattgtcctttgtaggctgggggtgatggtagtaaagatagtcccagagtttcatttctaatatcactggggagagtgtggccctgaagagacaaagaccaagtggtggcagtgacttgcaaaagccagagggcacggttactatggcaacctckgaggagaagccaagaggactcaagctgcagggaatgtggggaagtataatagagggtggtgtcccagggttaggacaggcagctggttgatatctatgataagaaagcaagaattgagaagcaggagggtgaaggtgtttgactcaatacaaaatcatgatcccatcctcaatgcctagacctcagccaagatgcagattcagatctcagtgacagaggaagagtccatatctctaggcggaatactctgcaaccccgtggaagtrtatgctgggacaattccctcagtccttcggcaaaggaccatatagccatttactcaggagattgtacactggggaaaggaaacaggcagaactggggggattattgacactgggtgtgaactgacattgatgctcagatgcccacagcactatcatgtctctcatcacagtggggcttatggagctcagggagtaaacctggacacattatggcccacaatggaactactggatccatagacccagccctggttatcttcctataccctgagtgcataattgacactgatgcactgctaagtggagttacccccaccctgggtccctagtctgtggagtaaggactttcattgtgctgaaagccaaagggaaacctctgacactgcccccatcctggccaaatcaaaaatcatagtgtgtcccagggtgggtcttgtgtaagatacttcaagtattgtggggatcacatcaccattacagagctgaaggatgtgggatggtgttggggctgtctattgtctctacgtaatccagcaacctgtccctgaagaagcctgatgaagcctaaagaatgaactagattactccaggtctggccaagtaggagttataattgcagcttttgtgctgtctggatatcactggtagagcagattaataaacccttggacacagagcatgcagctgtggatttggtgactgcatttctttccactccaattagaaagtggatatggagtgattcacattcatgtgggatcctcaaaacattgatttatcatttgtctcagggctattgtaactcccctgacctctatagtatagtcttaagactatactaaacatactggatatccaataggatattaaatcagctcatatcattgacaacttcctgttgayctggctggatgagcagcaggtagaaagtgcactgtagtgcttggcaaaacacgggcactccagaaggtgaagataaaccttacaaagcttccagagtggccactcggccaggtgcagtggctcacgcctgtaatcccagcactttggaaggctgaggtggvtggatcacctgaggttgggagttggagactagcctgaccaacacggagaaaccccgtctctactaaaaatacaaaattatccaggcatggtggcccatgctggtaatcccagctacttgggaggctgaggcaggagaatcacttgaacccaggaggcagagattgcagtgagccaagatcgtgccattgcactccagagtgggcaacaagagcaaaattccatctcaaaaagaaaaagatagtgggcattgaagtaaagttttatgggtgaacaatggccaagtgtttaggggaatgcaggtgtgtcccctccaaggtaacagacaaactgtttcatcttgcatcctcaccagaaagaaggaagcacactgcctgatgagcctcttccagttctgacaacaccactttccacatctaggtatgttgctttggcccacactctaggtgacataggaggaggccagcttcaagtagggcccacacagaaaaggaccctgcagcagatccaggccatggtgcgagcagccaccatctctcagaccccctggtgctggtgatgccattggtagggaaagatgcaggatggagctgaaccaagcaccagtgggaaagtcacagtgaaaggcctgggattctggagtaaggtcatgtcattcacagcagagacatatgccacctattagaagcaacttttagtgtcccttgtcctgattagatagaatgcttgaccackggacaccaagcaactatgtggttcgagtgcctgtgtgacccacagagtcatagattagacaggcccaacagcatccatcatgaggtgaaaatggtccacctgggttgagcttgaatcccatgtttacacccagagaaaatacccaagtctgaagtggcactgaacaaccaaacagacaaatggaagttagccagccttcaccatgggtcagccctggtttggtaggatgagttcatgaatggagcaaccacagtggcaggcatgaggctacgtatggggccaacagcactgactcccccctaccaaggcagatccagctgccgacacctctgaatgtccaactcattagcaattgaggcccatgatgtgccccagtggggcactatttctttaggtgactaactagccactaagtaacaagttgactacatttagctacttccatcctggaagggccagaggttcatcttcacagggataggctcctattccatgggtgttttcatgtcctgctctcagaaactcagccagcacctctccgggtgctgttgacattcctgatctgcaggctaggcggtgctcctagcccattatctgcctgaaggacccacttggctgggaaagtttcagtgtttccatggctgtgggttccactaatcctatcaccatctgcaccatccagaggctgccagccacaaggaatgctggacaggtcttctacaggcaaaactcagtgccagcctggaggaagcactctgagaggtgggtgccrtctttyaggacacsgtgcattgtttgaatcagagatgtctctagagtgctgtgttctcaataggaagaacatgtgtgtccaggratcaaaagatggaagcaggtttggctccacgtccaatcccttagattcacccaatggggtattttgcacgttttatcttccaacactgggctgtgcagggtacgaggtcctggtttccaaggagggtacccttaaaaggagacaaaagacagcccactgaactacacattatggttgtcacgagagaagttttgatagtttgtgcccagagaccacctggtgaaaagaggattctcctcctctccaggcccaggtaayagatcctcatcttcaggagaaggcatggctactttcacacaatgagggcggaagtgtgtgtggaaaccagagatccacctgggggccttctggtttcccttacctcattgtaagtgtgagcagaatcatccagcaattcagcctgagacagcttgatttccaaggacccagacccgtcagggcagaaggtttgagtaatgctgggtaatctcccaaggccctgctcctgtgctctgacatcctcagtagcattggtgctgaggtcctgcttccaatgggctgttcccaaccagtgacagatcacaccagtgacacgaaagcaggacattcctgggagaccagggactcctctgatggccaactgtagctcaaggactcctccatggccttgcttaactctccttagattgcctgtggtctacggcacatccagtaaaccttgtctccttctgtccatcactggggatcacctttgcatcttgttgcctttcccagggtaacctacctcccttgccatatcacctgacaggtgtgtcccctaataaaatgctataactttaatcccatgatggaacttgctttttggagcatttggactataaaatcattttcatctgcccactagtgatctcttacttattccaatgtgtaaaatctttttgtttattcaacttctacctgcattggctccattttgctggtatttgtattatgcttttgagttcctcaatgtttattgtttaatcactaaatttgggggtagtttgttacacagcaatggataactaatgaagccctcttacatttccattattctatagaagttaactacatctcttttattttctcctattttgataatattagccacacatagggtttctagtttctcaacacctattcttttctttattttagtttcttttctcctttattccttcccttttttttttttttttttttgagatggagtctcactctcttgcccaggctaaagtgcagtggctcaatctcagctcactgcaagctctgcctcctgggttcatgccattctcctgattcagcttcccaagtagctgggactacaggcacctgccaccacgcccagctaatttttttgtatttttagtagagacggggtttcaccatgttagccaggaaagtctctatctcctgacctcatgatctgcctgcctcagcctcccaaagtgctgggattgcaggcatgagccaccacacctggcctcttccttccctttctccttccttctaaccctccctccctctctttcttctctatttccattcaacctatcaccttccctccttcttgctccctttccttccccttccccttccttcttttcttctttcactttttcctccattcctccttctttccctcccttcctccattttttcctttttattataaaattttcctaaaatataaaataaccctatgtgattgggctgtaagtaagcattttctgaatctatatgtcaaaagcataatgtcttttatatgagaaacaagtaaacaacaggaagttattaacagaataaaaatgcttgctataattctaccaccaagacggtgacttttaacacaattccttcaactcagtgttttcagaacacatcatcaacatcaagtattacacatttattgtaaaagtttaagtagccacaattactttggaaatcatattatcattatctagtatggttaaagtccatacaatgtatcatgcaaccaacccattcctaatcatccactctgggggctttggggctttcttgcctatgtgcacaggagacatgcacactaatatttatggcaaaaactggaatcggccacatgtacatcaataggaaaccggtgaaattgtggtaaaacgatatgtaagccttcagcgtaaaaatgaatgaatgacagcctcccacaccacagataactcctacacataatgtgtatcatgggaaaatacatgcagtaggaatttgctgtacaggaagcttaaaaaccagcaaaactaactgaggtttgttttggggagatatagatatacttattgcacaaatctttgaaggaatacaaaggaatacgtatcagaagactcaggatggagtctcctgccgagaccagctcggtcaggaagaccctaacccagtggtgctagaggacttaaagacacacacacagaaatatagaggtgtgaagtgggaaatcgggggtctcacagtcttcagagctgagagccccaaacagatatttacccacatatttattaacagcaaaccggtcattagtgttgtttctataggtattaaattaactaaaagtatcccttataggaagcaaagggatgggccgaattaaaggaataggttgggctagttaactgcagcaggaacacacccttaagacacagatcgctcatgctattgtttgtggcttaagaatgcctttaagcggttttccgccctgggcaggccaggtgttcctttccctcattcttgtaaacccgcaaccttccagcttggacattagggccattatgaacatgttacggtgctgcagagattttgtttatggccagtcttggggccagtttatggccagattttgggggacttgctcccaacggtctccttctagggggtgactgggtagcagcccagggtagctttacaggcttgtgttttacaccagtgctgggcaccctcgtagatacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagccatgtgacagagaggaccaggatgccatgaaaatggcattggctacaaataggtcatttgatccttggctccctggcatctctctagattttcaatgatacaatgttcaatctgctgtgcaagataatttcatcttscaaagatttgatgttacattttaccacacattaaactgaaataaacttttacagattggaaatgcacatcattgatcaaaataaatgaaacatgaaaagagtaggraggaatacccagtgatggaatagcaaatatgaatggaaaacagaataggactgctaaaaagaaaaaaaaattcagaagcatgtaatagcagcgctatttagaatcatagtggtgtccaaatcacttctatcacatctcattcaataccacaacaaaagatgttaagtttattatagaatgcccatcaaatagccagtttttgaaaaaaacttgtttctcaattagaactaaccatttcgggctacagcatcaagccaaaattattggcatcatgctaataatttttactaaagtaaaataaagttgactgaagtatgagattcacatttttgtaaatgaaaagcaatttgattaggcatttttttctgcacagcaaaagaaactatcatcaatcacagtgaacagacatcctacagaatgggagaaaaattttgcagtctatccatctgacaaaagtctagtattcagaatccacaaagaacttaagcaaatttacatgaaaaaaaaacttcattaaaaagtagacaaagaacttgaacagacacttctaaagaagacatacatgtggccaacaaaaatatgaaaaaaagctcaacatcgctgatcattagagaaatgcaaatcaaaaccacaaatgagataccacctcatgtcagtcagaatggcaattattaaaaagtcaagaaacaacagatgctggcgaggttgcagagaaataggaatgcttttacactgttggtggaaaagtaaatggttaatccattgtggaagacagtgacagtgtggtgattcctcagagatttagaatcagaaataccatttgatccagcaatcgcattacagggtatatacccaaaggaatacaaatcattctattataaagatatatgcatgtttacattcatggcagcactattcacaatagcaaacacatggaatcaacccaaatgcccatcaatgatgaactggataaagaaaatgtggtacatatacaccatggaatattatgcagccataaaaaggaatgagatcaagtcctttgcagggatatggatgaagctggaagccattatcctcagcaaactcacacaggaacggaaaaccaaacaccacatgttctcatttataattgggaactgagtaatgagaacacatggacacagggagaggaacaacacacactggggcctattggggcagggtggtggtgggaggatcattagcaaaaatagctaatgcatgccagggttaatacctaggtgatgagttgacaggtgcagcaaaccaacatggcacatgtttacctatgtaacaaacctgcacatcctgcacgtgtaccctggaacttaaaaaaaattaaattaaaagacaagcttaaagaaaaagacaagctgaaagagttaatgaaaaataattagataaaagaagtctttgattttcaaaaacctgaaacaatagttataattttgcttttaacatatattcaaaacatttgatactgttcccttccagaggtgcatcttaattccctctcctgagtgtggcttggacttaatgaggcacttctgatatggcctggttctgtgttcccacccaaatctcatcttgaattgttatgcgaattgtaatcgctacctatwgggggagggaccacatgggaggtgattggataatgggggcggtgcccccatgctgttctcgtgatactgagggaattctcatgagatctgatggttttataaggggcttttccctgcttcattctgcacttctctctcctgtcatcatgtgaagaaggatgtgtttgcttccacttctgtcatgactgtaagtttcctggggcaggctcctcagccatgcagaactgtgagtcaattaaacctctttcctttataaattasccagtctcaggtatttcttyatagcagtgtgagaatggactaatataacttctaacttatagaataatgctgacataatggtttgtaactctgggtgtagaacctaaaactcactgcggcttccaccttctctctctctgtctctgggatcatgagctctgggggaagccagctgctgtgccacaagcagccctgcaggaaggtccatgtggctgagaactgaggccttccgggaccagacaacaaagaactaggccttttccaacagccatgtgactgatccatgtttcatgtgaatcctcagccccagtgaagccctcagatgatgcagcccttggctgacaattggactgcaaccttgtgagaggcccsgagcaagaagcactcagggaaacctctcctggactcctgaccattggaaactgtggcagatgaggaatatttgttgttttaagctaagttttacataatttgttatgyaatagtaaataaataacacattttcacaagagaggatgtattattacacattaaattgcatttgctttaaatgtatcatcrtcatcattattatttttgagacatggtctcgctctgtcacccaggctggagtgcagtggcatgatcaccatgcactgcagtgtcgacctcctgggttcaagggacccactgatctcagcctcctgagtagctgggactaccatcatgaactactatgcctggctaattttctaattttttgtatagatgggggttttgcccaggctgatcttgamcttctggagtcaacaaatctgccttcctctgccttccacagtgctaggatggcaggygtgagccaccatacctggcgtaaattaattataagatattaaacatgtaacttagttttaaaaggtaaggagaatttccatggctgaagaggatgtattttatgaccattcacaatgatcactttacttgaacttcaatttccaactgtgtccgaagtaaacacaaaaggaagatccaacccttgctaggctgattctattatgccctcaacaaccagctcctggtcattcaccatcctccagttattcaatcaactctaatgtaggtgctgctgtgaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgaggggtttcctccagcatgggctttgaaaatgaaagggctgtgggccgggtgcggtgcctcacgcctgtaatcccagcactttgggaggctgaggcgggcggatcatgaggtcaggagatcgagaccatcctggctaacatggtgaaaccctgtctctactaagaatacaaaaaaaaaaaaaaaaattagccaagcgtagtggcgggtgcctgtagtcccagctgcttgggaggctgagacaggagaatggcgtgaacctgggagccatagctggcagtgagccgagatccggccactgcacccaagcctgggctacagagcaagactccatctccaaaaaataaataaataaaataaaaaatgaaggggctgtgtaggaaagaatgctggtgaggaccaggaatcgagcacagccctccctgttctctacattgacagccagcaaggaacagggacctcagtcttacaactgccagaaactgcattctgccacctctgtataagcctgaaggaggattcaaaatgaaaacacagcttttggaagcccagaagagagattccatccacaattttgcccagatttctgatcaaggaactataagcagataaatgggtgttgtttcgccaggcatggtagtgcacgaatgaattgatgaattgatatgcacactagttacataaaataaaaattttctgaactttttccgtgttttgcactttataattatctgtaatgcaatttaatacactcatatttcattcattcagtcgacaaaaattaatttagtccctacgataaaccagatatcccctcatatgctcacgtgcctgacactccagaagtttctcaagaccgaggtggagacactggagtgttttaagtggagagatgacacactccgactcccaggagcaggaccactgtgaaaagaacagtcacgtaacaggtcatgggacagtgctagtgtcacaactcacaagtgacagtgtggtggggactaaggggacaggagggcctgaaggatgaaaaggacggagagaagggctggagaagcaggaggtgaagaaaaggagcagaggaaagaattcgaaagcagcagaattcttaggtttaaatacattgttttatggattttaatacatccatctacagagcctagcagggtgtccttggcagttggcctttaatacctcatgtgggtctgcctaaaaactaattttttaatgttaatcaggtttaaaaattactaagtgttcctataaaatatacacaacacttagcagtggatacttcctaaaaacaggcagtgcatgagcactagtgaggggcattgtgactacattgaacagttgcaactttgaggtgaataaagcctgtactgactcctggttgcaacgtacctggttgcaaagtacacagtgtgctactttgtattgaggagatatcctggactcacacagaaactcagagctatggaatgatggcaaatttaaaatatgacaagcgggagtcacaggtacactgcaaaagtgaaacttagaagctttgtgagtcctgttstaacgcttttgggcacatttatacatcatggggccaaagtcacattttttaccgattagattcctgatcattcaggggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgrcttttcttctagaagagtccaggtggacagggagtccagttcagggacggagattcctggatgaaaagtgaagggagagggacagggcccatgccgagggtttcttcctggtttctcagacagctcctgggccaagactcagggaaacactgagacagagcgcttggcacaggaggagcggggtcagggcgaagtcccagggccccaggcgtggctctcagggtctcaggccccgaaggcggtgtatggattggggaggccccgccttggggattcgccacctccgcagtttctcttcttctcacaacctgcgacgggtcctttttcctggatactcasgaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgacccagacctgggcgcgtgagtgcagggtctgcagggaaatggtcgggaggagcgaggggcccgcccggcgggggcgcaggacccagggagccgcgcagggaggagggtcgggcgggtctcagctcctcctcgctcccaggctcccactccatgaggtatttctacaccaccatgtcccggcccggccgcggggagccccgcttcatctccgtcggctacgtggacgatacgcagttcgtgcggttcgacagcgacgccgcgagccagaggatggagccgcgggcgccgtggatggagcgggaggggccggagtattgggaccggaacacacagatctgcaaggcccaggcacagactgaacgagagaacctgcggatcgcgctccgctactacaaccagagcgagggcggtgagtgaccccggcccggggcgcaggtcacgacccctccccatcccccacggagggccgggtcgcctcgagtctctgggtccgagatcctccccgaaaccgcgggaccccgagacccttgacctgggagaggcccaggcgcctttacccggtttcattttcagtttaggccaaaatccccgcgggttggtcggggcagggcggggctcgggggaccgggctgaccgcgggggcggggccaggttctcacaccatgcaggtgatgtatggctgcgacgtggggcccgacgggcgcttcctccgcgggtatgaacagcacgcctacgacggcaaggattacatcgctctgaacgaggacctgcgctcctggaccgcggcggacatggcagctcagatcaccaagcgcaagtgggaggcggcccgtcgggcggagcagctgagagcctacctggagggcgagttcgtggagtggctccgcagatacctggagaacgggaaggagacgctgcagcgcgcgggtaccaggggccacagggcgcctcccggatggcctgtagatctccggggctggcctcccacaagaaagggagacaaatgggaccaacactataatatcgccctccctctggtcctgagggagaagaatcctcctgggtttccagagagtgactctgagggtccgccgtgctctctgacacaattaagggatgaaatctctgaggaaatgaagggaagacaatccctggaatactgatgagtggttcyctttgacactggcagcagccttgggccccgtgacttttcctctcaggccttgttctctgcttcacactcaatgtgystgggggtctgagtccagctcttctgagtccctcagcctccactcaggtcaggaccagaagtcgctgttccctcctcagggactagarttttccacggaataggagattatcccaggtgcctgtgtccaggctgttgtctgggttctgtgctcccttccccaccccaggcgtcctgtccattctcaagatggccacatgcgtgctggtggagtgtcccatgacagatgcaaaatgcctgaattttctgactcttcccgtcagacccccccaagacacatatgacccacyaccccatctctgaccatgaggccaccctgaggtgctgggccctgggcttctaccctgcggagatcacactgacctggcagcgggatggggaggaccagacccacacacggagctcgtggagaccaggcctgcaggggatggaaccttccagaagtgggcggctgtggtggtgccttctggagaggagcagagatacacctgccatgtgcagcatgagggtctgccagagcccctcaccctgagatggggtaaggagggagatgggggtgtcatgtcccttagggaaagccggagcctctctggagagctttagcagggtcagggtccctcaccttccccccttttcccagagccatcttcccagcccaccatccccatcgtgggcatcgttgctggcctggttctacttgtagctgtggtcactggagctgtggtcgctgctgtaatgtggaggaagaagagctcaggtaaggaaggggtgaggagtgtggtctgagatttcttgtctcactgagagttccaagccccaggtagaagtgccctgcctggttactgggaagcaccatccacactcatgggcctacccagcctgggccctgtgtgccagcacttactcttttgtaaagcacctgttacaatgagggacagatttatcaccttgatgactgtggtgatgggacctgatcccagcagtcacaagtcacaggggaaggtccccgaggacagacctcagaagggcggttggtccaggacccacatctgctttcctcatgtttcctgatcccgccctgggtctgcagttgcacatttctggaaacttctctggggtccaagacttggaggttcctctaggaccttatggccctggcttctttctggcatctcacaggacattttcttcccacagatagaaaaggagggagctactctcaggctgcaagtaagtatgaaggaggctgatccctgaaatcctttggatattgtgtttgggagcccatgggggagctcacccaccccacaattcttcctctagccacatctactgtgggatctgaccaggtcctgtttttattctactccaggcggcaacagtgcccagggctctgatgtgtctctcacrgcgtgaaaggtgagaccttggggggcctgatgtgtggggggtgttgggggggaacagtggacacagctgtgctatggggttctttgaatttgatgttttgagcatgcgatgggctgccaaagtgtcatccattactgggacagatatgaatttgttcatgaatattttttctatagtgtgagacagctgccttgtgtgggactgagaggcaagatttgttcacaccttccctttgtgacttgaagaaccctgactttctgcaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggcggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacmcatgagaaccttccagagtccatgtgtttcttgtgctgatttgttgcaggggaggagaatagatggggctgtgcctagtgggtgctcaggccagtatggactttatgtggtcactgctcagctgggtcatctttgctccttcattctccttggcccttcagtagaaccttgtcccaccaccacctgtgatcacagggasttggatgtcacctasggtggtccctgcatacaaatctcattgtggtatcaagagactaattttcagacctgtccagctcttgccctcctcccagggctctttcctggattgtagttttcatcttgtctccaatctttttaaaggaagcagattctgaaatttgcagagaggaggggtcccatagtttctcatcatagtgaactttctgttggagctcctcttctgctctcctactcttcttcctgccctgagttgtagtaatcctagtgctggctccaatccaaactcatggatttacaaagcagagtctaatttagattcatacgtggttggaaaattgtacccataagcctagggttatctttcctgaagagaaaaatatggttgtgtgctgcagtgtgcaggagggttggtgtgggaggaggtagggagggagggaggacacacaagcastcctggtgagaaaagcactggcggcatcgatgtccacatgagatgatgttgttctttagctgccacaaaacagcatttgccctgaggctaccttaacaaagatattggctttagaatagagaagtgctctacagtgatcattcattcaactgacatttgttgtctgctagggatatgactgcttttgcgtttagaaagcatcattaaggtgaaaacagaaaaatttctggtgttgtggtacatatgttctagatgctagcttgtctaacccgtagctcgcaggctgaatgtggcccaggacagttttgaatgtgaggagtttttgcttttctgtggcggacctgagacctggagtgagtgcacccacctccctcaggatcaggagtgaatgctttaggaaccctcctttgcagygacctgcaaaagatagagggcacggttactgtgagaacccagagtagcagccaaaggggctcaaccttcatggagttttgggaaaggttagtaaaaggtggtgtcccagcgtcagaacagatgggcagccagcgagggcactgcttcatatctatgatgggaatgcaagaattgaggagcaggagactgagggtgtttgatcaaatacaaagtcatgatcccagtctcaattcctagacttcagccaagcttcagattcagaatctacagtggggcttaaggaggccaggaaataaacctggacacattatggcccactgtgggaccactgggttcataaacccagtcctggttatctccccattctccacatgcataattggccttgatgcactggcaaagggagtcacccccacactacatccctagtctggagagtaagggctatcattgtgctgaagcccaaagggaatcatctaaaacttccctcatcccagccaagccagaagcaatattgcgccccaggtgggacttcaggagggtactgcaggtattgtaggggtggcactgccattagagagctgaaggatggggggtggtgttgggattgcctattatctccatataattcagcagtctgtccctgaagaagcctgataaagaatgaatggaattactccagacttgaccaagtaggagtcctgattgcagctgccatgctggctggatatcactgcttggggagattaataaggcctcaggcacatggcaaacagccatgcatttggtgagtgcattctttcccattccatttagaaaatggatatggaatgattcacattcacatgggatttataatacatttattgatagcttgcctcagggctactttaactcctcaaccttctataaatatcaccttaagagatctggacaaatcagacatctcacagaatactaaatctcttcatttcattggcaatatcacatagattgggatggatgagtaagaggaggaaagtacgctgaattctttggcaaaacgtgtgcactacagaaggtgaagattaaccttacagagcttcaagagtggccactgcagtgaagtgttatgggtccagtggttaggggcatgcagggctgtcccctccaaagtaaaagacaaacttgcatcttgcatcctcaacagaaggaaggaagcacactatttggtgagcttctctgggtcctggcaacaccacattccacatctaagtatattgtttggcccactgtctgggtataatataggaagaggtcagctttgagtgcggactagacaggaaaggacactgcagcagatccaggcggtggtgtaccaggtcatcaactctcagtcccctggtgctgggggtgacagygtggggaaagatgctagatggagctgaaccaagcagctgagatcaagtgagctgagatcccgcccctacactccagcctgagcaacaagagtgaaactccatctcaaaaagaaaaaaaaattaaaaggataagcaccctcccacatcagagataactccccaacacataatatacatgcggtgtgagttctctgtatggggaagttaaaaaaatacaggtcaaactgtgatttgggtattattgtaaaaatcttcagtgacaatgccaaggaatagcaaatacaagactcaagacataggttccttttaggggataggattggacaacagcctagggtggcttcataggttctgtttcttatgccaggaggggatatccaggtagttagttacttgatcataaaactttatttatttatttatttatatattttgagtctcgctcttgttgcccaggctggagtacagtggcatgatctcagttcactgcaacctccgcctcccaggttcaagggattctcctgcctcagcctcctgagcagctgggattgcaggcaaatgccaccactcccagctaatttttgtatttttagtagagacgggcttcaccatgttgaccaggttggtctggaactcctgacctcaggtgatccacccacttcagcctaccaaattgctgagattacaggcatgagccaccactcctggcccacaaatctttaaagtggtatttttcaaaatgcaccttgtgtgccattcctgattgattatttggaaatgaaagagaaaagaaaatgccaaagttcatcacaagcatcctttgcgataactactcgtagtaaaacaaagccgcagctggccgggcacggtggctcacttctgtgatcctagcactttgggaagtcgaggcctgtggatcacgagatcaggagttcgagaccagcctgaccaacatggtgaaacctcgtctttactaaaaatacaaaaattagctgggcgtgttggtgcgtgtctgtaatccaagctactcagaaggctgatgcaggagaatcgcttgaacctggaaggcagaagttgcagtgagctgagatcctgccatcgcactccagcctgggtgacagagccatactccatctcaaaacaaacaaacaaacaaccacaaaaaacaagccacagccaattttaaggagccatgtgagaggaccaggatgccatgaaaaacagccttggctacaaataggtcatttgatccttggctagttggcaactctctacattttctgatacacagtgttcaatctgataggtaaggcaatagtatcttgcaaagaatttgagaatttgatatgttgctcacattttaccacacatacaagtgaattaaacttttacagaatagaaaaaaagcattgttgagcaaaataaattaaatgaaaagacataaatgaataactagtgatgaaatagcaataagaatggaaaacacgaaagagctgcttttaaagcaacattagaagcacaaaataacagtgtttttcagaatcatactggagtccaaatcacttctaccacatctaattaaaaaccacagtgaaagatgttaaactgatcacaggatgcccactgaatagccagttactgaaaaatcttgttcctagattgaatttaaccatttccacctaccacatcaaaccaaatcattgtcatgatgctaagccagttgtacagacaaagatgtgagactcacatttttctaattgcaaagcaccctgattaggcaaatatttttgtagatgcttgagtcagaaaattgtcattttgggcattctttttttttttttttttttttttgccttcaagcatctgtttaacaaagcacatcttgcaccgcccttaatccatttaaccctgagtggacacagcacatgtttcagagagcasggggttgcgggtaaggttatagattaacagcatcccaaggcagaagaatttttcttagtacagaacaaaatggagtctcctatgtctgcttctttctacacagacacagcaacaatctgatttctctgtcttttccccacatttcccccctttctattcgacaaaaccgccatcgtcatcatggccccttctcaatgagctgttgggtacacctcccagacggggtggcggccgggcagaggggctcctcacttcccagacggggtggccgggcagaggcgccccccacctcctggacgaggtggctggccgggcgggggctgccccccacctccctcctggacggggyggctgccgggcagagacrctcctcacttcccagacggggtggctgctgggcggaggggctcctcacctctcagacrgggcggccggggagagacgctccttacctcccagacggggtggctgctgggcggaggggctcctcacatcccagacagggcggcggggcagaggcgctccccacatctcagatgatgggcggccgggcagagacgctcctcacttcctagaccggatggcggccgggcagaggctgcgatcttggcactttgggaggccaaggcaggcagctgggaggcagaggttgtagcgagccgagatcacgccactgcactccagcctgggcaacattgagcactgagtgagagagactccgtctgcaatcccggcacctcaggaggccaaggctggcagatcactcccagttaggagctggagaccagcctggccaacacagtgaaaccccgtctccaccaaaaaaatacgaaaaccagtcaggcatggtggtgcgcgcctgcaatcccaggcactctgcagactctaaattattcaacgcctcagacactaactttccaaggaataggagattatcccaggtgcctgtggccaggaggtgtctgggttctgtgctcccttccccaccccagatgtcctdtccattctcaggatggtcacatgggtgctgctggagtgtcccatgaggaatgcaaagtgcctcaattttcttactcttcccttcagaatcccagaatacatgtgtgatccactaccccatctcggaccatgaggccgccctgaggtgctgggtccygggcttctaccatgtggaaatcacagtgacccaactgtgggatggggaggaccaaatttaggacgcagagcttgtggggaccagacctgcagggtatagaaccttccagaagtgggcagctgtgatgctgtcttctagagacaagtagagatacacatgccatgtgcagcaggaggcactgccagagcccctcacactgagatgggctaaggagatgaatgaggggccatgtctcttctcagggaaagcaggagccyttctggaggccttcagcagggtcagggctgaggcctgggggtcaggacccctcacgttcccctcctttcttagggccatcttcccagcccacattccycatcrtgggcatygttacygtcctggttgttctaggtgctgtggtcactgctgtgatgtggaagaataagaccccaggtaggaaaggggtgagttccaagatttcttcttccattcgtggatttcaagctccagatggaagttggctcatttcctgcctagttgtgagacaccatctccacacacatttaccctgttcagatgccctgtcaactctcactcttttgtaaagcacctgtgaaattgaaggacaaatttatcaccttgattgtgatcatgggaacctgactcccagcagtcacaagtcaggagaatgttcctgctgaggacagatgtcaaaaggacatttggttcagcttcaacacatcctcttccctcgggttttctgatcctgacctgggtctgcagtcacagttctggaaactcctctaggatctcatggccctgcctcttccctggcctctcacagtttgttttctttcctcatatggaaaaggagtcagctatgctcaggcttcaagtaagtgtggtaggggtgggagagtgattcctgagatccttggaatagtgtagacaggagcccatgggggaggtcaccaccccacaattcctcctttagtcacatcacctgtgggctctgaccagactttgtttttgttccaccccaaacaggaacagtacccagggctctgatgtgtctctcaagtcttgtaaaagtgacaccttagagggcctgaagtgaaggaggagttggggcagatgggacacaactaggctctagagagtctttgatttggaatttttcaatgtgtggtgggctgttcagtgtcaccacttaccatgactgacttgaatttgttcacgactattttctttccaagactgccttgtgagggactgagatgcaagatttgttcatggctccactttgagacttcaagggcctctgttttctctttctgccaaggcatctgaatgtgtctatgtccctggtaacatgtgagaagtggagagaccagcccaccctcatgtccaccatgacccctgatattgtttggatctgtgtccccacccaaatctcatgctcacttgtaatccctaatgttggaggtggtgcttggtgggacgtgattggctcatgaggatggatgattcatgaatggtttagaatcatctctttcatgctgttcttgtgatagttcttggaggcattgtgccacctccctagggatctgtggaactttaaacttgagagtgatgattaagggtatctgatggaagaaatttctcagtagcatagaattcaggatttggtctggctgcctgtaatagcctatgtgcatatgtgtgagcaaagaaatgacccgaaactggaactgatatttaaatggggaaatttaatacccaggaaaattcttagcggagctgcagcaacaggacccctgccaggactactaaatggtagagccactggctatgtgcaacctcagcctggaaaagccataggcattcaattttctcccatgacagcagctatatgggttatgttcagcaaagccataaatgtggagctgcaaatggcattaggagcccagcagttgcaccagccactgtgctctggattcaaaatatagagtcaaaggagattcttttagacctttaagttttaatgtctgccatgatgagtttcaatcttatgaggaaactgcattcatttcttttggcccatttatataccttttggaatggaaatgtacaagaaatgtctcttccactgttttattaatattttagatgcaaataacattttttaaaaaaattttacaggctcaaagctataagaatttaccttgcgtctcagatgagactctagaattttgagttgatgctggaacaacctaacacatttgggacaattgggagtagattattatattttgcaatgtgagaagaacatgacctttggctggctagggaggggatgcaatgatataaacatttatcccctgatacctcatgttaaaatctaacgcccactgtgggacttggggcctaatggccaccatttgggtcatggtgaccaatcttttatgaatcgagagatactgccctctctcgggaatgaatgaattgttgctctattattttccaagagagctagttgttaaaaagaccctggcaacttcctactctctgtgttcctctgttaccatgtgatctctgcatataccagctcccctttgtcttctgccatgagtggaagcagcctgaggccctcactaaatgcgcaaacatttccagacatcagaatcttgagccacatgaacctcgtttatataaattagtcagtctcagacatttctttatagcaacacaaaatggaaaaagataaccctcgcatcacaggtatgtgtctctggcagctagccaccgttcttaagatatccaggatccactcagccaagagtcttctcatcagtactctaaagacactcttatcactcaagagagtctaaggtttttaggagaaaccagggacaaagactaaatgtttttgtgataactcagattgcccacttttctttgaccacatatcttttacaggaaaaaggattgtaacagtaaagaggtattggcatattatcagagtctcatccattcattcaaaattaggccagtttatcatcctcttgtatgaatatgtctcccagaatgaaatcactcagctttgctgacaacactcaatcttaccaggttccaaaaacaaggatggtctcagggacatacagcttcactcttttaggcatcccgtataattgacctaagtgacaatatcttctcttgctcacaccacctttgaggagttaagctaatattgaatttttctcattatataaccctttgatttattcacttaccctcagccactattcctccctctgtccctttatatcagttgtttccaggtttgggagtgacattaggtttgtctgctgggctggcctagactgcaggcagcaatagtattctagcatgtcttccctcagtctagtcttgatcatagagggtaggttatataggtaaggaactagtgggggctatcagaccaccaggctatataactctacttactgttaatcctaacttttcagatgaaatgaatacttgagaattcttacataaaggtgtaaaaatatagttatggtttttcgcttagggataattcctgtttctggcacttttatttacatccctattcctggtactatggcataacatatgaaaaaataaatttgaggtgaagtgtagtctttattccagcatcctctccccttcagaagaattgtatgtatcgtcgtaacagcatcgtcctgatccatcaggtaaaagagaggatgctacctagtggagttattcttgcagccccactcatgttgacagcgagcacattcatgaagatataaaagccagtccttcatgtttatattgcccaacaattagattggcagtttttagacaaacaatgtttcaattgaccatttcaattttctatcaaattttcccctgaggaggacatgtccctctgcattgttggccgtttgaggctgtaaagtgtgttttcttgtgtaaagaagtgtgactcggcagtccaaattggtgcaacctcttcttttctggtccttgtatagcccttgaagcattgacatctacccctggttgagcatagcccaatccagagtcagtgattttcctgtcaagatccattggcagctcctttggggttgctggcatcattctggcttgccaggtattatgatcaaagccttcccactagagaatctgtcacatctccatctgctgcctctgtctgttttcttgaccaacagtgaaaaaagagattatgagaaataagataaattaccaaaattgtgaacaaaagagattatcactaatgacccttaggaagttaaaaaacattataagtgaatactctgaaaaacctgaagccaataagttagaccacttagataaaaaggaccaattcgtgcagagatagaaattgccaaaactgacccaaattaactggaaaacctgaagagaactgtgaactaagtcagaaattgaaaaaccttctcaaaaagaaatgccaaagcccagatatcttcactggtgaattctatcaaatattttgaaagctctttcagacaagaagagaggagggaagactttccagcccatttacagaactggcattaccctcatatcaaagtcacagcaagactcacaggaaaagagtgccatacaccagtgtcaccaataaacataaatgaaaacatccttaacaaacattggcagataatacaaagccacataaaaaaggattacactccatgaccaatgggattcatcccaggaacatatggttggattaacatttgaaaatcaattcatggaatgcactgtattaatggaaaaaaagacataattatctcaaaagatgcagaagaaacagttgacaaaaatgttaacatcactcatgttcataagtttcaacaaaataggaatggaggagaccttcttcactctgataaagggcatctataaaaaacccacagctaaaatcaaacttaatgaagaaagactgaagactgaatgcttttctcctaagatggggatcaatgcaaggatgtccaatcccaccacttttatttaatattatactggagattgtagccagtgcaataaggcagaaaattaaaaattaaaggcatccagataaaaaggaaaacatacaattctattcacagataacatgaccctgtctgtagaattcacaagcagataaaaactggctagcactaataaatgaatccagaagggcccataggatatcaaatcaatataaaaattaattattaacatatttctctatagaagcaatgaaaatctcaactttcctatcacagtagttaccagaagagcgaaataggaataaatttaggaagacagcagtgtttgttcactgaaaataaaaaaacattcctcagagaaattaaaggtctaaataaatggagagatgcgagttggaaagctcgataatactgttaagatggcaattctcccccagtagatctataggttcaacacaatccctatcaaaatcccagcagggattttatagaaaattgacaaaataggccgggcgcggtggctcatgccggtaatcccagcactttgggaggctgaggcaggcggatcatgaggtcaggagatccagaccatcctggctaacacggtgaaaccccatctctactaaaaatacaaaaaactagccgggcgtggtggcgggctcctcgggaggctgaggcagaaaaatggcatgaacccggtaggcggaggttgcagtgagcggagatcatgccactgcactccagcctgggtgacagagcgagactccgtctcaaaaaaaaaaaaaaaaagaaaaaaagaaaagaaaattgacaaaataatcctaaaaatgtatattaaaatgcagaggatgcagaagggccaacacaaatttgaaaaaaaaaatggaatgtcatatgaaactacaataatccagacagtgtgaaactgagagacatagagatcaatgaacagaagtgagaatctagaaagatattcttactttctttgtcaattgattttcaatgaagttgcataggtaacacaatgttacatttaacaccatataaaatatcagctcaaacaaattagagacctaaacagctaaaatttatgagttaaaactataaaatttctaaaagaaaacacaggagaaaatttttattactttgggtagttaggcaaaagattcttagataaaataccaaaagcatgatctacaaataaaaaaaaaagagagagagaaattgggcttagttaaaatttaaaacttgagtgctccaaaagacattgagagaatgagaagacaagccatagacagggagaaaatatttcacaatttatcacaaattacatttgtgttgaagaacatgtttccagaataatgtggcaagttcttaaactcaatgtgtaagaagatgagcaact

SEQ ID NO: 10643 - DNA, 15338 bp, Homo sapiens
  misc_feature (1)...(15338): n = A,T,C or G, or insertion/deletion polymorphism (see Tables 1-2)
gagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtcyccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacrtcatccccgcagccaaggatgtcaaggccgctgctaatcagatgcgcaacttcctggttcgagcctcctgccgccttcgcttggaacctgggaaagaatatttgatcatgggtctrgatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctccctctcagtcctgatcatggattcagcagcagcgaactcgccaatgtagtgggtggcacagccagggtcttgactctggctctgcagtagcacagtctggaaaagctctgaggggagagagacccccactggtccgagggtctggcacagagccagaaatgggggggaaggtatggggctgggtcgcctctgacctctcaggtaccatccaggaggccctggcctctcactgaacccggccactcctctttggcatggcctcttcccaaatccccaaactgcctccttacccacaaaagtggtctctgagtgtcagtccagtgggacccccaccccttatggcttcagttccccaaatagggctggacccttgatcctgatccagctgtggctatccagccccttcctggggactttggactttgaggggggcatgcccagttgtgctgggaatccatactttccctggctggagtagaacctgtggactgtagtcctgagggcagtcatgttctgcctgtgcctggaaacacaagaaacttgactgcagagagaagaaagaggagagaggaacagagcgaggaaaccgcccgtctccggggctttttctgttccctatccttgactttctaagaccagtggggtcccctcctctgcttctttttcctgagttctgtgaaattccccaattcttattttttatctcaaaccagctcaaggtgggctgttttcctttcaaccaaagaaaggtgctcctggtggctaaaggtacatattcgacagctagatttccaggctggaatcctgccctccacaacatgcgaacaatacccgtgttgcatatagagcatggctgtgaagagttgagtgagtgcccacaaagcacttagagcagtgtctggtacatgctattactccgcagcgggaaaccacttcctcctttgtcttctgggcacttttgtgagtgaaaggaggcactaataacaatcacactgggatacctgtatatactggaatgccccaggcaaaccaggcttaaactgtattactctatctgtagcttaaactaacaaacaaacccacacaaatcacattttgttcttcaggcgattcaggaaggcctattaggcagggactgccattttctctctgagacaaacatcatgccagtaaactggcccacggtggggtggcagagggagagggcccaggtcggggcggacacccttgcctgcacgggtgatgtggaaccagaaagctgactctggatgcaggaaaaaggtcagggttgcatttcccttccttgcttctcgatgggtgattaattttttttgaaatacggacgtcccaaggccaatgagactggtgtcattccagaaaagggccactctgtgggtgggtcggtgggaaggyacctgagggtggggtcaagggaggccccaaaacagtctacacagcaggagggatggctggggctcttgagctataagtggcacctcagggccctgacgggcgtctygccatgctgctcctgggcctgctgctgctgctgcccctgctggctggcrcccgcctgctgtggaactggtggaagctccggagcctccacctccygcctcttgcccygggcttcttgcacytgctgcagcccgacctcccmatctatctgcttggcctgactcagaaattcgggcccatctacaggctccwccttgggctgcaaggtgagaggctgatctcgctctggccctcaccataggagggggcggaggtgayggagagggtcctctctccgctgacgctgctttggctgtctcccagatgtggtggtgctgaactccaagaggaccattgaggaagccatggtcaaaaagtgggcagactttgctggcagacctgagccacttacctgtaagggcngggggcattttttctttcttaaaaaaatttttttttaagagatgggttcttgctatgctgcccaggctggtcttaaattcctagtctcaaatgatcctcccacctcagcctcaagtgtgagccayctttggggcatccccaatccaggtccctggaagctcttgggggggcatatctggtggggagaaagcaggggttggggaggccgaagaaggtcaggccctcrgctkccttsrtcagttcccaccctccagcccccamctcctcctgcagacaagctggtgtctargaactacccsgacctktccttgggagactactccctgctctggaaagcccacaagaagctcacccgctcagccctgctgctgggcatccgtgactccatggagccagtggtggagcagctgacccaggagttctgtgaggtaaggctgggctcctgaggccacctcgggtcagcctnncctctcacagtagcccccgccctgccbgctgcacagcggcctgctgaactcacactgtttctccacagcgcatgagagcccagcccggcacccctgtggccattgaggaggaattctctctcctcacctgcagcatcawctgttacctcaccttcggagacaagatcaaggtgcctcacagcccctcaggcccacccccagcccctccctgagcctctccttgtcctgaactgaaagtactccmtcctttnctggcaggasgacaacttaatgcctgcctattacaaatgtatccaggaggtgttaaaaacctggagccactggtccatccaaattgtggacrtgattccctttctcagggtgaggacctggagcctagacacccctggrttgtrggggagaggctggggtggagggagaggctccttcccacagctgcattctcatgcttcctgccgcagttcttccccaatccaggtctccggaggytgaagcaggccatagagaagagggaycacatcgwggagawgcagctgaggcagcacaaggtggggactgtrygtggacggcctcccctcggcccacagccagtgatgctaccggcctcagcattgctatgaggcgggttcttttgcataccccagttatgggcctgttgccactctgtactcctctccccaggccagccgctcagccngctcctttcaccctctgcaggagagcctsgtggcaggccagtggagggacatgatggactacatgctccaaggggtggcgcagcygascatggaagagggctcyggacagctcctggaagggcacktgcacatggctgcagtggacctcctgatcggtggcactgagaccacagcaaacaccctctcctgggccgtggtttttttgcttcaccaccctgaggtgcgtcctggggacaagcaaaaggctccttcccagcaacctggccagggcggtgggcaccctcactcagctctgagcactgtgcggctggggctgtgcttgcctcaccggcactcaggctcactgggttgctgagggagcggctggaggctgggcagctgtgggctgctggggcaggactccacccgatcattccccagattcagcagcgactgraggaggagctagaccacgaactgggccctggtgcctccagctcccgggtcccctacaaggaccgtgcacggctgcccttgctcaatgccaccatcgccgaggtgctgcgcctgnggcccgttgtgcccttagccttgccccaccgcaccacacggcccagcaggtgactcccgagggttggggatgagtgaggaaagcccgagcccagggagrtcctggccagcctctaactccagcccccttcagcatctcyggctacgacatccctgagggcacagtcatcattccgaacctccaaggcgcccacctggatgagacggtctgggagaggccacatgagttctggcctggtatgtggggggccgggggcctgccrtgaaaatgtggtggaggctggtccccgctgccgctgaacgcctccccaccyacctgtccacccgcccgcagatcgcttcctggagccaggcaagaactccagagctctggccttcggctgcggtgcccgcgtgtgcytgggcgagccgctggcgcgcctggagctcttcgtggtgctgacccgactgctgcaggccttcacgctgctgycctccggggacgccctgccctccctgcagcccctgccccactgcagtgtcatcctcaagatgcagcctttccaagtgcggctgcagccccgggggatgggggcccacagcccrggccagarccagtgatggggcaggacygatgccagccgggtacctcagtttctcctttattgctccygtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccyttccccttaaggaggtagctcccagcactcaaccaacctccccgcagagctcccttcctgaccctccgctgcagaggattgaggcttaattctgagctggncctttccagccaataaatcaactccagctccctctgcgaggctggcatgattgttccatttcacccagccactcagtcccttgcctgttacactgtggggctgaaacctaggcaggccgagccccagccaccccagctctgagccgcctccccacccctcacctgatggtccactgtgctcccgtagagcccgttgaggttggcgtagtggcagttcctgtaccaccaggcccctcggtaggagacagcgcaggagatgagcaagctgttggggtcccgatcacgggcagagaagacactgccgctgtggtagctcatggagtcccctgggcagggtggaggaaggagccatgagggcctcccctcccagcctcaccctcccagcctcacagcctctgcttacctgcggtgccgtggtagccctccaagtggaggcggtagtactccgcagccgagtctacgtggaaggagtcgtactgggcgaacacagcctcgtccccagcccgcaggtccacgcgcatggagtagtcacctgcctgtgtcaggctgtgcagggcctcattgcctgggggtgggatacgtgccctcatcagggtcctggtgtccacagggcccccatccccatccgtagttccccagtccctgtgaggcactgacccagccagaactctccagagatgttcccaaaaccatgggcatagtcctcccagtccctccagaagtctgtctgtccatccatgcggcgctggaacacctgggaagcaagtgggggcaccatcagcctctggctcccggggcaacagaccctgccctgcacagacccctgggcttcccaatgccacccaccagccagccgcccccatcagtctccatgtcgcaaaacacgttcaggggccgctcgcggttgccgttgaggaagatggtgctggtcctggaggcaccggctccgttctgcatctcctccccgcagtccctggggaaggggatccgcagcccacctgggagaggagagcaggggccagtccttttccaagccttaggccctggctgcccacccagcccccggccccgggcccgtgcgtccaggtacccgtggtgaaagaggtggacacgggcggcaggaggctctggccccacatggcctggagccgtgcattgtaggaggtggagggaaagaggccaaggagctggtgagatgtgatccctcctgggagcaggatctcctgtgggacagacaagggggggtcaggggagagggaggtggagaccctccgggagggccagaggcagcacctcctggaatcacccagggaggggagttgggtcagtggggccggggcacctggttctgtccaccaggggtgtggaagctgagcaggtagcctgcgggccggactgggggctcagtccaagtgagcagggcggtgcggggggtcacttccttggcctccaagtcccgaggggcctctagccctaggagggaaagcaggaagaggagatggggatgaggcccaacctggctccctctacctcctctccctgtcccacacaccccacagaccctacctgtggtgaaggtgatgctggctggggaagtgaggttggggccccgcaggccacgcactgtggcggtgtagttggtgtggaggacaaggtcatgcagggggtagtccaccgcgctgcctggggtctccgcctgcagaggcggggctgggagtgtagagaggggcatcaaggcctgccccctccatcctcggccagagtccagcctcccccctgcaatccccaccctgaacaagtcccctccagaggcctcaggcctgctcacccccaggggctgtgacctggacgtcataggtgtccacaggattctgggggggcttccagtgcagcacggcgaatccctcggtcaagttcagtgcacgcaactgtgtgggaccgtcaggaactgggggaaggggaggggctcagaagggtccccgcggctctctctactccgtgcctccccagactccactggcctcccgtccgcaatcggagcctccaccacctccctttcaccctcctcgttctctctcaactcccacccatgccgttttcttggctcccacctcttgccccgggtcccagtccatctcacccgtggtgaggaagcctgtgagaggctcactctcctcaaagcctcggaccgagaccacggtcacctcatagcgagcgcctgggatcagcccctggagtttctgggtccgggcctggccatccacctgcacactctgaggctcccctgaaaacattggggatcgagggttacccagggaaccccagggcggctggagggtgggcagagtgcaggggggagaggaaatgcgaggcgatgagcacatggcaaaggcaccacctccgtccgccagctggtaggagactttgaagctgtccgcccgggatggtgggggcatccagttgaccttggctgaggtctccctgatttcactgaattggaggtcacgggggctctccagaactgcagaggggtcaaggaacaatgacgcaggcaggggcagggaggcttctccctgcgagtccccccctcgcctctgctccagcacaggctcaccaccccttttcctctagtccccaggaatggaagtcgctctgcagattcctccaggcccaccaccaactcgcccacccccaccgctggctgaggcactaggtcccccccgtgaagtacaaagacccccactttggggcagagtgtgtgtgggtccttacctgggctgagggtgcgggcggttccctggatgctgtcggccttgtggggtcctcgcagcccatacagtgtcaggctgtacagagtcccggaacgcaggtcccggagcacggccgagtgccgcgtccccggcaccatcagctcgcgctgcagcagtggacgcggatgcggctccagagtgcttggtgatggaaccccaaagcggagcaggaaggagtcgaaggcccccggtggggcctcccagttgagcctcagtgaactggtggtcacgtcagtcacagacagctgggacaggcggggccttgactcctctgaggtctgaccagcaggagccagccctgcacggagtgggtgggggagaagggattggagacagaagcacaccagcttggtgacccagagcacgtcccttccacccccctccctgcccccgtttctctatctgtaaccagggacttgcagccacaggggggtcctgtggggcagagctaaaggccactcgcatccagcccatccatcctctctccctggtacccgcctcacgctctttccctgcgaccaccccttctgagcccccgtttctcccttctgagtcctaggctagaggccggagacgcctggtggtacctgtggtgccctcagctgagaggggccccaggcgcttcccttcatggaggccatagaggaggaacctgtagggggtgctgggctccaggcctgagatgaggatcttgctctggtcgccgtccacgagcaaggcctggggctgcccgttcgtgtcctcatactggaccacgaaggaatcaaaggggccctgggccacgctccacgagaggcgcatggagtctggggttgtgtcggtcacggtcagcactcctaggcggggctcttcaggaggctcaggggcctctggggctaactctggggctggtgtgtcctcttctggggctgcgtgggagaagcccaggggagaatctgagtgaggggcgccatggggtgctccatttttatcttccaggcttggcccaaggctgaggtgggaagtttataggtccaggcccagtcagacaatgaagtcgctgtggcctcgtgactcctgcgagctcccgcgctgtctgagtcaggtgctcgcttcccccttccacaccccggtgtcctgccgagcccacctcgagatatcacaggctctggccccacccatgccgggatacattcactgagcttgaggagtgtggtgctcccttctgagagaagctgagggtggaactggctggttgaggtgactggcaaatcccaccagccgtgccgtggtcaggcctgtctgaggtgggcatcagcgagctctggaagaggagcctgtaccacaaatgcagccactgctgttggtttctgtgtccccgctcattttgttttccagtgatgttcctcttaagaaaatgctcctgactcatccacggcagggaggtttgccgctatctggacaaggccacccttcggggaggcgacagcagccccagcgagtaatgaggagcagtggcagtgacggggcagagtcggggctgggagattagagagcccctcccagggcctttccctcccgcctggcctggctcctgctctggactccttgatggatgttgaagcccacagggctgcagactcctcctccttcctggggacaggccagggcgccccactccggcctgcccactcctgcagtcatctttgtcttcagcccaaatgcacaaggaaacccacacaagctggcttgctatagccaggcacagcagcctcacctgtcattcccagggcagagaccgggcccaggcgctttcccccaaggagcccgtagagcagaaacttgtatttcttgccaggctccaggtcctctacggtgactgtgcgctggtctgcggccacaggcactgccctgggctgcccgtccgtgtccctgtactggaccacgaaggagtcaaaggggccctgggctaccgtccaggacaggcgcagagagctggaggtctcctcagccacggtcagttcccccaggtggggaggtagctccttctccaggggagctgtgcagagggaggagggaaagctcttagtcacatgctgcctttgcctaagccctggcagcctcccggaggtgtgaggttctgggaaatggtccctccagtgtagccccagggacagctccttgaggagacacacaggcctgctcccgccatgccccacaggaatgagggagaacagccccctcctcctctggaggctgctgcccaaactccttcctgccccgccccttccctgctgtgatcgaggatgcgccaaattcattacagatcatctcccgagggatgggtggctgggggtgcagagagggcctttgtttaccctgacccccagcccctgagcaagaatgaggccagagctgagagagactccccggaggtctctgggttgtcacggagacaccccaaacatcgagagctggtctgggcagccggccaatgcacggctcccatcactgccaggctgtgatctcccccttgtccccttgtggccatcagcctgaacatccgtgcctcctgcttccccagccccacactgaccccactgggccggggcagccagggtggggcagggagaagacaggggattagctgggagaacagagggcagagcagaggcttgcccgggtggggctggggccgatgggtggggatctgtaccccgtccccacagtgagggtttgggaagagaattacggagtcccagggacccaggcccagactggccggctgctctgtcctcctctgggcatagtgactcatggtcctgggagtggggtgagggtcggtgacccaccacaccccttcctcagggagctgagtcataggcatagtgacaccaggtttttccatcgtctttccatagccaagccctcccttttcttccacccctcggctccgagtcagggaggagggaggaggatgggaaccactactgagtccagcgccattcccagcattatgcaggtgaggacactgaggtcccggggatgaagcggcttgtccatggtcaccctggcaaaggctaggactggaactggaacacagatctgctggccccaaagcccgtgtcccttttatttcctcagcagtcagcgaatgaaaggaagtaatgcatatgcttcagaactgtgcctgacacacagagggactcactttcggagttaagatggttgtgtcagggctgatag

SEQ ID NO: 10644 - DNA, 28622 bp, Homo sapiens
aaaaaatcagagatggacacttaggggaagggaggagaaaaagcaaggagggaaggcagaggcggaatggttagaggtctgtgtgtgtgtcgggggaagggaggtaatacgttcttgaacctgggtatgtggggaattcagggtcaagggacaaacatgggagggcttagagaggcagaatactgtgaaaatgccattgatttgggatctgggtaattggttgccatttgagagggaggtttcaggagaatagggtgtggatgcatattccaataagtcaagaaatagtgggtatgaaaaaaagacagatacagacatatctctgatagcaatattccgcacccccctgcccctttttttttgagatggagtttcgctcttgttgcccaggctggagtgcaatgacttgatcttggctcactgcaacctccgcctcccaagttcaagcgattctcctgcctcagccttccaagtagctgggactgcaggtgcccgtcaccatgcccggctaatttattatttttagtacagatggggtttcaccatgttggccaggctggtcccgaactcctgacctcaagtgatccgcctgccttggcctcccaaagtgctggaattacaggtgttagccaccgtgcccagccgtgaattctgtttttcaagaagtttggtaaggtaggcacattaaatgcgaaacatccaagggcgaacccatgatattcacacctcaccccaccctcctcccacatctcctatcacatttcctatctcagtgcatggcttcccttctagattgtaagctccatgaggtcaggggtcacacctgctgtctgggtggatgtctcaccagcatccagcatggagtctgcatgttgcataaatgcataaattaggttaggaccctgtcctgtgggtgtacaaccaaagacccaagcccactgctggcagcatcccctaatcaccactcccctcagaaaagaggcctattggttgacctcaggataggagagggcaactagtcccagggagacttgagaggccattgacctcctccctgggctcccacagcaatctgctctctttgcctttcctataccccctacagtccagcatgtggggctctaatccaagttatctgccaccctccagcccacagtcaggaacagctatgggcagctggcatctcttcttggcccccatcactctatccttgaccagcttcttcaccatggtctgccctctctgttctcttgtcttcctggagttctggggatagtagggaatggaaaaggggtactggggaaataaagcctcactaagaaaataaagcctcactgagaatggaccccaaggtcttccttggtggattcccagggagctcccctccgtcccccatattcacgtgtctctctggcgatctgggaatctgtgtccctcacgttagtctctgtcgggttttctttttttttccttggaagaggagatgaagggaagtgaaaggcggaatcaaaagtggggagggtctttgcggggccgcagtctttggaattgcgggcgataaatcaactaagtctctttaatattgtctttcagaagttcacacacactcacacacagatcagaacaaggcggggccgccgaggggagcggggagcggggacttgggaggtccatagcctggattcccttctgcccggctgcccaggggctgggatgggtggaagggagtatttacagagcgtttacaggcaggtttcttatcccagggagaagggtcctacaccaggaacttcccaaatgtccttaaaaaaagcaaaaggaaaggttctgggattagcaagaaaataggcagatacctgggtggaggagggacaaaaatgtacttgcaaaaaacaggagtgtgggggccttactaccccagggctcggtccttttgccggaagaaagggaggggtctgtccgtctgtgggcgaggcctggagccacaaacccaatcactggactgaatcaccccgcggagaagaaaagaaggcggagcctgccgacctggaggcggggttttgtcagagctggggcggtgcttatagaggaggcggggttttagggaccaaaccgaggttgctcggttgggggcgctacactttgagggtgagggggcctggagcgactgagggtccggcgtttggccgggatcccggaaagcggcgtccctgggggtgtgggttttggaggggttcctgaggaactggattccgagcttgctcgcaaggcgagacgttccgtggaggcggagtttacgatgtatccaagtctgacggccccagaaacgggtgtgcagggcgcccattgggtccgcggtatgactgcagaaagagcctgggagatcgaggggcgcagagtggggccggaccaggggcgtttttagggatcccagtagttctcgtggtgctgcgcggcgatgatgatgactacggtgaggatggtacagagcaccatggccgcgatgcccacggccagggagatgaaggagaagttccgggcctcgcgtgaagcgatctcggccgacaccatgtctccgcgggccaaggccgtgcgcacctacggaggaggggtgggggaaggaggtcaaagagctgcggcctcgttcgaacgcctcagcctttctctaagatggtccccagaacgcccagaactccctgtccccgcccccaaaccgagtatgcccctgccccctacctgcacggccttgaagatggcaatgatgccagtaggccagaagcaacagatggtggtcagcaccgcgatgggcatgtagtcgtgtggcgggcgcctcggctccagtagggccagccctgggccctggggcggcggggggagagtggaggtcactcctgttccccccggggtcccgcctgcatatggctgtggaaggaaatttggggggcaggggcatcactctgaccctctcccagcctaccagcgttgggcggctggcagagtggctttaaaagcacaatttttacctatggcttctcaaaataaagcacccattacccttccaggacacccataaattccacctaagcccctctcctcccttccttgcttcattaaccaccatattcttgggctttctacattctctcccgcaaggtatggtcccactggggctgtcctggcctcaggtcagaccttctttcttccctccagacacctaccaggcctcccctacccccttagtcccaggcttctcccacatccctcttggttcccagcttccattccccccgtcccccgccaggcggtttcctactttcagacctcctctgaacctctaggctccgatccccctcccaggccctgactctgggcaccagtagactcctactcccgtgtctctccctagtccttcctgtctcaggctcccttctttctagggcttgtcccgggaacactacctgttccctgcccttgttcctctatcctaccagcccccagcgtatccccaatttcaagtcctgtatcgcgtccccctctttcccatgtccctgtctgcccggcactcaccgtgcccaccgggtagaccggcacgtaagcagtgcaaggctgcagctgcagggggtatccgggcgctacgtagccccccagcggcagcgtgcccacagtccccgcgtgcgtgggcaccacgaagccaggggcctgggcagtctgggctggcgccggcgggggcggggcggcggcagcgggcggcggcgggggaagtgggccctcgaagcgagtctcctgcaggtaagggtcgggtggcatgcggggcaaggtagcgcagccgggtgggggtgccccggcagcagggccgggaggggcgtggtgggggggcctcggcagcgtggcagaggaggagggaccgcgctgagcggtggccgcggaagaggccaggccccctgcccctaagcgcgggagggtggcggtgccagactgatggtagtggtggtggtggtgatggtgtgaggaaggggctgcctgtggcggtggggctgggggttcggctggaggctgaggggcattgtagggcggcggagaagtgtgagggactgagtctgggagtcctgggggaggtgagtggaggagagtataagaggaaagatgacacagtgatgagttgaggagggggtaaggggaaacacagccggtcagggatggagaaagataatgggagagacacatagagagagacgggtgagaaaccatctctaatttgaggggcaagagaggggctgtatctaggccatctgcccccctccttcttccttccaatctagttttgaggtcacaactctggtctgcttcttttctgtctttttcatcaccatgcacccagctctcacctgcagacctaatcccctctcctttgctatagctgcctttgggctggcctatccgagctagtcctgtgtgtgcgtatgcgtagacatgcaaccctgtgttaatatgtgctcaattcaacagttgtataaacacatgtgggatgacatgtgttccactctgctgttccttcagtggggggaggagtgccccagcctctgtgagaatctcgggacctcttttagggcagattaagaagagccctctggattttgctcccttgacaacccccatctggtcatgtctccatatttcctcacaggatgtctccatgccagccagtgattgtccatctgtcactcccaatgatgccatccctgcaaaacctggctgtacctccttcaccctctcaacctacccccctgaccatgttgttggcaaggggcagaggctgccactggaaagaggaaaggaagagaaagggggagacagaaagaggagggggactgggggagtgttgagagctggagagaaggggaatgaaatagaaccacagctgaggaggggtaagggagggggttggggcaagggggacggagagtctggagacagtggagggggtgggaggttttgttattgtttttacctgacttttcggatgacatgcctgcggtctcgctgggacagggtccctgcagccggagtgggggtcctcggccggtgctggagtctgggtgctggatggcgcagcggcagcagcgcagagatggagagatgaaggcagcggcggggggggggggcggggggggcgggcggagggagagcggggagggggggagcttaaagggaccgaggcgagggagggggagcgcttcagatgtttcccactcggtctctctctgctctcggaccacctctctcctcctcttaccccggcattcaagcccccagtttgggctcctttggagttgtcatggaaacacggaggctagaccaggcgaggcgggtgggactaaggaaaggaaggaaggagaactctctggagtctcccccaccaagactcagtgattgtattgtgggaggaagtgaacaggttctcagtggagttaataacccaggtgcctccagaggcaggtcgtctccccctcttagctccctgcaaggtgccagggtcttctcccaaatccttggccccagtttcctcctctttagaagagataaatacttgtgtgtgagagagaattgtgcagagttcagaactgcgatggtctgaaaagttcccagggtttggtgaacctaccaacctagcagtaaagagggaggcccaggtctgtaaatcagggggagctgggccttggagggaaaagggagagagagtttgggcggtgtgcatacataccttcttcgtccaggactaaggagctgaagctcttttggagggggtagggggtatgacttaactgctcatttctggcagctctgttggtaatgtgtgcttgttcccccactttccctttgcttttgaggctgcttagagtctctgggctggtcaatgttcagatccattccctaaacccccctactcccacccaccacctcccaccaagacgcatctccagctcctgagtcgacctgcagtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttgtaagtcgctgacctggggcggactggagggtggggtggggtgggtgttgaggggcacgcccgggctggcatcagccctccaggccaccctgccactcacccagcacacggcaaaatgcagaggactacctttccctggtccgccccctggccgccccttggggaatgcaaacttcgtgtyctgctgcggagccagackcctgtattgggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggtgcgtcaacgtggtgggggggtgtgtttgtagggagagggctggagtaagttaaaagtaggctattttgtgacacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgaggtctggcaggggacacctgggtgcagggcgttagaggcgtctactgtggcaggggagggagagcggggaactgaaagccacccctctgggcctgcccagttcctcagggagctggtgctggcgtgggggagagttgggggacgggatccctggttctagcagggtacaatagacctgtggacgcgggccagggggtggcgtgtgggagcttcttagcctatccccggtggctgcattgcccccttcccacagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcagggtaggcgactcccctgcccctaactcctaagccctatctgaggcttgatccttatctgagggacacttcctagcgtccctttttctgaaccacattgctccaggcacaaccctggtacctgagcccttcctttctgacttccctcagcacctgggtctcatctctgtcttgaatgggagggaggctccctacactgctgcccttttgcttcctgttacccatggttcttggacataagggctaatggggcaggtaaaaacatcctagaactagaggcaggaggcccagcatctaattcgggctcagtcacttatatgatgtgtgaccttttggcacagggtgtgcctgccttctgtaagcctcagtctcctttgtgtacagtgtgtgtctgtgtgtgtctctgtgtgtgtgtgtgtgtgtgtgtgtgtgtgtgtgtgtggtgggggtggggggtgctgctggctttgctgtccttaagtgcctgcccaatgtggtgttctgcttacagggggccttgtgtgccgggctctgctttctgtcatggatgatcacaacgtggattctttcatctccctctcctctccacagatgggacagtatggaggtgagtgggcactagactccatagaatgccctgagttttgggggaacagaggtttatggtcacttagcattgccattcrcttgccagacacggactacttgaagtggctgttccccacctccatgcggtctaacctctatcggatctgctatagcccctggggccaggaattctccatctgcaactactggcatggtgagtggggatgctgaactggggcttccatggatcaggtcagttgcttccacctctgctacaaccaatagcagtgatgacaataaagataacttacatttattgagttatttgaacaggctctgttcagaattttttttttttttgagacggagtcttgttctgttgcccaggctggagtgcagtgcaccatctcggctcactgcaacctccgcctcccaggttcaagtgatcctcctgcctcagtccccctagtagctgggattacaggcaggcgccatcatgcccggctaagttttgtattttaagtagagatggagtttcgccatgttggccaggctggtctcgaactcctgacctcaggtgatccactcgcctcggcctcccaaagtgctgggattacaggtgtgaaccattgcacctggcccagaatgttttaagtgtgtcaccttattgccttagaaggtttagtctgatgtgggagtcagcaaaccttgtctataaagggccagagagtaaatatttttgactttgtaggacatatagtctgtttcacaactcctcaattctgctgttgtagtgtgaaagcagccatgtaccatatgtgaatgaatgtgcctgtgttccagtaaaacttcatttacaaaaacaagtagcaggctggatttggtcctttggtcacagtttgccaacytctagaccagaccatggggccagaatacttgggtttgaatcttgaccctattgggtgcctttgggcaagttacttaaccattctgttactcagwtttccttatctgtaaaatattatagcatgtacttcaccaggtggttgtaaggattaaataaataaatgaatgcaatgtactttgaatagtacctggctcatatagtagatactagatagaagtacttgctattgccaggtgtggtggctcacacctgtaatcccaatatcttggcagggggaggtgggcgcatcacctgaggtcgggttcgagaccagcctggccaacatggtgaaaccccatctctactaaaaatacaaaaaaaatttagctgaatgtgggcacacgcttgtaatcccagctactcaggatgctgagtcaggagaattgcttgaacccgggaggcagatgttgcagtgagcggagatcctgccactgcacttcagcctgggtgacggagtgagatttcatctaaaaaaaaaaaagtacttgttactatgtttacggttgttatcactactattattattttgagatggagtctcactgtgtctcccaggatggagtgcagtggtgcagtctcggctcactgtaacctccacctcctgggttcaagtgattccagcgccccgagtaactgggattacaggcatgcaccaccacgcctggctaacttttgtatttttagtagagacagggtttcgccatgttagccaggctggtctcaaactcccgacttcaagtgatccacctgcctctacctcccaaagtgctgggattacaggtgtgagccaccgcacctggcctacattatcactactattttattactatccaccttgactattgctgcagcttccttattgggcttttcaccaccagtcttgcctcccttttctgcttctttttctaactgctgtttgtacccagatccccaccacgatgacttgtacctcaatgccagcagcttcctggccctgatcaatggggaaagagaccatcccaatgccacaggtgagaattcaggctcctacctgtgttgctttttctgcttctttgactccctatgtctccctctccaacctggcctgacccctgtggctgactcagcctctcttcttcccatcctacagtatggcggaagaactttctgcgtgtgggccacctggtgctgattgggggccctgatgatggtgttattactccctggcagtccaggtaataagggattttgtggcctgaagattggctaaagacatcccccaaccccagttggtctttatctcatgcctaaactggcctgctccttccactgttcagttagtgctcctccccccattcatcatgtcacccaagaccaaaacctgggagtcatatcccaaccccttgtatcaagccagtcactaagtcctgctgactcttctcctctccatccctatcaccccctcccccactttataaaaacttttaattttgaaattcttatagattcataggaaattgcaaagatagtatagcgaggcccttcacccagcttcccccagtggttgcatcctatgtaattatagcacagtatcaaaaccaggaaattcacattggttcaatgtgtgtgtgtagttttataccattttatcacatttcctaccacctctttacttacctggactattataacagcctccagctttgtcccctccatcctattccttagaaaaaaatccatggctccatggtactatgtgcttgcctgtgttataggtcaccatgtgtgatctgtaatgtcacctgagctacttgaattgctcaacaaatatttattcaacattatgggcgcaggcttgttctgggccctagggatgcagtggtaaataaaagagaagtccctaatgttatgtagcttatattctagtttgtaagatagctgatacatacatacaaatatatatgtcaggtaataaggcaggggaaaggattagaggatgtccggggcctagtttcaatagtggccgaagaagtcctcctggaaaagtcaccattcaattagagactgaaggaagtgaaggagggagttgtgctctgggtggaagaaccccccagggagaaggtctggcacctgcagaggccctgaagcacgtgtgagcaataaggaggccagcatggctagtgcacaaggagctggggagaggacaggagaggagctaaaagtggtagcaggggaccaggcatgtcaaaccttagcaggtcaaggtaaggcccttgatatttttttttcttttttttgtgataaaatatacataacataaaattgccattttaaccatttaaaaatgtacagttttgtggcattaagtatactcacatcattgtaaaaccatcacccatcagcaccatccatctccagaacttctttttccccaaactgaaaccgtatacccattaaaaaatagactgggtgtggtggctcacgcctgtaatcccagcactttgggaggccgaggcagtggatcacctgaggtcgggagttcgagactagcccgaccaacatggagaaaccctgtctgtactaaaaatacaaaactagctgggtgtggtgatgcatgcatgtaatcccagctacttgggaggctgaggcaggagaatcgcttgaacctgggaggcagaggttgcagtgagctgagattgcgccattgcactccagcctgggcaacaagagcgaaactccatctcaaaaaaaaaaaaaaaaaaaaaatatatatatatatatatatatcctcatccctatttcccgacagtcccggtaaccaggcttttgatttttttttttaaattctgagtgagatgggaaggcactggacagttttcagtgaaggcaggacatctcttaaaatattgtaataatataatagtaagtgatgagttttatgtacatcatgtcatttcacatctaccacaaccctatgaatgacagtgatagctcatggttatataacatttttaatgttccaagtcactgtttcttccttttttttttttttgagacagagttttgttcttgtcgcccaggctagagtgtaatagcacaatctcggctcactgcaacctccgcctcctgggttcaagccattctcctgcctcacctcccaagtggctgggactacaggtgcccaccaccatgcctggctaatttttagtatttctggtagagacggggtttcactgtgttagccaggatggtctcgatctcctgaccttgtgatccgcctgcttcggcctcccaaagtgttgggattacaggcgtgagccactgcgcctggccaatatatatctctctctatatatagatagatatatattttttgagttggagtcttcgctcggtcgcccaggctggagtgcagtggcgtgatctcggctcactgcaagctctgcctcccaggttcacgccattctcctgcctcagcctcctgagtcgctgggactacaggcacccgccaccacgcccggctaatttttttgtatttttagtagagacggggtttcactgtgttagccaggatggtttcgatctcctgacctcgtgatccacccgcctcggcctcccaaagtgctaggattataggcgtgagcccacgcacccggccttgcctggccaatattttttaattaaaagattttaactccatctggctgggtgcggtggctcacgcctataatcccagcactttgggaagccgaggcgggtggatcacctgaggtcaggagttcgagaacagctggctaacattgagaaaccccatctctactaaaaayacaaaaattagtgggcctggtggcgcacgcctgtagttccagctactcaggaggctgaggcaggagaacttgaaaccaggaggcggaggttgcaatgagccgacagggtgccactgcactccagcctgggtgacagagcaaggctctgtctcaaaaaaaaaagaaaaaaaggattttaagacctttctattttgaaataatttcatacttaagaaaagtttgcgcctgtaatcctagcactttgggaggccgaggcatgagcccaggggtttgagaccagcctgggcaacatggcaaaaccctgtctttacctaaaatacaaaaattagctgggcgtggtggtgtgcccttgtagtcccagctacttgggaggctgaggtacgagaattgcttgagcctaggaggccaaggctgcagtgagccgagatctcaccattgcactcctgcctgggtgacagagtaagaccctgtctcaaaaaaaaaaaaaaaagttaccaaaatagcaaaaagcagtcatttatactcctcacctagatttcgcaaatgttaacattttgtcatgtttacattaatatcttttttctctaaatatatatacatttatttatatacgttaatgttatatttaaatataaacatagattcaaattttcctgaatatgcgctcacagattattcaaatttttccaactgtccttacagaaaaaaatatacagtggaagatccaaatcaggatcttgagttgcatgatcttgttacgtctctttagtatctttttgtttgtttgtttgtttgagttggagtttcactcttgttgcccaggctggagtgcaatggcaaatctcggcccactgcaacctccgcctgccaggttcaagtgattctcctgtcttagcctcctgagtagctgggattataggcgcccaccaccatgcccaactaattttgtatttttagtagagacggggtttctccatgttggccaggctggtcttgaactcctgacctcaggtgatccaccctccttggtctcccaaagtgctgggattacaggcatgagccaccacacctggcctyttttttttttttttttgagacaaagtctcactctgtcgccaggctggagtgcagtggcgccatcccggctcactgcaacctttgcgtcccagaatcaagcaattctcctgcctctgcctcctgagtagctgggattacaggcgyccaccacgcccagctaattttgtatttttagtagagacagggtttctccgtgttggccaggctggtctcgaattcctgacctcagatgatccaccctcctcggcctcccaaagtgctgggattacaggcttgagccaccacgcccagctaattttgtatttttagtagagatggggtttcaccacgttggccaggctggtcttgaactcccgacctcaggtgatccgccggccttggcctcccaaagtgctgggattacaggtgtgagccacctcgcccggccagtaatgcatttttgatggggtttctacagaagtgaggtcgtatcttcagtgtatcacctcatgaagtacattatatccagtaaggtagttttgagtgtcctccctgctacctgtctccccagtaggccttgggttcctttgggaccttagcccaccttgatttcttcctttcttttttccttttcttttttctttcctttttcctttcctttcctttttgagatggggtcccgctctgtcacccaggctgaagtgcagtggtgcgatctcgactcaatgcaacctccacctcccgggttcaagtaattatcctgcctcagcctcttgggtagctgggcttgcaggcatctgccaccatgcccagctaatttttgtatttttagtagagatggggtttcaccattttggtcaggctggtcttgaactcctggcctcaggtgatttgccctccttggcctcccaaagtgctgcaattacaggcgtgtgccactgcgcccggccagattttctccagctcttctgataacctccccscaaatctctttgtagcttctttggtttctatgatgcaaatgagaccgtcctggagatggaggagcaactggtgagccccctgggattacttccccttctagccgctgtcccaccttattccagagccctctctgtgactcctgagctgaagggttcaccctgtggggaggaggtccaggatcccagcagtaactcactttgtctctccttgtgtctctcttccatrcttccacgccccttcgaccaccttgaaggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtgacttggctcatttccaggtggaggggacctggctccccaaggagggtgggggyggagcctgaggcctgggtgcccagatgcctggtctagggtggggacccccttggtgtttccgctctctctcaatgcccattctttgtgggttcctggttctctgcgggttctttcctgctgaagacaattctcttcctctcccagtccccaagactggggggttaagctcagggctccagtggtttgggcctcagcctcatgggtggaatgcgcctgccacccccaggctagacgagggggcagagggtcagggtgggcattcgttgtgccgcttttgagctttgtgggccagagctgggtgtagggctggacaatgagcctcctcttccttgaaagaaggaattttggctgagacaatagggccctgtctgttctggcatggggggtggtggctgactcaattctgttccccctaagccctaacaaatgtcatgaagagaggggggcagttttccccttggtgccctgggctgcccccctgcccctttgtgacgacttgcccttctagctttcctcagctgatcttgctttttctcccataacctgaactgctttgttccctgcagctggttctctccctgccccctaactctcccctagtctgttttgggttcaagggggtactggtggtgttacagagctcatagcttctgatctggggagtccagaaataggggcctcagagggttggaaagatacttctagggagccctttgctggggtggggatgagggtagtgggacttgaccctactgagctgaccctgctggagctaaggaggaggcttgtgggagggggcaggaatgggaggactctctggcccagcccctcctctccttcttagcctgccaggcccacccaccagtctgagctgcttctgctgaggctggtctgcttgaagcctcccaggagaaagaagccaggtgggaatggagagagagaggaaggcaagtggggagagaatttcaaatggggaaagagtggggtttactcagagccttagggtgggcatgagttgcggggtgttttgttggagcaagggatgtgcatttagggcgttatgtgacggtgtgggtatatgaggggagtagcagtgtgtgaaaggtgtggagtttccaggtgcttggtttgtgtgtacggtgtgaaggtatatagctaggggttttttttgtttgtttgttttgtttgtttttttgagacggagtcttgctctgtygcccaggctagagtgcagtggcatgatcttggttcactgcaacctctgcctccagggttcaagggattctcctgcctcagcttcccgagtagctgggattacaggcgtccaccactgcgcctggctaattttttgtattttttagtagagatggggtttcaccatcttggccaggctggtctcgaactcctgacctcatgatccacccacctcagcctcccaaagtgctgggattacaggtgtgagccaccgcgcccaaccagctagggttttgaaggtatgaagttataagagggcatgttaaagacaggagggttggccaggcatggtggctcacacctgtaatcccagcactttgggaggccaaggcaggcggatcacctgaagtcgggagttcgagaccagcctgaccaacatggagaaaccccgtctctactaaaaatacaaaacaaaattagccgggcgtggtggcaggcgcctgtagtcccagctactcgggaggctgaggcaggagaatggcatgaacccgggaggcggagcttgcagcaagccgagatcgcaccactgcactccagccagggtgacagcgagactccgtctcaaaaaacaacaacaaaaaaaaaaccaaaaaaaaaaaaccctagctatataccctcacaccctacaaaacaaaacaaaacaaaattagccaggcgtggtggcgcatgcctgtaatcccagctatttgggaggctgaggcaggagaatcacttgaacctggggggcggaggtcgtgcggtgaggcaagaacatgccattgcattccagcctgggtagtaagagcgaaactccttctcaaaaacaaaaacaaaaaaaaacccaaaaaaagacaggagggtcataaggggagggttgactgtgtgtccctccaggttgtgcagaggggattagaagtaagtaggttagaggggaggtggagggagtgtgctggggtgtgagcttttatgatgctgaaaggatcatgatatgctaaggacaggatagtgttgggttgtacacacaggtgtaggcaatcctggtggctagtatgtaaaagtgaatgtcctgactcccttagagggtacctgcagagtgcccttggagggactagtgctggagaaattaataggagaggggacgggcatccattaaccttttcttgcctgcagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggtgagggatggggagatgggaccccaagaaccccaactaggacccgtactcagggtcctgagccgggcgctgtgttccaggaccatgtaccgcgttatgtggcgggaggtgargcgggaggttcagcagacccatgcagtgtgctgccagggctggaagaagcggcacccgggggcgctcacctgtgaaggtgaggctgggtcttccgggccttgcgggaggcgcgccccacggagctggggagctgggtcgtcggttygagtctgaaccccacttcctctgtcctcagccatctgcgccaagccttgcctgaacggaggcgtctgcgttaggcctgaccagtgcgagtgcgcccccggctggggagggaagcactgtcatgtgggtgagtcagcttgtcctccccacctacccaggtgcttgccccygcyccctctctcagccccttccttttttcggtaactagacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccggtgagtgggcaggagtacgggccacccgagggactcgggacgggcgtccgggctcgggtagtggtcacactcttggtctcctttgtccctagttcgggaggmrgaaaaagatgagcgcgctctgaagcaggagattcacgagctgcgagggcgcctggagcggctggagcaggtgagccaagcctgctgggtggggcgaggccagacgtcactgtcaataccctgaggsatctcttcctttctagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgtgagtcctcacactcctcccgccttgacttctattccccaactttccccaagacccctctccattcaggcattccctctttcctccaagcccctctccaacattcactatcctcatgcctctccactttaccatcgttctcttctgaaatcctgtccccagcccaacagtttcacttattgtttggtgagagtggcagtgtagtccactccaggctgaccacagccactgtgtctgccatgtcattaaccaggctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggtgagatggtgcagcagggctgcagggggctgggtggggtcatgtccactgaagaactgtactatggggacagaaaaccagaaatgtggagactgaactggtatcccagagagtgcacgaccctgggcatctgggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgggggggatttgttccaaagaatggatgagtccactggccaatgtggggtagaggggtagagaagaccacataggaagagactccactggggatggaatgttcccctcccttgtgtaggctgagtcactggagatgagggggaggcaactgtcccacagacaagacagtaggaggtgggggtcaagagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgggaggagagctcagagccagggttcacccaccgcccccaggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacaggtggggcccagcttccgagtgatactcttcctcaacctttcagttctcttcccccaaccctggacaaccatccctgggcttgccagctgccacttctgaggcccttctcctatacaaagccttctccaatccccagttcagacatctcctcagcacccctccagcccccctcctctgggtttggcatttactgctgaatgagtgttattcattacagctttgtgcacacaggccttatctttcctgttaagattagtaacagcctctcttggtgggaccaagtgctacccatctggcagggtatggtgggtgcttagtaaagacttattggctgatgtggggttagactagatgactgtgtagacatctcatggctctgacactgaatgatccccctgcctcacagggatgtcctcccagcctctccggacacaccctaccccagaactgctcaaagccctcacccgaggtgaagcgacgctccttcttgcagtagaagtcttggtaggaggacatgactatggggacaatgggaacctggggaagggttaaagcaggtcagtccacagctctcttcagagactcctacaataagcccctgcccagagatgagggaatggtgggggttggcagctgagtagcagaacgaagagcagtagtcacctgggcctgcactgcaagatggaaggcgccacgtttgaagggcagcatggagccattgtggtttctcgttccctcaggaaacacccagaccctcacctgggggagaaagagggtcaaagaagacaaatacatatggaggagtcagaataggtgtgatgttataatgggacctttgaggcccactggccctgcatatcagtttatttacaactgttctactctgtatccctccaatcccccatttccccaggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaccctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggtaggcaaggcacagaaggcagggctgggggctggtgctatgaggacaagggcctgagacacaaactggggcaggggtctcattgaaaccttcccaggaaggctctctaggatgagggtggtggagaaagagctcaggactgctctcccaccactcttcccaaaggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtgagatatccattactaatcttttatgctgactacattttgaaattataatcttgggccgggcgcagtggctcacgcctgtaatcccagcactttgggaagccgaggtgggcagatcacgaggtcaggagttcaggaccagcctgaccaacatggtgaaaccccgtctctactaaaaatacaaaaattagccgggcctgttggcgcatgcctttaatcccagctactcgggaggctgaggcaggagaatcgcttgaatccgggaggcggaggttgcagtgagccaagatcacgccactgcactctagcctgggcaatggagtgagactccatttccaaaaaaaaaaaaagaaattataatcttttggatgttatcagattcaagaaaatatattactaaaattaatttcactctttttgccttgtaaaaatgtggctaccataaaaaaattacattgtggcttgcattatatttctgtagaacagtactggtctatacattaagttaaactcttaaaatgatgcatatgatagtctagaaagtactattactatttacattttataggaaataggcccagggaggctaaataacttacctgaggtcatacagctcctaaacagcagtttctaggttaaatctaagccgcctgtgttcctaaccactccattacgctgacactggtatgtattgcatatatatatacgaacacagcacacagcatatatggtgattgtgacagaacactcacagccatatacccaagggccaaatggcaagattaaaagttcgtgtcactaatgccaacagacacacagtcatacaaagactaacatgttcacacatagacacaaatttataattacacccagtgacagataaaagaatgtaaatgcataactagaaaaatccctctccacccaggcagctcccctattcctaggtaaacttatggacatacctggaatagctacaaagaccaatcctacctccagacaggcaaacgaatcctactaccctttcccttccttctagtgacactttgcgtgggcaggtacagtgtgtgaggcctcaccaagtgaaaaaaggagggaatggagtaaaggtgacctaacagcacttgccctgggagaggaaagggctcaagaggaagagaggcaggaacacagaacctgtgttctaggttcttcctccttcctccactctgccccagtgttgggggcagggtaacaattcacaaaaagggtgttcaggcaaatacctgtcattcctactgaggccacaggcactgtcttcccatgatgggaagggctatgctcaaaggtaagcctattgccaagcgagaaggtaacaggcaatagaggaaacaggagaccctgccagttggaataccgtaggctttctgagctgctccatcccactgcccctacaagttcagaacagcatcatttctcccctgaactatgtggagtaggctcccaactccctccaatccatcttccacgtagcaaccacagagatttttctgttagcacagatttttctgaaacacagagcatttccctgtcttgcctaaaggctcttcttgataagttgacttctgcttacatcttcgaccacatcctcacaaaactctttgttccagtcaaactgattcacttcagttcctcagacaccatgatctttcatgcttccccaccttgaacatgctgttccctttggctggaatgcctgtctcttctcctgcctcacacagctcagtgtcaccttttggagggctgcctgaacccctccaggcctgtgctttccttacacttttatcttgatcagcgggtctcgaagtatagaaatgcaaattattagacttcaccccagatctactgaatcagaaattctgggcattaggtccagcaatctgtttttctttttctcactctgtcactcaggctggttttgaactcctggactcacgcgatcctcctgcctcagccttccaaactgttgggattacaggtgtgagccatcgtggctggctagcaatctgtatttcaacaagccctctggtgagtctgatgtgcgcctgaatttaagaaccactgatcttgacaacacactatgtgttgactggcatttttgtttccctccttaggctgtaagcagcttaaggacagggactctgtcttatctccagtgccaggacaataggagatggagtaggtgctcaataaacacttgctgaacagattctaaggctgtatacccacccatagagccacagttaatgacagagatggcggttctgatcacaaattagatagttatcctcttgagtagaagtgactactaaaagaagtcactgagaaagtaacgaacacaccaagcctaatggtaaccgactctgaatagatacatgcaatacatagccataatgaaggcagagtaacaataatcaggaagaggtcatctcacaagagaaatgtaccgaatgggatcaagatgccacagggaaagatgctgctctcatcaaatgtgtgccaacagtgcaaagaatggaggataatgtccataaataaataccaacaatggggttcacagcaggattgaccctgtgacatgcattgagctcatggacacagactgtacacagccactggaaagataatgtttgtgtagagaggtatgggccagggaggtcaccaaggtaaggcatgcagggatggttctttgcagacctggagacccagttaccttcttctcttaacacttgatattaagtgaccctctttggagaacaaaagtccaaggatttagaaatgcaatggagggccaaatttaatgagcatacggctcacaaaatatactgatgacaaatttataacacacattctatggtcctgttacatcagtgtatcatgcaaaggcgcatacacatgtgttctgtgaactgtgactgggaaaacacagcaaacaggccaattcagtcagacatcagagtgtggggtattcagccaagccatgggatcccacacatgaagactactgcaaatggtaggaccatggacatgtcagccaaagcaaaataaggtatataaccttcacatgctgaaataaacatgccaaaacataaaatgtgcaagtaacatgaaattatagaacaggtgcaatatatgaaaactcacacacatgcggtacttaaaacatgtcaaaactggatgtgagacatggacacaagaatgaagaatgggcaattctgatagaaaataacacaccatttctacacagcctatggatagcattgggacaacctagttgcacacaagccattaaacatgtcaaaggcacacagactcaatgtagaaaacatggctcccataaggcatttgtgtgtcagtaagggtctagcagtgtggaaggccactgagaaacaagaggtcctgtgc

SEQ ID NO: 10645 - DNA, 14788 bp, Homo sapiens
cattttgaaattataatcttgggccgggcgcagtggctcacgcctgtaatcccagcactttgggaagccgaggtgggcagatcacgaggtcaggagttcaggaccagcctgaccaacatggtgaaaccccgtctctactaaaaatacaaaaattagccgggcctgttggcgcatgcctttaatcccagctactcgggaggctgaggcaggagaatcgcttgaatccgggaggcggaggttgcagtgagccaagatcacgccactgcactctagcctgggcaatggagtgagactccatttccaaaaaaaaaaaaagaaattataatcttttggatgttatcagattcaagaaaatatattactaaaattaatttcactctttttgccttgtaaaaatgtggctaccataaaaaaattacattgtggcttgcattatatttctgtagaacagtactggtctatacattaagttaaactcttaaaatgatgcatatgatagtctagaaagtactattactatttacattttataggaaataggcccagggaggctaaataacttacctgaggtcatacagctcctaaacagcagtttctaggttaaatctaagccgcctgtgttcctaaccactccattacgctgacactggtatgtattgcatatatatatacgaacacagcacacagcatatatggtgattgtgacagaacactcacagccatatacccaagggccaaatggcaagattaaaagttcgtgtcactaatgccaacagacacacagtcatacaaagactaacatgttcacacatagacacaaatttataattacacccagtgacagataaaagaatgtaaatgcataactagaaaaatccctctccacccaggcagctcccctattcctaggtaaacttatggacatacctggaatagctacaaagaccaatcctacctccagacaggcaaacgaatcctactaccctttcccttccttctagtgacactttgcgtgggcaggtacagtgtgtgaggcctcaccaagtgaaaaaaggagggaatggagtaaaggtgacctaacagcacttgccctgggagaggaaagggctcaagaggaagagaggcaggaacacagaacctgtgttctaggttcttcctccttcctccactctgccccagtgttgggggcagggtaacaattcacaaaaagggtgttcaggcaaatacctgtcattcctactgaggccacaggcactgtcttcccatgatgggaagggctatgctcaaaggtaagcctattgccaagcgagaaggtaacaggcaatagaggaaacaggagaccctgccagttggaataccgtaggctttctgagctgctccatcccactgcccctacaagttcagaacagcatcatttctcccctgaactatgtggagtaggctcccaactccctccaatccatcttccacgtagcaaccacagagatttttctgttagcacagatttttctgaaacacagagcatttccctgtcttgcctaaaggctcttcttgataagttgacttctgcttacatcttcgaccacatcctcacaaaactctttgttccagtcaaactgattcacttcagttcctcagacaccatgatctttcatgcttccccaccttgaacatgctgttccctttggctggaatgcctgtctcttctcctgcctcacacagctcagtgtcaccttttggagggctgcctgaacccctccaggcctgtgctttccttacacttttatcttgatcagcgggtctcgaagtatagaaatgcaaattattagacttcaccccagatctactgaatcagaaattctgggcattaggtccagcaatctgtttttctttttctcactctgtcactcaggctggttttgaactcctggactcacgcgatcctcctgcctcagccttccaaactgttgggattacaggtgtgagccatcgtggctggctagcaatctgtatttcaacaagccctctggtgagtctgatgtgcgcctgaatttaagaaccactgatcttgacaacacactatgtgttgactggcatttttgtttccctccttaggctgtaagcagcttaaggacagggactctgtcttatctccagtgccaggacaataggagatggagtaggtgctcaataaacacttgctgaacagattctaaggctgtatacccacccatagagccacagttaatgacagagatggcggttctgatcacaaattagatagttatcctcttgagtagaagtgactactaaaagaagtcactgagaaagtaacgaacacaccaagcctaatggtaaccgactctgaatagatacatgcaatacatagccataatgaaggcagagtaacaataatcaggaagaggtcatctcacaagagaaatgtaccgaatgggatcaagatgccacagggaaagatgctgctctcatcaaatgtgtgccaacagtgcaaagaatggaggataatgtccataaataaataccaacaatggggttcacagcaggattgaccctgtgacatgcattgagctcatggacacagactgtacacagccactggaaagataatgtttgtgtagagaggtatgggccagggaggtcaccaaggtaaggcatgcagggatggttctttgcagacctggagacccagttaccttcttctcttaacacttgatattaagtgaccctctttggagaacaaaagtccaaggatttagaaatgcaatggagggccaaatttaatgagcatacggctcacaaaatatactgatgacaaatttataacacacattctatggtcctgttacatcagtgtatcatgcaaaggcgcatacacatgtgttctgtgaactgtgactgggaaaacacagcaaacaggccaattcagtcagacatcagagtgtggggtattcagccaagccatgggatcccacacatgaagactactgcaaatggtaggaccatggacatgtcagccaaagcaaaataaggtatataaccttcacatgctgaaataaacatgccaaaacataaaatgtgcaagtaacatgaaattatagaacaggtgcaatatatgaaaactcacacacatgcggtacttaaaacatgtcaaaactggatgtgagacatggacacaagaatgaagaatgggcaattctgatagaaaataacacaccatttctacacagcctatggatagcattgggacaacctagttgcacacaagccattaaacatgtcaaaggcacacagactcaatgtagaaaacatggctcccataaggcatttgtgtgtcagtaagggtctagcagtgtggaaggccactgagaaacaagaggtcctgtgcctagatggaaacagaggcacctaagggtattcctaagaggcaaattctgctggccttctcccctcatgacccttcaagagtcatgtggggtcaaagggcaagaaaaggaattggggaaggtgtagggaattccctctccaggattccctgtgcacgctcccagtcccaaattcacaagggtttccatttctcctccctcccaggtctcttccatccttcctccctctcaggtcccctctcctatccccagcaaccctcttcccagtcggcccctctcctttccccagcaaccctctcccccagtcggccctcccagacccaatctctccccttcccctcatcctagtcgctttcagcaccctcttccctcctcctcccatccctttcccgcccacacctcagaggggtagggggcctggggggctggccccctccccagccaggctgcggcagcggtggtggcggatggctgtgtctctgtctctgtcggggtgtcggtgccaagggggcgacgggatttgggggtgtcctagccccggccgatggaggggaggtgggagtgggaggttgggcccatagcggtaggaatggtggggggctgtccccccagcaccctccctccctccctttctgctgtctctctgagggctggggctgctgccgccgctattcccccgccacccctccccaacgcctgctggtttccggggccggccaggaagtggagggcggtgatgggcagcctgttttgccaatcgtctcccagaaactctggcatctcctccccacatctaccagtgtcctcttgcgagccccgccccagggctctccctcggtctttgcccccatctctggctccagctgcatcttttttttctctaactccctttcagctctggatcccctggtgctgtattcctccttccgcacattccttcctttattctccatcagctctcttttaactgccacttttacttggtctctttttttctcaactccggttatctgctgcttattccccccaactattcttaaggaccccttttcccgtacccattcaattctaaacatttatcaagcatctacctaccatatgacaagcattaagttcacctctcttctttttctctccaggactccatctcactccatctcactctccagtcctctggtctggtttcctttgccctttgtccctcactatctcccagcagtccagctcccccctccacctgccttctctggcctttaaagagaagagatctctttggccttatccctgaccctttccttttccatgctcttttacctctgtaccttttctttcctacttccttcgtatcagtctccttacttgcccaagctgagacaaccccttctcacaacatacaatatgggtacatcttttcttccaatggaaatttggcttcaggggtgctttctagaaaaataaaaagtgaggaagaatgccgattcctctggaatgcgcgtgcctccttaatttggtagccatgtatctagttttccaccccctcttctcttcctccactcccattatccctttactaggatcattccatcacttcactctccttcatttccacctttccctctcaatatcttccttcctaaacctcaagcttcctgaatcctcatctgccccagtccttctttacgcaactgctaacttctcatctttccttactcttgagtcacatgggatcttttatcaaggtcccccctctagccacacctttaccctgcattagtttacatgccctcgggaagaggattggtagtgggaggactgttacctaattctgctcctttagtcacagtgagggtcagtgattgtaggaaaagcccaaactccccggggtccaacctgggaagaagaccctatttctgatgggcaaattataaagaggaaagggcgggtctagcctccgcgggtctccttaaaaggggcgggctttgtcccttttgcaccactcacaaaggggttgagcccagagctttcctgctctgaaggtttaaaacggagttgaagtcaatcctgttctactctgtgtacaacattaagaaaggggtgggcctttagttcagttttgctctgtaaatcacctaatatggggagggctgagtcgtccagccgaatgagttgggttaacaccagcgccgcagatcgatgttcccactatccaaacgtcgggctaatcccagttctgctcccttaactaaaagggaggggcagacccaagttctgctctctacgtcaccaaaggaggttggagccattttgaaccctgcgaccctagtgttttccctcttttcctagctcttcgccgtctttcccgatgtcggccaatcaggggaaaaggaaaaggcccaatcagcagaaagtccacagctgaaggacccggatgaagcgagcctaggactttgaagtgcaagcctcgccaattgtagagcagtcaccatggcgacaagataggggtgaagaggtggaacaagagaaggttaaaccctcacaggattggcccacccccgtcccgccgcgtgctgcgcaggcgcgttttacctaaccaccattttccgkcaagttttagccaatgagttgatttggagccatacgctccaaagtccaatagcaatccggacattctctaraagaggaagcgaaggaaagaaaggggcttatagtgggcgaggtctataggtagtcccgagcaaattgcttatggctttggttatgactgacaactactcagacgaataaagccctccttggccaggsgacagsgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactggtgagaatcgaggaggggggcgggaggtggtgggtctcgcttatatactggagaggctaggagmgaataatcatacagtcatacagataatcggagggcacgttcccataggtgaagcccgacaggagacataagactttgctggtatgtgtgggtgggagtataacggtcgagatctgtggaaagaaaggtcttaggaaccaggagctgaggcacgtgatgtgctgagaagagaaggtggggcggggartggcaggacaatgtgagacccgagccaccttaccccagagaagtgaggggtcttagctgtgcaggtggaaacaagtgagacacaaaggttaagggaggcacgcatcagttgagtcggggagaaccaggaaatatggatcacattcagatgagatctgggagggggctggtataagggcactgtggagaggcagacttgaaaggttaaagggtcataaagatagggacattattgagcttgaaagtgagtaatgggggaatgtgctagtaaaggggtttggtttggagtgatggggttggggttgaaaagaggagacccrgaaagaggtggctgaaggaaattagaaattaacttgaaaggcagaaaagagagggcacgaaaatttgtaygtgtttgttggggagaggagaaaggagagggttgagtgtgttgaggatggacagagctttaggtgttggaagatcagacaagcaggaaggctaactaagttggctggcatggtagaggttgcagaaaatctgaaaagcaacagcaggttgcttgggaagaggggttagatgggattctgcgaagtctagggtctgtgtctctcttttctgtagctagtttgacctttttttttttttctcccccatccagttggccatgtcttcatcaggtgcgtactcaggagatgaagagggaaatggggaggtctgaggagctgtaagaccctcttgtatactggaaaccaccttttttctccccagtggctggagacacggccagaacggcaagagtgtccagtatgtaaagctggkatcagcagagagaaggttgtcccgctttatgggcgagggagccagaagccccaggatcccaggtgagagactggaggtgttgcttagggaagattgaaggcttctgcccttggaaaacggtgtggaagatgggaggagaaaaatccctgttaactttctctctccacttcctcagattraaaactccaccccgcccccagggccagagaccagctccrgagagcagaggggtgagtcttcttgtccagttgtgtcccttccttgacagatttgccggcttccygtctgactttttctgcctccctagggattccagccatttggtgataccgggggcttccacttctcatttggtgttggtgcttttccctttggctttttcaccaccgtcttcaatgcccatgagcctttccgccggggtacaggtaagagtcacactcagctcccatsagggagccctgtgaatcccctcaggccccctcccagcctaggagcatatgcttccacagctttcctctctcccacaggtgtggatctgggacagggtcacccrgcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttsatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatatattgatgggatctcttcccaagttcgcccccacccccgacagaagcatcttctccccaacttgagtagatgtttggtatagtatggtgaagtatgggggtgagtccctttccttcagggccctcaagggtataggggtgaggttgtgtctcatacacacacacagacacacaagagcaagatgtgtcaggtgtttaatcatcattgtggggggctctggttgtagaagaaagcttggcaaggtggggttatacaggagagagattatacaggagagagttggtctgaggccagaacagttcaagggaaaaagaaaagggagctgatggatgggatctgtctgtgggcccctcaaggccctccagtactactctcgcctgcctcaggttcctccgactgattcagttctgcacgctcctcctcttcctcctggttttctggggccttcctgaggagaaagattggggggaatgcggcacgttgtcgttccaccccccgacccctcttcgcttgctgcctggaagccctaggtctgaggggtctggctttctccactcacctctcctctcctcggcgttgccgcctttgccacaagatgaccccaatgagcagggcggctgtccccaggcctcccaggatccccagggccagggctagagttcccagccctgatcctcccacagagcctgtacggagacagggaaaattgagagcacagccaccaccactcaccattcctttcttgttgaccatccccccagtcacatgtgttgggggctatcttctgcttccctgactttatcaaacccctcacctgcagttggcccctcctcgcctggttctggaagacaaagttggatccagtcagaaaggaagacttcgggttgagagagggttatttagtgggagccccagtggagtctttccctttctttttttttttgagatggagtttcacttttgttgcccaggctggcatgcaatggtgcgatcttggctcatcgcaatctatgcctcctgggttcaagcaattctcctgcctcagcctctcaagtagctggcctcccaggtagctgggattacaggcatgtgccaccatgcctggctaattttgtatttttagtagaaatggggtttctccatgttggtcaggctggtctcgaactccctacctcaggtgatctgcccgcctcagcctcccaaagtgttgggattacaggcgtgagccaccgcgcccagccgtctgttcctttttttagctcagagggaagaagggagaggcttggctgctctcttggcagaatttgggtggggcaggggaggcttgggtgtgggtgcatggagggagaggtggggtggctgttagggataaggccagaatggggcaggaaattagagcctgtgctgtcctgcaccctagtcccagggtctgtagggcttggggagaggtctcaccgatgatgctgatgctgacagcacggctttcctggggcccgtggctggaatgggtggccacacagctgtaggttccctggtcctgaggccctatctcagggaggatcagcacagggctggggggaaggggcaagggcacaccctggtgggggaaggggagaggagactatttcaaaacccttgtctttttgtctccatatcttcagataccctctcttcctcctcagctcctagcctgcctttccctcgttagccctctgccctccctgttgctagttatggttcaccctacctcccagcccctctctccaggtcactcacatccttcatccagtggatttgaggagagggctgggcagggacttcacaggtcagggttacggttccaccaggagctactgctccaccttctggctccaccaccaattggacctcctccagaggcacaggctctgggagttggaagggttttgaggtggagagttacacttgtgagtgatcccagtggccatgggcttgactccctctttccctaagggtcagacttccagaacgtgctcacgtgagcttggggccctccccacctatgctcaccccagacacggggctggatgggggctgtgcgcaaggcccggtgtcggggaaggcctgggctgaagctacaggagaaggtgggacggggatctcctccccgggctggggtcaccattagctccgactgcagtgtgaagagccctgtctcagggtgtctcctggtctgttccttcacagatactcctatgatgggaggataagacaaattatcccagggtgggtgtgggagtgagatcagggagaaggcagcttggggggcaccttaggactcacccttctcattaggcaccaggggcttcccatccaagtgccagctaagagtccctgcagggtagcttccctctgacacacatgtccccacctggggaaagagtggtgacctcagaatcctttgaaaatgagagatgccacacacccacacccacacacactcgcctcctgttcacagggccgttttctacttctcctgctttcttccactaccttattgggaacaccagccgtgagttcagaggcagaatctacaatttctggcttcccaggaatctctgaaggaggaaaaatccagtcagaggctgtaattgtgaaggttctcaaactctgtgtgtggaaatgaggccagtggaagtcagaggccctcatgggccaaggctggggttgaaggctttttcttaggtaagagggaggccttggagaagaccctggaattcttacggtagacacggactcggtagttggacttggtctcctttccattcctgttcattgcctggcaccggaaaatcccctcatcctggatcccgacagccggaaggaagagggagccgttgggaaggacacgagccacactgtcccaggggcctcctccctggggagacaggaccttccaagcttctgtccggcctgtgttctagaagcagagaagcagggcctaaacagtgcaaggcctttgggaaaggactgtgaggcagagtgacggggatccaaatcattgctggtctccctggaagttgggaggctgcaacaggagccccgcttaccagtttccattccagccgctggggtggtttcttgggggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtggggttgagggagtggctcaccccacagactgaggaccagcacccaggctccaactgctgttccggctgccatcctgcttccttccagggtcctggctctgtctgcccctctccctgctgtggcctccgccctaggtggggcctgcaccctctctccagcccccatctttcagtcgtcttgtcacagggaatgctaggaattcatgcctttgggacaagagtccttcaggtactagagaaataattatcaccccacccctgggtactaccagcctctgggtacagtcacttccctgggggatggggagtgtaccctctagggtctcattccctcagagcccccgatcctatttattccatcagtccatcagggctgcctggtgacccactggagccccatcttgattgcgcaaagttgcatcaatagggttcaggccagactgttgtctgcaagggtgcaattgggcctgcatcatgaaggcaaggctggggaacaggagagaaacctgtttggaacttcgtgaaagaaaatcattttttttctggggtttctcatgttttttgaaaaaaattctcaactaaacccagggaaaaaagaaatttctttatttaaaactgcattttgttttttttctgtgaaactacacaagtttacaagtgaggagagaactgcccccggcccatgcctcccacccccccacccatcacacttccaacctgtccccagtcctgcccggatctttaatgggaggggttccccactctgacagtcttgtaaaatcctgagaatgtctgaggggatcagatggtagctagttcagggctgaggatgggacagtgttgatgttacttttcccccacatctggctttttgcaacctcctccctctccctaccccttgattttggtgtgacaaaaagatacctcatttatggggaaattgaggaagatacatatacaagcaccccaacccatatttaacatatttggcaataactcccttcccattcttccccctccaattttcaaatagtagttttttaaaaaattaaagacatgtcactcacaggggaagatggcatcttcaatttcctcaaaattactgagtccagccctgcccaagggttgtgggaagaagggggatgagaggccagcagggcaagcccttcactgcctccacatcaaatgcggcagaaacctgcctgcatgaacaaagaacacctaagggattttagggggcaaagcttggtgccctgtaaaatttacttcctgatggacaggcctggagccaggggggcctctttaccagttctgtttgtccccctttctcttaccagaacccctttggctatcacccctaatatgggaaagtaagaaataaaaaaaaaagacaagaaatcaacatatttataaaaaaaaaaacaagctacttccccaaactaaattaaaaattaagaaccaccaccaccaccaccaccaacaacaacaaaaacaacaacaacaacaaaaaaaacagatggatcccagggtttctttttctttctttaaaaaaaaaaaagttcaaccccaaagcccagtcaataattccctaaagtagcagaaactccctccgaggtagatatctgagtcagacactctcgtccaccgagcgattctattggtttaagatgagctgcgtatgaggtaagtaagccgtccggaggggcgggggtggggatgcatgggggcgtggcccatgtcctctgtccagaagtcatgtccccatttttggcatctctgattgggcagggctggcgtctccacagattccagagcatacaagtggggtggggaagggaaagtgggggagcccaggagagaaacagaatagttgcaagtgggagtatgtgtgtgtgaggtgtgggagagggagagagaaagacagaggagaaaaaggggtctgagaaataggtttctcggtatgtgtatgtttctgtgtaagaaagaaagcgagagaggaaaaagatggaaaaaagggagagacagaccccacactccccttagaggccccattcttcctgccatgtaattagcacccccagcacagagagtctcgttagggaggggatgaccccattggcccttctctgtcttgtgcttctcctgtattggggtttgtcctctggaagcctgcgtcctcttcaagtcgccttgtgagagcccccacccctgtgaccctgaggggcaagatcagttggaggtatcagagtgaacactccctggtccctccgttggggatgtcactgaagagggggtcacagcctcttgccagctgccatttgcctgaaaggagagacagagtacagaaaacagagaaagccctgggaaccctgtgtgggcacaacattactagggaaaatgcccctctgtcctgtgagaactggacagagaggagcttcaggatccactcaccctcatttcccgtgggctgtacatctggcctcccccgaggttatccccatagccccctggccccatcgagtgtcggagtgattccacctgcaggcagcagaggaaggtatgacagtgaagagaagcctcagaggaaagaggtcttgtatcctaaagtagaggaaatggagttggggaaagccctattcgagaggagat

SEQ ID NO: 10646 - DNA, 17793 bp, Homo sapiens
  misc_feature (1)...(17793): n = A,T,C or G, or insertion/deletion polymorphism (see Tables 1-2)
atattcctcacgcctaatagcgattgattcttttcctaggagctctccaatcctaatgtacatattgtgaacgttctttgaatagatcttttcatttatttatttttagagacggggtcttgctactgagacagccaggtgggaagggrtccccagataaattccagccagcctgagcactgggaggagtgcaaactgggatggagccacagaagtttgcaccatttgcggcagggaggagagtgacccctcttctttgggtggaacgtggaattcaatctgtgaggtgggaagcccactggcagaaaaaaatgcattctctcactttgctaagagcctctgtttccccttttcttccttttcacccaatactcaaccttcaagttgtcctactcacccttcaagttgtctgtgaatgtaatttcttgtggctgtgtggcaaggacgctgtcattagctgaactaaggaaaagtcctgtaacactatgtttcccaggctggcctcaaactccttggctcaagtgatcttcctacctcagtcacctgaattgctgggagtataggcacacacctccacagtcagctgtacagttatttttacttagcattagtgattttaaaatgacaaataattttaaatggaaactttaaaagcaagtgtttatatgaaattattcatatgtatttaccaaaggtcatcatgtatatgtaaagcattttacctagaaattttaagttgtgattttgccagaacattaaaaacagaaataataacacaagaataattcaaatgttttaataactgacaactttagggaaaaatgaatccagatatgtgtgatgtttggggattttgaaaaatacctcaaacaaaagaaatattttataaattatttacaatgatacaagttgagtaaaaattattcttgctatagtatttctctaaaagtatcccattgactaaagaagattggcaaggacaatcttgcacctgagagatggtggagcttgaaaggcttacaatgggcactaaagagagaagatgggggcaggggaatgcttccactctcatttgtcctcctctccgcgcctatgcacttgagatagtcatgcattcattattatctttgagtcgtgggaatattggtgtccatgggatttttgcaccataagaaatgtaaaaggaagacctttacacggtagccatatgatatcacatagaaacctggatctatacaaagaaataaactctggaaatgaaacattttttcacatttaaaaaatggtctaaaatgaggcttctcaacctcagaactgttggcattttgtttcaggtgattattttcttgtaggaggctgccatgtgcattgcaggatgtgtaacagcacccctggcctctacccaatacatgccagtagcaccctccccagtaatgacaacaaaagtatctctagacattgtcaagcatcacttgcaggaattttctattggccccattttagaatgtctgtgttacagaatcatacgaagatactaaatcgttgttggaagtcattaagttttggaatagtttgttacatagaaaaatctgacagatacaacagtcttcaaagaagttctgtttcctagaaatctcttagtgtttctgtggctcacaggctcctatatgcctggagtgccacagggagaagcttaaatgaatgaagaaaaagtaatagtctgtcccagcccaatgtgtgatgttactatcattatcattattaatatttgtctttatgtagcagctcccacttgggaatagttgctaggtgtcagacactggcctgtatttaactgtataatttgtacttatctatcatttcatcatattaattatcttctaatagttttcatcccacattatagaaaataaccctaaggctcaggtattctgagtggtttgcccagggtgatggagctgagaaaatcaaaagcagcatggaatacatatttattttattacaaaatctataatatttttattttgctactctagactctgttattgttgtgaagcacctttaactactgcaagatagaagtctcggccttcagagtaaaatttcatcaatgtataaaattagacttaaagatagggtcttagagaatgttataactgctccttagaactaacataatttctgcctaatttcttagagggcccttaataatatcaattgtaatggcatatcccattgatattttagttacaaaatcaacggcatgtcaattagtgctttctaagaaagttattaggcaaagtagtattttgagctccaaattttattcccattattactttatgaaaaggacttttttcttttcttttcttttctttctttttttttttttttttttgagatggagtctcgccctgtcaccagactggagtgcatggagtgtagtggtgtgatctcggcttactgcaacctccgcctcccgggttcaagcgattctcctgcctcagcctcccgagtagtagctgggactacaggcgcgtgccactacacccagctaattttttttttgtttttgtttttgtttttgtagagatggggtttcaccttgttggccaggatggtctcgatctcttgaccttgtgattcgcctgcctcagcctcccaaagtactgaggaccttttctatttctacaagtaagaaattggtttctgttaaaatggtatactgttcttctgagtctaatttactgattattctatcttgcattaaaattatgacctgaaaacagaagcaaatagaacaaggttcgctatattctggctggatgaagcaggaggaggagagggacacaaaaccagttaaagatagaaagggcatctattatcttttagtcaatgacctggccttgcttggactttccctccatcccacaggatgtgagatctgagactgaacccatgacttcccttctaagatacaattctgatcccacatttaacaccctaacttcctaattagagttgagttttttaaactgtgatattaataggggaaattctggagtactatcaggaaagatttagttcatttgccaaaatcttaaggaatttctgtcagatacaaagcaggtaagtctggatacaggggaaaaaagatagaaatgtgttatttactacacagcaaagaggatgctgcacggtgaagggagcagagctcaactgcaacctccaaaaccctcttagttcacaatggcagtggctagaaagagtaataaggccacgtacagtgtcatatatctctcctaatcgtattagggcacttactcagaatccacacagaaggagacacccctcacccctcatgaggaatcatggcttgcccctgtagcatcccatctctactacttacgagccatgtgaccctgggaaaagtcctttacctctctgagttttaatgtcctccttgaaaaatgtggatgatactaaagtatgacaagtatttataaagagtaattcattccaagtgcagtatatgtacattcctcacaaccgcctaatgaggtaccatcagtgcctccggccaaagaccacgaagagcatacccttgaatgaacaagttggctttattgtccgttgcaatgatggagaaaagtcaccatggggaatcatgcagcagttcagtaagagattgttggaaccaaagaagtagaactaggagaacacatatattaagagaatgactgaaaggaattaatttgtgcaactgtgcgggtggactagggaagcctaaaacccactgggaggcagtcatcaggaaaggcaggttgaaattcttagcactggctgacgcgctgtccacagtggaatttctgtttcctcagagaagcctcagctctgctcttaagacttttcaactgcttagactaagctcacccaatttatctcagataaattcttacttaaagttaactgattatgaactttaatgacatctacaaaatatcttcacagcaacacctagattattagtgtgtgaataactggggaccacagtccagtcaacacataaaattgaccattaatcaattgtaagatttgtgcttgtgttaggtagttttgaggaggatttaagaaagagggacttcatttttaactggattctgacagaaagcagggagtggggatggcaatgctatgattgggtagcttcataaatactacctagagggacggaagactatcctgaggctacggctgtgattggtaaagaagcagcaatcactctttcgagagatgtgcctggttatttttgtagtttggacaatattcatgttttgtctgggtgcagacgtgatgactgagtggccttattttctgtctcagtccatcgcactcacagagtacctgtctgattctgatgttctatgaaattgattatcttcaacaggagaatcaaaaccagctgtgcacaccaggctagctcctagcaaccccaaggccttgttaattgcatccaggcagcccccaggtatcaggacacttttttattttacctttttttagtctctgccattgggaggcaagacaacatgctgagaatctcagaaggccattcaacaaggacagagtgattctaaatgaaacctccattactaacttgttgtttctataacatacagaaaatagattcatctgaaaaaaggtaagtttccctgtgattactacattttagctcattccctagtcccttgcaatatctgaaatcttaatgtggttggataacaaatatgaaaagatccagtagtttaagaaaagtaaacctattttctaagttaaagcaattctccttattctactctcaatatttgacttgacattcttaaatttaaaaaaaaaaattactggccgggcgcggtggctcacatctgtaatctcaggactttgggaggccgaggcaggcagatcacgaggtcaggaaatcgagaccatcctggctcacacggtgaaaccccatctctactaaaaatacaaaaaattagctgggcgcggtggcgggcgcctgtagtcccagctactcgggaggctgaggcaggagaatggcgtgaacccaggaggcagagcttgcagtgaaccgagatagcaccactgcagtccggcctgggccaaagagcgagactccgtcttaaaataaataaataaataaaataaaataaaataaattattagagtaattgagccagccaaagcttttttaatgtaatcaatgtccctaaatttcctttaaatatattcaagcagcaccgaaacacagagcataaagattactagaagcaaaagaaaaaactgtgtaaaagatcggttactgtaggcagcaccgcatgacagtctaacccctttaattgccctggtcaaaaacacctggagcttttgagaacttacccaactggatttatacaagtagaaaaggcaaaggtattgcttggctaccaccagcagagatccctaggaaggtggggtcaagtcaaaatttggggaataccatatacactatggaagcaaaaagaaaaacagctaacccacatacagaagccagagaaaggggaggggatggggactgccagggaggaaaatcacttcagggaagaattcctggagaatgtaacccagaaaaccctgaaggatgccatattattgatgaccttacctatccaagcggctgctcagaaattcccgcccctcttgacactagcagacatgcacacatgacagaagattcagatttagtatcttccctttatttatagaaaatttcctcaagaccatgctgtgtggaggatgtgtcagaaccagaggatgtccctgtcttcttccagggctcttaatataaactctgcaactggcaaacaatatgtcaccataggggatttttctgattggccaaaacctgacctggcagggtttggtttgggtgtcttcagatttgcttgtctcgaggtcctcacaattgctctacagctcagagcagcaactgctgagsctgccttgggaagaagatgatcctaaacaaagctctgctgctgggggccctcgccctgactgccgtgatgagcccctgtggaggtgaagacattgtgggtgagtncatgagtgaggaatgttctctggagctgaaaaacagnaaattaaaggaaaaganagagtgnaatttgctaagaaatagtagaaatttcccaagggtcttttcaatattaagaaattttaaaattatggcagttcctcctttaggaaaccagagctccaaccgactctctttgctacctgtgctattggagtttaccaaggacgttgttctgtttatattatatccagagactatagcctggaggtctgtgtggcattccatcatgattgcctcaaagactagggatgtttccatgaatggagtatttttttgttattaaaaatttctgaactgttactcccaaatttctctgaacaacttttgaagcttttcatatgcctcctatagcatatgttggggtagatagttccatgaagtatgtacactctatagatataaagaaagaggttcttttctttctctcagacttacatttccacatgggaattggcacaggtggggagtaggtgaaagagcccagcaggctgaatgccttcaacaatcattttaccacgtggtaaatgtggtacttactctctgctacctcatatatgtcacctcgcttatgatcaaataaaatgggcatgtagatatgctttatgaatagtaaaaacatgaatgtcaactttttttaacttattcctattacaggtataacttcgtattttttctttagcaaagtaaggaatatattttaaaactgagaactttatgataaaatgcttggtaaattaaattattttattctcaaattgtcaacccaaattacttgttcttcaccttatctaatgaagtcttataaagagaaaaatgggcaggcacagattatttggtcccttagtcccctctgcctttgtcgtccatctctttccacctctcttcatgcatccctttctccctcttccctttcaggatccatctctgactccctgctcctttacagacatgggcagtgggtttgtaaaacaaaagttggaaagtcaaatagttaaaaggggaagtgaactggaagctactcgaaacttccacaaccttattaaccatagctgctcccattctgattttgtttggcagtggaagtttcacctgcttctccagagcacttggcttttttttttcaaatctcctttcttcaacctcacaccagagtgccccggtcaggctcgacttatccattaggaacagtgtgggcagtgaaggagactctccaaactgtaaagctacaagagaacgttttaactcgttttaaaattagaagaaaaatgaagttttacagtctatgaaaatgttttaacttttttttttttttgacggagtctcgctctgtcgcccaggctgtagtgcagtggcgcgatctcggctcactgcaagctccgcctcccgggttcacgccattctcctgcctcagcctcccgagtagctgggactacaggcgcccgccaccgcgcacggctaattttttgtatttttagtagggacggggtttcaccgtgtgagccagaatggtctcgatctcctgacctcatgatccgcccgtctcaacctcccaaagtgctgggatttgtacaggcgtgatccaccgcgtccggccttaacttttaatgtagcctggattgtatttgtctttataccaatacaatcagaagctgtaattttccgtatttttatggaggaaggcgcccacaaaagcaacagtgctcggggctcacaagtcagaattcagccctgggcatccctgatcctgggctttgcgtggttctgctacctgggtgcctgtcagtcttccccaaaatctatgtaattgtcaaaaattgcaattgtcattcaatacacatgtttgagcacacaatgagctaacttttgggaattcaaagataaaaaatcatgctgtctgccttgcagagggtgcacaaaccagtgatggaaacagtatggggcacaggaaagcagaaggccctgctgagcaggacactggcccagcagaggctgaaactataaaaatgacttggttccagctgggccagtagagtgatgtcctccagcaacactragcacccaggacaagtaccagatgaaaagaaggattgcatgtattccacatatattcatgtttgaacaaggagtcaaagtttattgtaaggataaggagtctttgttggtggcctgttaagtaaccaaccagggcagtcatgctgggtagggaagaaggtgagctggaggaggaakagacaaacttggagagccagacattgagattccattgaggcgttggaggtcacaacgcggtcaaaaacatgttgagagsacttagctgcaaagttgttaactaagtagaaacctcaaggatgaattttaggatttctccaggaaatcctaaaagataacttctttcagggagaaaaaacagacccttgcaaagacatgaaaggaartgtagtttggtttgattggcagatagttgtgaagaatgtcggactgtaaggctgtcgatatcctcctcacagaaytccccaaagtacattgtatttgctcccttaccgacctgattctcccactattcagttcattccttgatgctgttttaagcaacccctgctctgtctgacacttttggatgctcagtaaatgaggaaggaaggaaggaaagataaaatggtaaagggctcacacatgtcttaacaaaaatgtccagttcggctcatttggctatacttcatggctgctgctctgccctkgcatcctcggataagctcrctgcccattagaggaaaaagggtttaatttacctgagtcctcgagtgaatgtaattgttgaatcagaacactatagayatttagtaacctccttcagaggaaaaaaaaaaaaagtgggggcaatgacagaaattaaaaaaccagtygagcttccacttttcatttcagaagaaatcaggtgctctcctctaaggaccactactattaacaaaacagagaccttagaagaattgtttatttgttataaatgtataatgttgctattcttgtaatagtctttctygtaccctataattgttagaagaaattmttttaagttaatacgttcctacatgcttttctttggtttaaaaaaaaaaraataaaggaaactctgtgtagaaagtgtcctgttctgatctagtcctgacaggaaacgaagtataatcaacttgttattaactgagagagaaaacttaggaagcagagggaaataaactgaatctctgagtaagaaaactaaatcctatgataactcattcattccttcctttgtttattgcaatattcatcataagcttatgatgtgccaggcactaagtaggcactcaggaaataacagacgtgtgacgttctgcctttgtggagcatatgttatagtgagaaagacagaatcagttctaacctgatgactaccaacgttaggcaaggaggaagcaggtgttaggaagattgttcarggactgtgccaaagatgaagcccataatatttgaaagtgagtttcttcaatcactttctgtattaaggttctttctccctgtgttccaccctcctgcttgtcaccttcactcgtcagctgaccatgttgcctcctatggtgtgaacttctaccagtctcacggtccctctggccagtacacccatgaatttgatggagaygagsagttctaygtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatggtangtgtccaccattccgcctctctttactgaaactaatctttcataccaagttttactcccttcttctcaagagatttccygatcttctcatggtaattgctgaaattttatcatctcccatctctaaaatcacatattcccatgtaatacaagggtctttccattatgtattaattcctactttattaaacatgcccacagagagaagggcacaggaataaagcagaggcaatgtgtcgttgctcccaagcagaaggtaaataagacctctttgactatcaggtggtgaaatgctggtargagggctcttccaggatgtaatgcagaagctcatggcagagctattcacacttcacatcagtgctgtttcctcaccacagaggttcctgaggtcacagtgttttccaagtttcctgtgacgctgggtcagcccaacaycctcatytgtcttgtggacaacatctttcctcctgtggtcaacatcacmtggctgagcaatgggcaskcagtcacagaaggtgtttctgagaccagcttcctctccaagagtgatcattccttcttcaagatcagttacctcaccytcctcccttctkctgakgagakttatgactgcaaggtggagcactggggcctggacsagcctcttctgaaacactggggtaargatgagttccacyacttcatgggtttctaataayagacttcactcttctccctaagcctggggccttgagtcttgcagagccagccctccaccccatcccatcccacacacatgcacatgagcacactgcacattctgacctcaacagctccactttcacagagcctgagattccagcccctatgtcagagctcacagagactttggtctgcgccctggggttgtctgtgggcctcrtgggcattgtggtgggcactgtcttcatcatccaaggcctgcgttcagttgrtgcttccagacaccaagggctcttatgaatcycatcctgaaaggaaggtaagattgagatttgttggagctgaaacctcagtatgagagggaggaaagtgggagggggttgtggacatgaatgtggttgaaagttgtaggcgaattgggaagtggcatgatgatcacacaggaggcccctcagacccatcgatctcatgtctgtcctgttgcaggtgcatcaccatctacaggagaagaagaatggacttgctaaatgacctagcaytattytctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgrgtaagccactcagctacctaattcctcaatgacctttatctaaaatctccatggaagcaataaattcccttttgatgcctctattgaatttttcccatctttcatctcagggctgactgagagcataacttagaatgggygactcttatgttttaggccaatttcatrtcattccccagatcatatttcawgtccagtaacacaggagcaaccaagtacagtgtatcctgataatttgttgatttcttaactggtgttaatatttctttcttccttttgttcctacccttggccactgccasccacccctcaattcaggtaccaacgaaccctctgcccttggctcagaatggttatagcagaaatacaaaaaaaaaaaaaaaagtctgtactaatttcaatatggctcttaaaaggaatgacagagaaataggatacaagaattttgaatctcaaaagttatcaaaagtaaaaaattttgttaccaaaagtcaaactgcattctcaaaactttaaatttgtgaagaatgacaacagtagaagctttcctctccccttctcaccttgaggagataaaaattctctaggcaggaaaagaaatggaagccagttagaaaaacattgaaataaggccaggcacggtggctcacacctataatcccaacactttgggaggccaaagtgggcagatcacttgtggtcaggacttggagaccagcctggccaacgtggttacaccctgtctctactaaaaatacaaaaattagctgggcatggtggtgggcacctgtaatcccagctactcaggaggctgaagcaggagaatcgcttgaacctgggaggtggaggttgcaataagattgtgccactgcactccagcctgggcaacagaatgaaactccatctcaaaaataaataaatacatataaataaattttttaaaaaagaaaaatattaaaataaggcaataatataagtgggtatctgaaaaggaacaaatgcttgttccttacttagggttagtgacaatggaaaacagatagaagtagaagctacagacccatttaggggccccagccccctgctcctcccccttcctggctaaggaaagcatgagcctatgagagagaaatcctaggaagaacaagacagttgagacaatgtagcagcagtagtgggtgytgtgtcctacactggattcgtggtctcctaatagaaaatctctcagaggaaatgggtccacagagacctgagggctctaaacagctatgaaatctgccaggatatttctgtccatgctatctgcatcagtgagtttaaaatgtaataggagaaaaaaaagagacaaaacrttaacataataattgatacagcatagttttgtacaaagaaacctaaatccaaatacttgactcagtattttgaagctaatattttaaactttactgggtaaagtatctgattgacatttctgaaccttatttttctcatccacaatgtgggagtgataatattttccttgcagagttattgacagaatttgaataatcttggtatatagacagtgccttacacgtagtatataaatatataagaaaacactgcagttatgtttataatggatttattaaaaagaatggatcatattatatgaaaagtacatttgttttccttagccctttagtgatttaggagattcaagcgtagacgtaaaagtgagtttcttttcatatgttaactggaggatttttttctttcttgagaggctgagattgggttgmtaagagaactcttaggacaagaagttgtaatatttgacttcggtttttaactctctaaggggtatattccctccttatggcccataaattttaagtcaaggtgaattatatgcaacagcagtttatccatatttactttggggaggaggtggggagactccgggagaaaataattataaatgcagactgggaattagtaagtgcagggaatctgaaccagtggtgatcatgaaaacgtccatcacagaacacagaggatttttagggcaatgaaactactctatttgataccacaatggtgaataaatatcattatgcgcttgcccaaatccatagaatgtacaacaccaagaatgaaccttaatataaactatggactttgggtgataatgatgtgtcagtgtaagttcataagttgtagcaaatgtacctctgtcgtggaggatgttactagtgggggaggctatgcatgtgtgggaacagagagcatatgggatacatctatctgtactctacaatttttctgggaacctaaaacttctctaaaataaactctattaaaaaaaaagaaaagaaaaggtcaacaataatgatcccaaatatataaaattaaaactgtagtataaaaatggtcacatgaaaatgcatgaatgtgctaagaacttttctgcaataggatttaaaataaattttatataaatttcaatgattcatgagccaagaacccagcattctggaggtgtgtgcatttgtgtgtgtgtgtgtgtgtgcgtgtgtgtgtgtaaggcttacattgaatggcattataaccagagtcatacagaaatacacaaatgctcccctatttagaatccttccccaagaaatactgaggaaagcaaatataatggtagttggattttactgaaagaatgtattcaaaaagtatttatataatgttaaaatagcatagttaaaattagttttataaaatagagcaaatatatctttttatcagctaaaagttcaaagtgaaatcatcattattatattattatattattattataaacagttataaatcaggctgcatgattttaaattaaatgattattaaaaattgttatctgaattatttcagattacatacataaagtatgacttcattaataggtaatatcacattgttcaaattttacaaaatttccagtcacaatggttcatgcctgtaatctcagcacaaggtgagggtcccttaaagcccaggagatggagaccagtctgtagtcccagctagtagggaggctgaggcaggaggattgctgcttgagcccaggagttcaaggctgcagtgagctaggactgactgcaccactgcactcgctccagcctgggcaacacagcgagaccccgtctctaaaaataaataaataaatgaatgaatgaataaataaaaattacaaaacgtaaaaatcacgtaaaatatttcaggtttgtacttaccacatacaaactagagatatgaagaattaaacattacaaataaagcacttcacacacagactggcccatagtaagcagtttatagaaattaacaaatttgtgttattgttattttctggagtccaagacaaaatcccatgatgaatgacaccacaaggatgtaagcaacaaaattcagaatatgagaagttctactagattaaataaaaagatttctccagcaaacaatttgcaaaaaaagttaaaaatagagaaaagaaaagctatacacttgaaaaagactgaagaaatatagtaaccaaatgctgagctttgtctagattcatattcaaacaaaacatctgttaaaaaatttatatgaggcaatcagaaaaattgacactgagtgtattaaggaattatttatctcgttttaaatgtgttagtggcattgctgttatgtttctaaaaagccattatattttagattttcataataaaaatgtataaatgaaatatgatacctaaaaatatcttcaaaataatccagtatgtgcctgtatgataactgggtgggtttacaaaattgctcatgaattgattattgttaaagcaaggctgttgatacatggaattcttctctgtactattgcacacagttgaaattttctgtaatacaaaggtttttttttttaaatgtattcaggaaagtcccataaacataggcagacaagcattctgtttgaagttatgttagtttttcagtttttctcatttttatcacatttaggaaaccctgtccaaggcctgcccaagactgtaagaacctctcaggaatgcaactgtaaagaatgtgtatgcaggaactaataataacaaaggaaagcaaagtaatgcttgctttattattggctggactaagcccccagacttgtttatatattcactaattcatcaaaaatgcaaaaatggtcattgagtaccagtgctacaataagtactcatagtttgttgaatgttattaaaataatgtgaaaacaattacattcattatcttcatagaacttacactccagtgggaggaaaatacatatattacataattccacaaacatagttacaaggtctgaaacatttataaagaaaaagaatgaggtaaaatgagagagtgttgcacagggaccaggtatgatttggggcagtttagaagtggcttgaagaaatgtatcttgagatgaaataaggtggtatacagtaggtaaaggacaaggttgaagaggccagagcaaatgtttgagaaactcttacaatatgaaagagaagatgagaataaaataacatgaaaattatcacagatttaatagagaaagttcatgtaacagcaaacaagtttaaagtcattctaattagaattcttgatctgtaaaagtaataatagaatgctaaaaacaattggaaaatttaatagaaagattggaaaattaaatcaagaaaatctcacagtaatttaaaaggcaaaaaaaaaatgtaatatatggtagaaaaaataagatggagaacagaccaaggaagtcaaacatcaagtgacaaagctagagagaccaacagggaagatgaagggagaaaatgatcagaacaaataataagggaaaattttccagatataaaggatttaattcttccatggaatagtcttgtcaggtatttagcaaaattaacagactcacttctaaatatctcattttcaaaatttcagaacttcaggtgttatagaaaagtcataaaatattccagtggcggaaaccaaaatgaaacaaactgacaacaaaaaaaatacttctattattaagataatgagaaagtccttgaagttctaaaggaaaattattttttattaataaatgtagatcttttcaaagtcacaatcaggcatggagaaagaataaaaatacctgtgaatgtgaaagaacataaaatttacctaccacgcagagttttactagaaattgactaaggatatgaccaattgagattgttaatcaggatataggaaggtaaggaatccaggaaactgggtttaacccaggatctcactgaaaagggatcctactacagcagtttcttggcaagcaaagaatacctgactacataagtgatatttagaaagtgataaactttttttttcaaatttagaattaatctgtgagcaaagcccaaggaatcttattgctacagcagaatgtcaatattttcagctttgacaatattgggggaaaaaaaaagatgtagatacttaattttggcaactggaagcgtaaaggagaggggaaagggagggtgaaaatgccaataacttcatcttccaagaaggaggggaagaggcattgcccatacttacagaagtcacaaagatcaatatatttaaattacaatcacaactggaaaaagtatgtaaaatgactcatgaattagagcaaggttttagaaattggactattatttcagttacaaaaaaaatggactgttattcttcggcctaagctattcagaagctgcaagagcccctcagagttggcccaaattagagcaggcttttatactcctatactgaccaatcattataggtgagttcctcctgggaagtggatcaaaatccgatgaggcagctttcatcaccaaaggcaattccggggcatgactgacagctgagggcagtcagccagcaacattcccagcaatgacagaataaatcgttcagtctcaaagggaggagtttaggtacagtggaacagcaccgacggcagaaacactgttctagttcctgggagtacatatacattcatgtggaagaaaacaaacagataaaattcagcatctatttaaaaattaaaaataaaactaccacatgatccagcagttccacttctgggtacatatgcaaaggaaatgaaatctgtatcaaagagatatctgcactcccgtgtttattgcagcactattcacaatggccaagagatggaatcaacctaactatccatcagcagatgaatggataaaaaaaatgtggtgcatatacacaatgaaatactattcagccgtataaaagaaggaaatcttgtcattt
